(12) United States Patent
Scarlato et al.

(10) Patent No.: US 6,914,131 B1
(45) Date of Patent: Jul. 5, 2005

(54) NEISSERIAL ANTIGENS

(75) Inventors: Vincenzo Scarlato, Siena (IT); Vega Masignani, Siena (IT); Rino Rappuoli, Siena (IT); Mariagrazia Pizza, Siena (IT); Guido Grandi, Siena (IT)

(73) Assignee: Chiron S.r.l., Siena (IT)

( * ) Notice: Subject to any disclaimer, the term of this patent is extended or adjusted under 35 U.S.C. 154(b) by 0 days.

(21) Appl. No.: 09/303,518

(22) Filed: Apr. 30, 1999

Related U.S. Application Data

(63) Continuation-in-part of application No. PCT/IB98/01665, filed on Oct. 9, 1998.

(51) Int. Cl.[7] .................... C12Q 1/68; C12N 15/63; C12N 15/85; C07N 21/04
(52) U.S. Cl. ............... 536/23.1; 435/6; 435/320.1; 435/325; 435/252.3; 536/24.1
(58) Field of Search ............ 435/6, 252.3, 320.1, 435/325; 536/23.1, 24.1

(56) References Cited

U.S. PATENT DOCUMENTS

| | | | |
|---|---|---|---|
| 5,288,641 A | 2/1994 | Roizman | 435/320 |
| 5,422,120 A | 6/1995 | Kim | 424/450 |
| 5,580,859 A | 12/1996 | Felgner et al. | 514/44 |
| 5,591,624 A | 1/1997 | Barber et al. | 435/240.2 |
| 5,763,188 A * | 6/1998 | Ohno et al. | 435/6 |
| 6,127,180 A * | 10/2000 | Narva et al. | 435/419 |

FOREIGN PATENT DOCUMENTS

| | | |
|---|---|---|
| EP | 0 176 170 | 4/1986 |
| EP | 0 334 301 | 9/1989 |
| EP | 0 345 242 | 12/1989 |
| EP | 0 415 731 | 3/1991 |
| GB | 2 200 651 | 8/1988 |
| WO | WO 90/11092 | 10/1990 |
| WO | WO 92/05266 | 4/1992 |
| WO | WO 93/06223 | 4/1993 |
| WO | WO 93/07282 | 4/1993 |
| WO | WO 93/07283 | 4/1993 |
| WO | WO 93/14778 | 8/1993 |
| WO | WO 95/13796 | 5/1995 |
| WO | WO 95/30763 | 11/1995 |
| WO | WO 96/29412 | 9/1996 |
| WO | WO 98/20734 | 5/1998 |

OTHER PUBLICATIONS

Sayers, J.R., Database GenEmbl, Acc. # AJ001740, May 21, 1998. See sequence alignments for SEQ ID NOs 653, 649, 651.*

Meyer et al. Database GenEmbl, Acc. # A61829, Mar. 9, 1998. See sequence alignments for SEQ ID NOs 465, 463.*

Barcak et al. Database GenEmbl, Acc. # HIU20229, Feb. 9, 1995. See sequence alignments for SEQ ID NOs 131, 127, and 125.*

Paruchuri et al., Proc. Natl. Acad. Sci. USA, Vol. 87, pp. 333–337, Jan. 1990.*

Szoka, et al., "Procedure for preparation of liposomes with large internal aqueous space and high capture by reverse–phase evaporation," *Proc. Natl. Acad. Sci. USA*, 1978, *75*, 4194–4198.

Zollinger, "New and improved vaccines against meningococcal disease," *New Generation Vaccines*, 2$^{nd}$ edition, Levine, et al. (eds.), Marcel Dekker, New York, 1997, 469–488.

Kohler, et al., "Continuous cultures of fused cells secreting antibody of predefined specificity," *Nature*, 1975, *256*, 495–496.

Lieberman et al., "Safety and Immunogenicity of a Serogroups A/C *Neisseria meningitidis* Oligosaccharide–Protein Conjugate Vaccine in Young Children," *JAMA*, 1996, *275(19)*, 1499–1503.

*Morbidity and Mortality weekly report*, "Control and prevention of meningococcal disease: recommendations of the advisory commitee on immunization practices (ACIP)," 1997, *vol. 46*, No. RR–5.

Poolman, J.T., "Development of a meningococcal vaccine," *Infect. Agents Dis.*, 1992, *4*, 13–28.

Quakyi, et al., "Development of a malaria T–cell vaccine for blood stage immunity," *Scand. J. Immunol.*, 1992, *Suppl. 11*, 9–16.

Roberts, et al., "Prediction of HIV peptide epitopes by a novel algorithm," *AIDS Res. Hum. Retrovir.*, 1996, *12*, 593–610.

Robinson, et al., "DNA vaccines," *Seminars in Immunology*, 1997, *9*, 271–283.

Romero, et al., "Current status of meningococcal group B vaccine cadidates: capsular or noncapsular?," *Clin. Microbiol. Rev.*, 1994, *7(4)*, 559–575.

Rosenfeld, et al., "Adenovirus–mediated transfer of a recombinant α1–antitrypsin gene to the lung epithelium in vivo," *Science*, 1991, *252*, 431–434.

Schuchat et al., "Bacterial Meningitis in the U. S. in 1995," *N. Engl. J. Med.*, 1997, *337(14)*, 970–976.

Wedege, E., et al., "Human antibody response to a group B serotype 2a meningococcal vaccine determined by immunoblotting," *Infection and Immunity*, Feb. 1986, *51(2)*, 571–578.

Ala'Aldeen, et al., "The meningococcal transferrin–binding proteins 1 and 2 are both surface exposed and generate bactericidal antibodies capable of killing homologous and heterologous strains," *Vaccine*, 1996, *14(1)*, 49–53.

(Continued)

Primary Examiner—Ardin H. Marschel
Assistant Examiner—Shubo (Joe) Zhou
(74) Attorney, Agent, or Firm—Roberta L. Robins; Alisa A. Harbin; Robert P. Blackburn

(57) ABSTRACT

The invention provides proteins from *Neisseria meningitidis* (strains A & B) and from *Neisseria gonorrhoeae*, including amino acid sequences, the corresponding nucleotide sequences, expression data, and serological data. The proteins are useful antigens for vaccines, immunogenic compositions, and/or diagnostics.

12 Claims, 24 Drawing Sheets

OTHER PUBLICATIONS

Altschul, et al. "Gapped BLAST and PSI–BLAST: a new generation of protein database search programs," *Nucl. Acids Res.*, 1997, 25, 2289–3402.

Berkner, "Development of adenovirus vectors for the expression of heterologous genes," *Biotechniques*, 1988, 6, 616–629.

Connelly, et al., "In vivo gene delivery and expression of physiological levels of functional human factor VIII in mice," *Human Gene Therapy*, 1995, 6, 185–193.

Costantino, et al., "Development and phase I clinical testing of a conjugate vaccine against meningococcus A and C," *Vaccine*, 1992, 10, 691–698.

Donnelly, et al., "DNA vaccines," *Annu. Rev. Immunol.*, 1997, 15, 617–648.

Esposti et al., "Critical evaluation of the hydropathy of membrane proteins," *Eur. J. Biochem.*, 1990, 190, 207–219.

Gao, et al., "Identification and characterization of T helper epitopes in the nucleoprotein of influenza a virus," *J. Immunol.*, 1989, 143, 3007–3014.

Jolly, "Viral vector systems for gene therapy," *Cancer Gene Therapy*, 1994, 1, 51–64.

Kimura, et al., "Retroviral delivery of DNA into the livers of transgenic mice bearing premalignant and malignant hepatocellular carcinomas," *Human Gene Therapy*, 1994, 5, 845–852.

\* cited by examiner

M1  ORF5                    TP
              
FIG. 2A                     FIG. 2B

M1 ORF15

M2 ORF15

TP  OMV

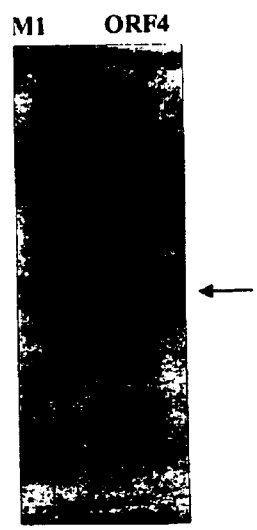
FIG. 8A
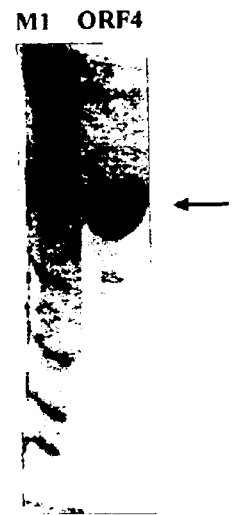
FIG. 8B
TP   OMV
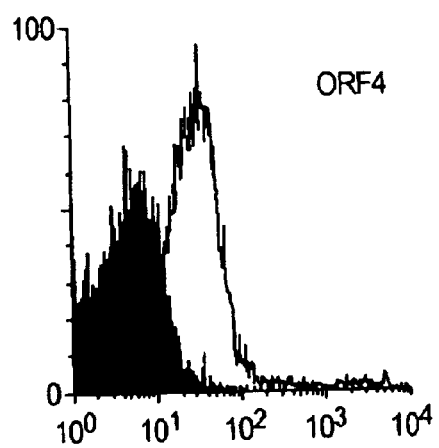
FIG. 8C
FIG. 8D

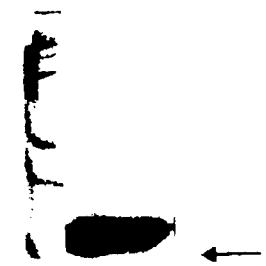
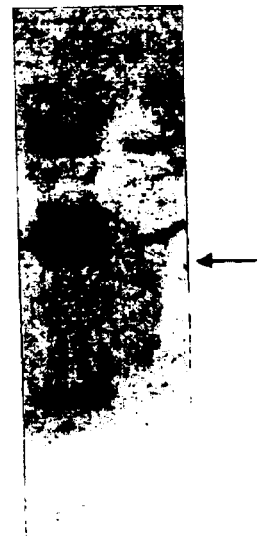
FIG. 10A  FIG. 10B
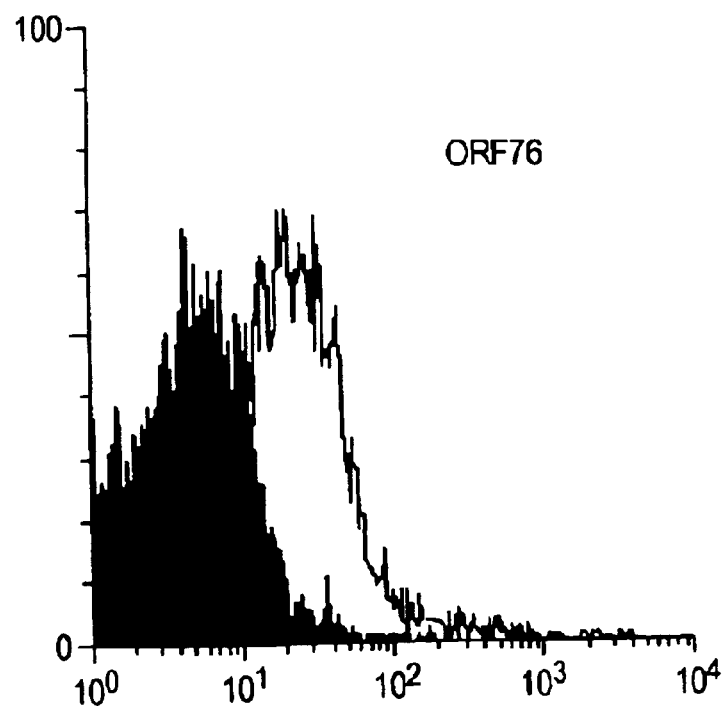
FIG. 10C

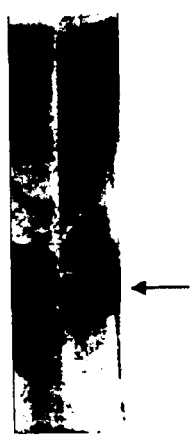 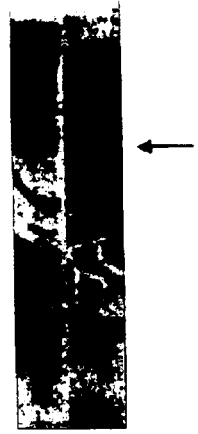 
FIG. 12A  FIG. 12B  FIG. 12C
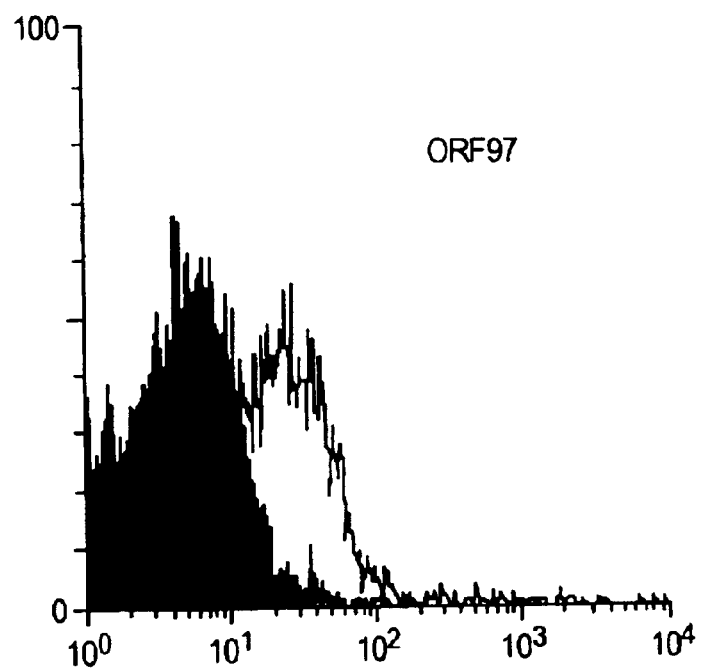
FIG. 12D

FIG. 13A  FIG. 13B
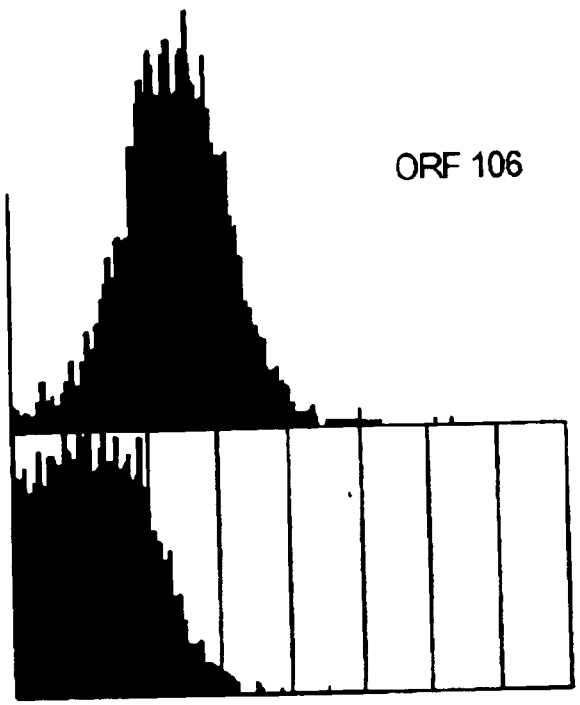
FIG. 13C

M1  ORF23　　　　　　　　M2  ORF23
   
FIG. 15A　　　　FIG. 15B
TP  OMV
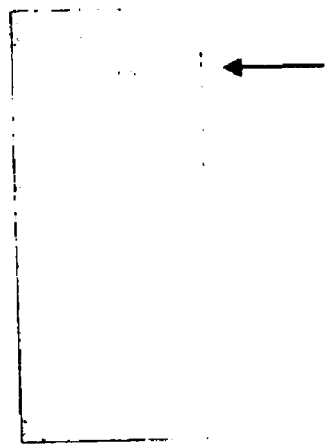
FIG. 15C

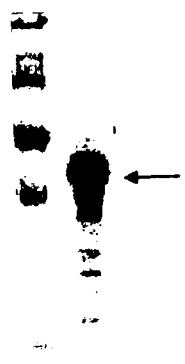
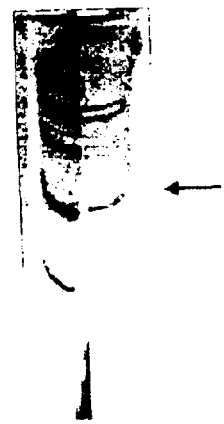
FIG. 16A  FIG. 16B  FIG. 16C
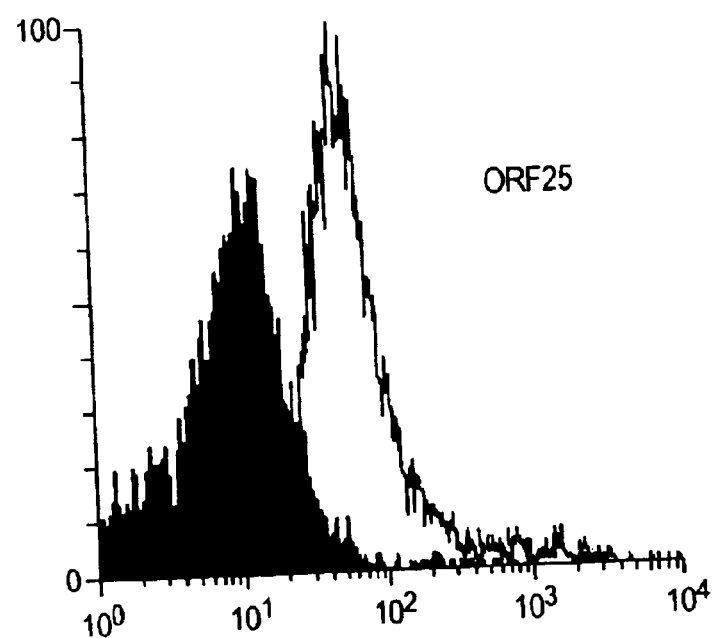
FIG. 16D

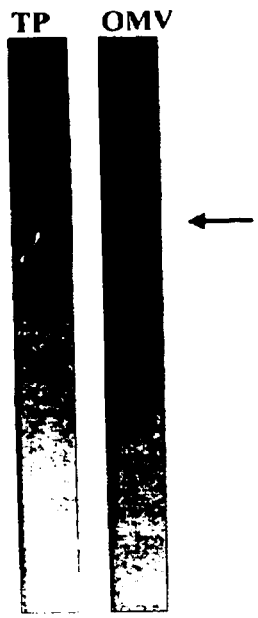
FIG. 19A  FIG. 19B
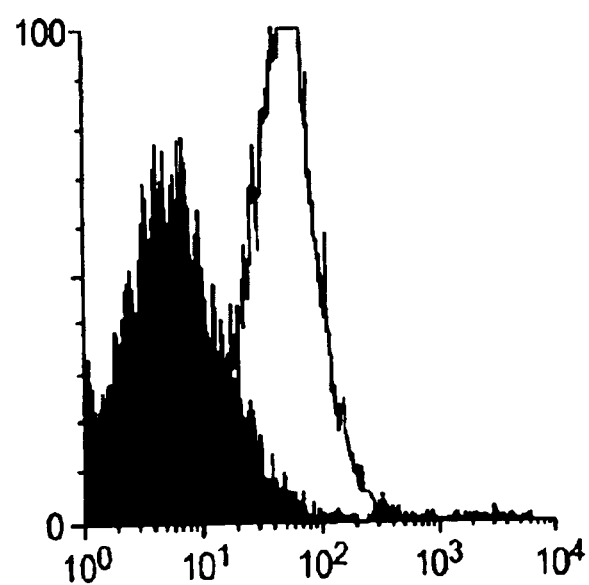
FIG. 19C

M1 ORF132

M2 ORF132

FIG. 20A          FIG. 20B

ORF132

FIG. 20C

NEISSERIAL ANTIGENS

This application is a continuation-in-part of international patent application PCT/IB98/01665, filed Oct. 9, 1998, from which priority is claimed under 35 U.S.C. § 120.

This invention relates to antigens from *Neisseria* bacteria.

BACKGROUND ART

*Neisseria meningitidis* and *Neisseria gonorrhoeae* are non-motile, gram negative diplococci that are pathogenic in humans. *N.meningitidis* colonises the pharynx and causes meningitis (and, occasionally, septicaemia in the absence of meningitis); *N.gonorrhoeae* colonises the genital tract and causes gonorrhea. Although colonising different areas of the body and causing completely different diseases, the two pathogens are closely related, although one feature that clearly differentiates meningococcus from gonococcus is the presence of a polysaccharide capsule that is present in all pathogenic meningococci.

*N.gonorrhoeae* caused approximately 800,000 cases per year during the period 1983–1990 in the United States alone (chapter by Meitzner & Cohen, "Vaccines Against Gonococcal Infection", In: *New Generation Vaccines*, 2nd edition, ed. Levine, Woodrow, Kaper, & Cobon, Marcel Dekker, New York, 1997, pp.817–842). The disease causes significant morbidity but limited mortality. Vaccination against *N.gonorrhoeae* would be highly desirable, but repeated attempts have failed. The main candidate antigens for this vaccine are surface-exposed proteins such as pili, porins, opacity-associated proteins (Opas) and other surface-exposed proteins such as the Lip, Laz, IgA1 protease and transferrin-binding proteins. The lipooligosaccharide (LOS) has also been suggested as vaccine (Meitzner & Cohen, supra).

*N.meningitidis* causes both endemic and epidemic disease. In the United States the attack rate is 0.6–1 per 100,000 persons per year, and it can be much greater during outbreaks (see Lieberman et al. (1996) Safety and Immunogenicity of a Serogroups A/C *Neisseria meningitidis* Oligosaccharide-Protein Conjugate Vaccine in Young Children. *JAMA* 275(19):1499–1503; Schuchat et al (1997) Bacterial Meningitis in the United States in 1995. *N Engl J Med* 337(14):970–976). In developing countries, endemic disease rates are much higher and during epidemics incidence rates can reach 500 cases per 100,000 persons per year. Mortality is extremely high, at 10–20% in the United States, and much higher in developing countries. Following the introduction of the conjugate vaccine against *Haemophilus influenzae*, *N. meningitidis* is the major cause of bacterial meningitis at all ages in the United States (Schuchat et al (1997) supra).

Based on the organism's capsular polysaccharide, 12 serogroups of *N.meningitidis* have been identified. Group A is the pathogen most often implicated in epidemic disease in sub-Saharan Africa. Serogroups B and C are responsible for the vast majority of cases in the United States and in most developed countries. Serogroups W135 and Y are responsible for the rest of the cases in the United States and developed countries. The meningococcal vaccine currently in use is a tetravalent polysaccharide vaccine composed of serogroups A, C, Y and W135. Although efficacious in adolescents and adults, it induces a poor immune response and short duration of protection, and cannot be used in infants [eg. Morbidity and Mortality weekly report, Vol.46, No. RR-5 (1997)]. This is because polysaccharides are T-cell independent antigens that induce a weak immune response that cannot be boosted by repeated immunization. Following the success of the vaccination against *H.influenzae*, conjugate vaccines against serogroups A and C have been developed and are at the final stage of clinical testing (Zollinger W D "New and Improved Vaccines Against Meningococcal Disease" in: *New Generation Vaccines*, supra, pp. 469–488; Lieberman et al (1996) supra; Costantino et al (1992) Development and phase I clinical testing of a conjugate vaccine against meningococcus A and C. *Vaccine* 10:691–698).

Meningococcus B remains a problem, however. This serotype currently is responsible for approximately 50% of total meningitis in the United States, Europe, and South America. The polysaccharide approach cannot be used because the menB capsular polysaccharide is a polymer of α(2–8)-linked N-acetyl neuraminic acid that is also present in mammalian tissue. This results in tolerance to the antigen; indeed, if an immune response were elicited, it would be anti-self, and therefore undesirable. In order to avoid induction of autoimmunity and to induce a protective immune response, the capsular polysaccharide has, for instance, been chemically modified substituting the N-acetyl groups with N-propionyl groups, leaving the specific antigenicity unaltered (Romero & Outschoorn (1994) Current status of Meningococcal group B vaccine candidates: capsular or non-capsular. *Clin Microbiol Rev* 7(4):559–575).

Alternative approaches to menB vaccines have used complex mixtures of outer membrane proteins (OMPs), containing either the OMPs alone, or OMPs enriched in porins, or deleted of the class 4 OMPs that are believed to induce antibodies that block bactericidal activity. This approach produces vaccines that are not well characterized. They are able to protect against the homologous strain, but are not effective at large where there are many antigenic variants of the outer membrane proteins. To overcome the antigenic variability, multivalent vaccines containing up to nine different porins have been constructed (eg. Poolman J T (1992) Development of a meningococcal vaccine. *Infect. Agents Dis.* 4:13–28). Additional proteins to be used in outer membrane vaccines have been the opa and opc proteins, but none of these approaches have been able to overcome the antigenic variability (eg. Ala'Aldeen & Borriello (1996) The meningococcal transferrin-binding proteins 1 and 2 are both surface exposed and generate bactericidal antibodies capable of killing homologous and heterologous strains. *Vaccine* 14(1):49–53).

A certain amount of sequence data is available for meningococcal and gonoccocal genes and proteins (eg. EP-A-0467714, WO96/29412), but this is by no means complete. The provision of further sequences could provide an opportunity to identify secreted or surface-exposed proteins that are presumed targets for the immune system and which are not antigenically variable. For instance, some of the identified proteins could be components of efficacious vaccines against meningococcus B, some could be components of vaccines against all meningococcal serotypes, and others could be components of vaccines against all pathogenic Neisseriae.

THE INVENTION

The invention provides proteins comprising the Neisserial amino acid sequences disclosed in the examples. These sequences relate to *N.meningitidis* or *N.gonorrhoeae*.

It also provides proteins comprising sequences homologous (ie. having sequence identity) to the Neisserial amino acid sequences disclosed in the examples. Depending on the particular sequence, the degree of identity is preferably greater than 50% (eg. 65%, 80%, 90%, or more). These homologous proteins include mutants and allelic variants of the sequences disclosed in the examples. Typically, 50% identity or more between two proteins is considered to be an indication of functional equivalence. Identity between the proteins is preferably determined by the Smith-Waterman homology search algorithm as implemented in the MPSRCH program (Oxford Molecular), using an affine gap search with parameters gap open penalty=12 and gap extension penalty=1.

The invention further provides proteins comprising fragments of the Neisserial amino acid sequences disclosed in the examples. The fragments should comprise at least n consecutive amino acids from the sequences and, depending on the particular sequence, n is 7 or more (eg. 8, 10, 12, 14, 16, 18, 20 or more). Preferably the fragments comprise an epitope from the sequence.

The proteins of the invention can, of course, be prepared by various means (eg. recombinant expression, purification from cell culture, chemical synthesis etc.) and in various forms (eg. native, fusions etc.). They are preferably prepared in substantially pure or isolated form (ie. substantially free from other Neisserial or host cell proteins)

According to a further aspect, the invention provides antibodies which bind to these proteins. These may be polyclonal or monoclonal and may be produced by any suitable means.

According to a further aspect, the invention provides nucleic acid comprising the Neisserial nucleotide sequences disclosed in the examples. In addition, the invention provides nucleic acid comprising sequences homologous (ie. having sequence identity) to the Neisserial nucleotide sequences disclosed in the examples.

Furthermore, the invention provides nucleic acid which can hybridise to the Neisserial nucleic acid disclosed in the examples, preferably under "high stringency" conditions (eg. 65° C. in a 0.1×SSC, 0.5% SDS solution).

Nucleic acid comprising fragments of these sequences are also provided. These should comprise at least n consecutive nucleotides from the Neisserial sequences and, depending on the particular sequence, n is 10 or more (eg 12, 14, 15, 18, 20, 25, 30, 35, 40 or more).

According to a further aspect, the invention provides nucleic acid encoding the proteins and protein fragments of the invention.

It should also be appreciated that the invention provides nucleic acid comprising sequences complementary to those described above (eg. for antisense or probing purposes).

Nucleic acid according to the invention can, of course, be prepared in many ways (eg. by chemical synthesis, from genomic or cDNA libraries, from the organism itself etc.) and can take various forms (eg. single stranded, double stranded, vectors, probes etc.).

In addition, the term "nucleic acid" includes DNA and RNA, and also their analogues, such as those containing modified backbones, and also peptide nucleic acids (PNA) etc.

According to a further aspect, the invention provides vectors comprising nucleotide sequences of the invention (eg. expression vectors) and host cells transformed with such vectors.

According to a further aspect, the invention provides compositions comprising protein, antibody, and/or nucleic acid according to the invention. These compositions may be suitable as vaccines, for instance, or as diagnostic reagents, or as immunogenic compositions.

The invention also provides nucleic acid, protein, or antibody according to the invention for use as medicaments (eg. as vaccines) or as diagnostic reagents. It also provides the use of nucleic acid, protein, or antibody according to the invention in the manufacture of: (i) a medicament for treating or preventing infection due to Neisserial bacteria; (ii) a diagnostic reagent for detecting the presence of Neisserial bacteria or of antibodies raised against Neisserial bacteria; and/or (iii) a reagent which can raise antibodies against Neisserial bacteria. Said Neisserial bacteria may be any species or strain (such as *N.gonorrhoeae*, or any strain of *N.meningitidis*, such as strain A, strain B or strain C).

The invention also provides a method of treating a patient, comprising administering to the patient a therapeutically effective amount of nucleic acid, protein, and/or antibody according to the invention.

According to further aspects, the invention provides various processes.

A process for producing proteins of the invention is provided, comprising the step of culturing a host cell according to the invention under conditions which induce protein expression.

A process for producing protein or nucleic acid of the invention is provided, wherein the the protein or nucleic acid is synthesised in part or in whole using chemical means.

A process for detecting polynucleotides of the invention is provided, comprising the steps of: (a) contacting a nucleic probe according to the invention with a biological sample under hybridizing conditions to form duplexes; and (b) detecting said duplexes.

A process for detecting proteins of the invention is provided, comprising the steps of: (a) contacting an antibody according to the invention with a biological sample under conditions suitable for the formation of an antibody-antigen complexes; and (b) detecting said complexes.

A summary of standard techniques and procedures which may be employed in order to perform the invention (eg. to utilise the disclosed sequences for vaccination or diagnostic purposes) follows. This summary is not a limitation on the invention but, rather, gives examples that may be used, but are not required.

General

The practice of the present invention will employ, unless otherwise indicated, conventional techniques of molecular biology, microbiology, recombinant DNA, and immunology, which are within the skill of the art. Such techniques are explained fully in the literature eg. Sambrook *Molecular Cloning; A Laboratory Manual, Second Edition* (1989); *DNA Cloning, Volumes I and ii* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein*

*Purification: Principles and Practice*, Second Edition (Springer-Verlag, N.Y.), and *Handbook of Experimental Immunology*, Volumes I–IV (D. M. Weir and C. C. Blackwell eds 1986).

Standard abbreviations for nucleotides and amino acids are used in this specification.

All publications, patents, and patent applications cited herein are incorporated in full by reference. In particular, the contents of UK patent applications 9723516.2, 9724190.5, 9724386.9, 9725158.1, 9726147.3, 9800759.4, and 9819016.8 are incorporated herein.

Definitions

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

The term "comprising" means "including" as well as "consisting" eg. a composition "comprising" X may consist exclusively of X or may include something additional to X, such as X+Y.

A "conserved" Neisseria amino acid fragment or protein is one that is present in a particular Neisserial protein in at least x % of Neisseria. The value of x may be 50% or more, e.g., 66%, 75%, 80%, 90%, 95% or even 100% (i.e. the amino acid is found in the protein in question in all Neisseria). In order to determine whether an animo acid is "conserved" in a particular Neisserial protein, it is necessary to compare that amino acid residue in the sequences of the protein in question from a plurality of different Neisseria (a reference population). The reference population may include a number of different Neisseria species or may include a single species. The reference population may include a number of different serogroups of a particular species or a single serogroup. A preferred reference population consists of the 5 most common Neisseria. The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to the gene. Another example is where a Neisserial sequence is heterologous to a mouse host cell. A further examples would be two epitopes from the same or different proteins which have been assembled in a single protein in an arrangement not found in nature.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

A "mutant" sequence is defined as DNA, RNA or amino acid sequence differing from but having sequence identity with the native or disclosed sequence. Depending on the particular sequence, the degree of sequence identity between the native or disclosed sequence and the mutant sequence is preferably greater than 50% (eg. 60%, 70%, 80%, 90%, 95%, 99% or more, calculated using the Smith-Waterman algorithm as described above). As used herein, an "allelic variant" of a nucleic acid molecule, or region, for which nucleic acid sequence is provided herein is a nucleic acid molecule, or region, that occurs essentially at the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions (eg. see U.S. Pat. No. 5,753,235).

Expression Systems

The Neisserial nucleotide sequences can be expressed in a variety of different expression systems; for example those used with mammalian cells, baculoviruses, plants, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (eg. structural gene) into mRNA. A promoter will have a transcription initiating region, which is usually placed proximal to the 5' end of the coding sequence, and a TATA box, usually located 25–30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation [Sambrook et al. (1989) "Expression of Cloned Genes in Mammalian Cells." In *Molecular Cloning: A Laboratory Manual*, 2nd ed.].

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallotheionein gene, also provide useful promoter sequences. Expression may be either constitutive or regulated (inducible), depending on the promoter can be induced with glucocorticoid in hormone-responsive cells.

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter [Maniatis et al. (1987) *Science* 236:1237; Alberts et al. (1989) *Molecular Biology of the Cell*, 2nd ed.]. Enhancer elements derived from viruses may be particularly useful, because they usually have a broader host range. Examples include the SV40 early gene enhancer [Dijkema et al (1985) *EMBO J.* 4:761] and the enhancer/promoters derived from the long terminal repeat (LTR) of the Rous Sarcoma Virus [Gorman et al. (1982b) *Proc. Natl. Acad. Sci.* 79:6777] and from human cytomegalovirus [Boshart et al. (1985) *Cell* 41:521]. Additionally, some enhancers are regulatable and become active only in the presence of an inducer, such as a hormone or metal ion [Sassone-Corsi and Borelli (1986) *Trends Genet.* 2:215; Maniatis et al. (1987) *Science* 236:1237].

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus triparite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation [Birnstiel et al. (1985) *Cell* 41:349; Proudfoot and Whitelaw (1988) "Termination and 3' end processing of eukaryotic RNA. In *Transcription and splicing* (ed. B. D. Hames and D. M. Glover); Proudfoot (1989) *Trends Biochem. Sci.* 14:105]. These sequences direct the transcription of an mRNA which can be translated into the polypeptide encoded by the DNA. Examples of transcription terminater/polyadenylation signals include those derived from SV40 [Sambrook et al (1989) "Expression of cloned genes in cultured mammalian cells." In *Molecular Cloning: A Laboratory Manual*].

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (eg. plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 [Gluzman (1981) *Cell* 23:175] or polyomavirus, replicate to extremely high copy number in the presence of the appropriate viral T antigen. Additional examples of mammalian replicons include those derived from bovine papillomavirus and Epstein-Barr virus. Additionally, the replicon may have two replicaton systems, thus allowing it to be maintained, for example, in mammalian cells for expression and in a prokaryotic host for cloning and amplification. Examples of such mammalian-bacteria shuttle vectors include pMT2 [Kaufman et al. (1989) *Mol. Cell. Biol.* 9:946] and pHEBO [Shimizu et al. (1986) *Mol. Cell. Biol.* 6:1074].

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (eg. Hep G2), and a number of other cell lines.

ii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and methods for baculovirus/insect cell expression systems are commercially available in kit form from, inter alia, Invitrogen, San Diego Calif. ("MaxBac" kit). These techniques are generally known to those skilled in the art and fully described in Summers and Smith, *Texas Agricultural Experiment Station Bulletin No.* 1555 (1987) (hereinafter "Summers and Smith").

Prior to inserting the DNA sequence encoding the protein into the baculovirus genome, the above described components, comprising a promoter, leader (if desired), coding sequence of interest, and transcription termination sequence, are usually assembled into an intermediate transplacement construct (transfer vector). This construct may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extrachromosomal element (eg. plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, *Virology* (1989) 17:31.

The plasmid usually also contains the polyhedrin polyadenylation signal (Miller et al. (1988) *Ann. Rev. Microbiol.*, 42:177) and a prokaryotic ampicillin-resistance (amp) gene and origin of replication for selection and propagation in *E. coli*.

Baculovirus transfer vectors usually contain a baculovirus promoter. A baculovirus promoter is any DNA sequence capable of binding a baculovirus RNA polymerase and initiating the downstream (5' to 3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from, genes for secreted insect or baculovirus proteins, such as the baculovirus polyhedrin gene (Carbonell et al. (1988) *Gene*, 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human α-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA*, 82:8404; mouse IL-3, (Miyajima et al., (1987) *Gene* 58:273; and human glucocerebrosidase, Martin et al. (1988) *DNA*, 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2–5 kb section of the baculovirus genome. Methods for introducing heterologous DNA into the desired site in the baculovirus virus are known in the art. (See Summers and Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91. The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 □m in size, are highly refractile, giving them a bright shiny appearance that is readily visualized under the light microscope. Cells infected with recombinant viruses lack occlusion bodies. To distinguish recombinant virus from wild-type virus, the transfection supernatant is plaqued onto a monolayer of insect cells by techniques known to those skilled in the art. Namely, the plaques are screened under the light microscope for the presence (indicative of wild-type virus) or absence (indicative of recombinant virus) of occlusion bodies. "Current Protocols in Microbiology" Vol. 2 (Ausubel et al. eds) at 16.8 (Supp. 10, 1990); Summers and Smith, supra; Miller et al. (1989).

Recombinant baculovirus expression vectors have been developed for infection into several insect cells. For example, recombinant baculoviruses have been developed for, inter alia: *Aedes aegypti, Autographa californica, Bombyx mori, Drosophila melanogaster, Spodoptera frugiperda*, and *Trichoplusia ni* (WO 89/046699; Carbonell et al., (1985) *J. Virol.* 56:153; Wright (1986) *Nature* 321:718; Smith et al., (1983) *Mol. Cell. Biol.* 3:2156; and see generally, Fraser, et al. (1989) *In Vitro Cell. Dev. Biol.* 25:225).

Cells and cell culture media are commercially available for both direct and fusion expression of heterologous polypeptides in a baculovirus/expression system; cell culture technology is generally known to those skilled in the art. See, eg. Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, eg. HPLC, affinity chromatography, ion exchange chromatography, etc.; electrophoresis; density gradient centrifugation; solvent extraction, or the like. As appropriate, the product may be further purified, as required, so as to remove substantially any insect proteins which are also secreted in the medium or result from lysis of insect cells, so as to provide a product which is at least substantially free of host debris, eg. proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iii. Plant Systems

There are many plant cell culture and whole plant genetic expression systems known in the art. Exemplary plant cellular genetic expression systems include those described in patents, such as: U.S. Pat. No. 5,693,506; U.S. Pat. No. 5,659,122; and U.S. Pat. No. 5,608,143. Additional examples of genetic expression in plant cell culture has been described by Zenk, *Phytochemistry* 30:3861–3863 (1991). Descriptions of plant protein signal peptides may be found in addition to the references described above in Vaulcombe et al., *Mol. Gen. Genet.* 209:3340 (1987); Chandler et al., *Plant Molecular Biology* 3:407–418 (1984); Rogers, *J. Biol. Chem.* 260:3731–3738 (1985); Rothstein et al., *Gene* 55:353–356 (1987); Whittier et al., Nucleic Acids Research 15:2515–2535 (1987); Wirsel et al., *Molecular Microbiology* 3:3–14 (1989); Yu et al., *Gene* 122:247–253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology*, Malcolm B. Wilkins, ed., 1984 Pitman Publishing Limited, London, pp. 21–52. References that describe other metabolically-regulated genes: Sheen, *Plant Cell*, 2:1027–1038(1990); Maas et al., *EMBO J.* 9:3447–3452 (1990); Benkel and Hickey, *Proc. Natl. Acad. Sci.* 84:1337–1339 (1987)

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for Agrobacterium transformations, T DNA sequences for Agrobacterium-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr*, 11(2):165–185.

Sequences suitable for permitting integration of the heterologous sequence into the plant genome are also recommended. These might include transposon sequences and the like for homologous recombination as well as Ti sequences which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "Intron" region may be conducted to prevent losing a portion of the genetic message as a false intron code, Reed and Maniatis, *Cell* 41:95–105, 1985.

The vector can be microinjected directly into plant cells by use of micropipettes to mechanically transfer the recombinant DNA. Crossway, *Mol. Gen. Genet*, 202:179–185, 1985. The genetic material may also be transferred into the plant cell by using polyethylene glycol, Krens, et al., *Nature*, 296, 72–74, 1982. Another method of introduction of nucleic acid segments is high velocity ballistic penetration by small particles with the nucleic acid either within the matrix of small beads or particles, or on the surface, Klein, et al., *Nature*, 327, 70–73, 1987 and Knudsen and Muller, 1991, *Planta*, 185:330–336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad Sci. USA*, 79, 1859–1863, 1982.

The vector may also be introduced into the plant cells by electroporation. (Fromm et al., *Proc. Natl Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Lolium, Zea, Triticum, Sorghum, and Datura.

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iv. Bacterial Systems

Bacterial expression techniques are known in the art. A bacterial promoter is any DNA sequence capable of binding bacterial RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) [Raibaud et al. (1984) *Annu. Rev. Genet.* 18:173]. Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) [Chang et al. (1977) *Nature* 198:1056], and maltose. Additional examples include promoter sequences derived from biosynthetic enzymes such as tryptophan (trp) [Goeddel et al. (1980) *Nuc. Acids Res.* 8:4057; Yelverton et al. (1981) *Nucl. Acids Res.* 9:731; U.S. Pat. No. 4,738,921; EP-A-0036776 and EP-A-0121775]. The g-laotamase (bla) promoter system [Weissmann (1981) "The cloning of interferon and other mistakes." In *Interferon* 3 (ed. I. Gresser)], bacteriophage lambda PL [Shimatake et al. (1981) *Nature* 292:128] and T5 [U.S. Pat. No. 4,689,406] promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter [U.S. Pat. No. 4,551, 433]. For example, the tac promoter is a hybrid trp-lac promoter comprised of both trp promoter and lac operon sequences that is regulated by the lac repressor [Amann et al. (1983) *Gene* 25:167; de Boer et al. (1983) *Proc. Natl. Acad. Sci.* 80:21]. Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system [Studier et al. (1986) *J. Mol. Biol.* 189:113; Tabor et al. (1985) *Proc Natl. Acad. Sci.* 82:1074). In addition, a hybrid promoter can also be comprised of a bacteriophage promoter and an *E. coli* operator region (EPO-A-0 267 851).

In addition to a functioning promoter sequence, an efficient ribosome binding site is also useful for the expression of foreign genes in prokaryotes. In *E. coli*, the ribosome binding site is called the Shine-Dalgarno (SD) sequence and includes an initiation codon (ATG) and a sequence 3–9 nucleotides in length located 3–11 nucleotides upstream of the initiation codon [Shine et al. (1975) *Nature* 254:34]. The SD sequence is thought to promote binding of mRNA to the ribosome by the pairing of bases between the SD sequence and the 3' and of *E. coli* 16S rRNA [Steitz et al. (1979) "Genetic signals and nucleotide sequences in messenger RNA." In Biological Regulation and Development: Gene Expression (ed. R. F. Goldberger)]. To express eukaryotic genes and prokaryotic genes with weak ribosome-binding site [Sambrook et al. (1989) "Expression of cloned genes in *Escherichia coli*." In *Molecular Cloning: A Laboratory Manual*].

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo on in vitro incubation with a bacterial methionine N-terminal peptidase (EPO-A0 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene [Nagai et al. (1984) *Nature* 309:810]. Fusion proteins can also be made with sequences from the lacZ [Jia et al. (1987) *Gene* 60:197], trpE [Allen et al. (1987) *J. Biotechnol.* 5:93; Makoff et al. (1989) *J. Gen. Microbiol.* 135:11], and Chey [EP-A-0 324 647] genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (eg. ubiquitin specific processing-protease) to cleave the ubiquitin from the foreign protein. Through this method, native foreign protein can be isolated [Miller et al. (1989) *Bio/Technology* 7:698].

Alternatively, foreign proteins can also be secreted from the cell by creating chimeric DNA molecules that encode a fusion protein comprised of a signal peptide sequence fragment that provides for secretion of the foreign protein in bacteria [U.S. Pat. No. 4,336,336]. The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the *E. coli* outer membrane protein gene (ompA) [Masui et al. (1983), in: *Experimental Manipulation of Gene Expression*; Ghrayeb et al. (1984) *EMBO J.* 3:2437] and the *E. coli* alkaline phosphatase signal sequence (phoA) [Oka et al. (1985) *Proc. Natl. Acad. Sci.* 82:7212]. As an additional example, the signal sequence of the alpha-amylase gene from various Bacillus strains can be used to secrete heterologous proteins from *B. subtilis* [Palva et al. (1982) *Proc. Natl. Acad. Sci. USA* 79:5582; EP-A-0 244 042].

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (eg. plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various Bacillus strains integrate into the Bacillus chromosome (EP-A-0 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline [Davies et al. (1978) *Annu. Rev. Microbiol.* 32:469]. Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extrachromosomal replicons or integrating vectors, have been developed for transformation into many bacteria. For example, expression vectors have been developed for, inter alia, the following bacteria: *Bacillus subtilis* [Palva et al. (1982) *Proc. Natl. Acad. Sci. USA* 79:5582; EP-A-0 036 259 and EP-A-0 063 953; WO 84/04541], *Escherichia coli* [Shimatake et al. (1981) *Nature* 292:128; Amann et al. (1985) *Gene* 40:183; Studier et al. (1986) *J. Mol. Biol.* 189:113; EP-A-0 036 776, EP-A-0 136 829 and EP-A-0 136 907], *Streptococcus cremoris* [Powell et al. (1988) *Appl. Environ. Microbiol.* 54:655]; *Streptococcus lividans* [Powell et al. (1988) *Appl. Environ. Microbiol.* 54:655], *Streptomyces lividans* [U.S. Pat. No. 4,745,056].

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. See eg. [Masson et al. (1989) *FEMS Microbiol. Lett.* 60:273; Palva et al. (1982) *Proc. Natl. Acad. Sci. USA* 79:5582; EP-A0 036 259 and EP-A-0 063,953; WO 84/04541, Bacillus], (Miller et al. (1988) *Proc. Natl. Acad. Sci.* 85:856; Wang et al. (1990) *J. Bacteriol.* 172:949, Campylobacter], [Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE1-derived plasmids. In *Genetic Engineering: Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; Escherichia], [Chassy et al. (1987) *FEMS Microbiol. Lett.* 44:173 Lactobacillus]; [Fiedler et al. (1988) *Anal. Biochem* 170:38, Pseudomonas];

[Augustin et al. (1990) *FEMS Microbiol. Lett.* 66:203, Staphylococcus], [Barany et al. (1980) *J. Bacteriol.* 144:698; Harlander (1987) "Transformation of *Streptococcus lactis* by electroporation, in: *Strepiococcal Genetics* (ed. J. Ferretti and R. Curtiss III); Perry et al. (1981) *Infect. Immun.* 32:1295; Powell et al. (1988) *Appl. Environ. Microbiol.* 54:655; Somkuti et al. (1987) *Proc. 4th Evr. Cong. Biotechnology* 1:412, Streptococcus].

v. Yeast Expression

Yeast expression systems are also known to one of ordinary skill in the art. A yeast promoter is any DNA sequence capable of binding yeast RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EP-A-0 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO-A-0 329 203). The yeast PHO5 gene, encoding acid phosphatase, also provides useful promoter sequences [Myanohara et al. (1983) *Proc. Natl. Acad, Sci. USA* 80:1].

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876,197 and 4,880,734). Other examples of hybrid promoters include promoters which consist of the regulatory sequences of either the ADH2, GAL4, GAL10, OR PHO5 genes, combined with the transcriptional activation region of a glycolytic enzyme gene such as GAP or PyK (EP-A-0 164 556). Furthermore, a yeast promoter can include naturally occurring promoters of non-yeast origin that have the ability to bind yeast RNA polymerase and initiate transcription. Examples of such promoters include, inter alia, [Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast Saccharomyces cerevisiae," in: *Plasmids of Medical, Environmental and Commercial Importance* (eds. K. N. Timmis and A. Puhler); Mercerau-Puigalon et al. (1980) *Gene* 11:163; Panthier et al. (1980) *Curr. Genet.* 2:109].

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See eg. EP-A-0 196 056. Another example is a ubiquitin fusion protein. Such a fusion protein is made with the ubiquitin region that preferably retains a site for a processing enzyme (eg. ubiquitin-specific processing protease) to cleave the ubiquitin from the foreign protein. Through this method, therefore, native foreign protein can be isolated (eg. WO88/024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EP-A-0 012 873; JPO. 62,096,086) and the A-factor gene (U.S. Pat. No. 4,588,684). Alternatively, leaders of non-yeast origin, such as an interferon leader, exist that also provide for secretion in yeast (EP-A-0 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EP-A-0 324 274). Additional leaders employing an alpha-factor leader fragment that provides for secretion include hybrid alpha-factor leaders made with a presequence of a first yeast, but a pro-region from a second yeast alphafactor. (eg. see WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (eg. plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 [Botstein et al. (1979) *Gene*

8:17–24], pCl/1 [Brake et al. (1984) *Proc. Natl. Acad. Sci USA* 81:4642–4646], and YRp17 [Stinchcomb et al. (1982) *J. Mol. Biol.* 158:157]. In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See eg. Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome [Orr-Weaver et al. (1983) *Methods in Enzymol.* 101:228–245]. An integrating vector may be directed to a specific locus in yeast by selecting the appropriate homologous sequence for inclusion in the vector. See Orr-Weaver et al., supra. One or more expression construct may integrate, possibly affecting levels of recombinant protein produced [Rine et al. (1983) *Proc. Natl. Acad. Sci. USA* 80:6750]. The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions [Butt et al. (1987) *Microbiol, Rev.* 51:351].

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors have been developed for, inter alia, the following yeasts: Candida albicans [Kurtz, et al. (1986) *Mol. Cell. Biol.* 6:142], Candida maltosa [Kunze, et al. (1985) *J. Basic Microbiol.* 25:141]. Hansenula polymorpha [Gleeson, et al. (1986) *J. Gen. Microbiol.* 132:3459; Roggenkamp et al. (1986) *Mol. Gen. Genet.* 202:302], Kluyveromyces fragilis [Das, et al. (1984) *J. Bacteriol.* 158:1165], Kluyveromyces lactis [De Louvencourt et al. (1983) *J. Bacteriol.* 154:737; Van den Berg et al. (1990) *Bio/Technology* 8:135], Pichia guillerimondii [Kunze et al. (1985) *J. Basic Microbiol.* 25:141], Pichia pastoris [Cregg, et al. (1985) *Mol. Cell. Biol.* 5:3376; U.S. Pat. Nos. 4,837, 148 and 4,929,555], Saccharomyces cerevisiae [Hinnen et al. (1978) *Proc. Natl. Acad. Sci. USA* 75:1929; Ito et al. (1983) *J. Bacteriol.* 153:163], Schizosaccharomyces pombe [Beach and Nurse (1981) *Nature* 300:706], and Yarrowia lipolytica [Davidow, et al. (1985) *Curr. Genet.* 10:380471 Gaillardin, et al. (1985) *Curr. Genet.* 10:49].

Methods of introducing exogenous DNA into yeast hosts are well-known in the art, and usually include either the transformation of spheroplasts or of intact yeast cells treated with alkali cations. Transformation procedures usually vary with the yeast species to be transformed. See eg. [Kurtz et al. (1986) *Mol. Cell. Biol.* 6:142; Kunze et al. (1985) *J. Basic Microbiol.* 25:141; Candida]; [Gleeson et al. (1986) *J. Gen. Microbiol.* 132:3459; Roggenkamp et al. (1986) *Mol. Gen. Genet.* 202:302; Hansenula]; [Das et al. (1984) *J. Bacteriol.* 158:1165; De Louvencourt et al. (1983) *J. Bacteriol.* 154:1165; Van den Berg et al. (1990) *Bio/Technology* 8:135; Kluyveromyces]; [Cregg et al. (1985) *Mol. Cell. Biol.* 5:3376; Kunze et al. (1985) *J. Basic Microbiol.* 25:141; U.S. Pat. Nos. 4,837,148 and 4,929,555; Pichia]; [Hinnen et al. (1978) *Proc. Natl. Acad. Sci. USA* 75;1929; Ito et al. (1983) *J. Bacteriol.* 153:163 Saccharomyces]; [Beach and Nurse (1981) *Nature* 300:706; Schizosaccharomyces]; [Davidow et al. (1985) *Curr. Genet.* 10:39; Gaillardin et al. (1985) *Curr. Genet.* 10:49; Yarrowia].

Antibodies

As used herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanised antibodies, altered antibodies, univalent antibodies, Fab proteins, and single domain antibodies.

Antibodies against the proteins of the invention are useful for affinity chromatography, immunoassays, and distinguishing/identifying Neisserial proteins.

Antibodies to the proteins of the invention, both polyclonal and monoclonal, may be prepared by conventional methods. In general, the protein is first used to immunize a suitable animal, preferably a mouse, rat, rabbit or goat. Rabbits and goats are preferred for the preparation of polyclonal sera due to the volume of serum obtainable, and the availability of labeled anti-rabbit and anti-goat antibodies. Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50–200 µg/injection is typically sufficient. Immunization is generally boosted 2–6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25° C. for one hour, followed by incubating at 4° C. for 2–18 hours. The serum is recovered by centrifugation (eg. 1,000 g for 10 minutes). About 20–50 ml per bleed may be obtained from rabbits.

Monoclonal antibodies are prepared using the standard method of Kohler & Milstein [*Nature* (1975) 256:495–96], or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells expressing membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (eg. hypoxanthine, aminopterin, thymidine medium, "HAT"). The resulting hybridomas are plated by limiting dilution, and are assayed for the production of antibodies which bind specifically to the immunizing antigen (and which do not bind to unrelated antigens). The selected MAb-secreting hybridomas are then cultured either in vitro (eg. in tissue culture bottles or hollow fiber reactors), or in vivo (as ascites in mice).

If desired, the antibodies (whether polyclonal or monoclonal) may be labeled using conventional techniques. Suitable labels include fluorophores, chromophores, radioactive atoms (particularly $^{32}$P and $^{125}$I, electron-dense reagents, enzymes, and ligands having specific binding partners. Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}$I may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}$I, or with an anti-biotin MAb labeled with HRP. Other permutations and possibilities will be readily apparent to those of ordinary skill in the art, and are considered as equivalents within the scope of the instant invention.

Pharmaceutical Compositions

Pharmaceutical compositions can comprise either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation can be determined by routine experimentation and is within the judgement of the clinician.

For purposes of the present invention, an effective dose will be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Vaccines

Vaccines according to the invention may either be prophylactic (ie. to prevent infection) or therapeutic (ie. to treat disease after infection).

Such vaccines comprise immunising antigen(s), immunogen(s), polypeptide(s), protein(s) or nucleic acid, usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the antigen or immunogen may be conjugated to a bacterial toxoid, such as a toxoid from diphtheria, tetanus, cholera, *H. pylori*, etc. pathogens.

Preferred adjuvants to enhance effectiveness of the composition include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59™ (WO 90/14837; Chapter 10 in *Vaccine design: the subunit and adjuvant approach*, eds. Powell & Newman, Plenum Press 1995), containing 5% Squalene, 0.5% Tween 80, and 0.5% Span 85 (optionally containing various amounts of MTP-PE (see below), although not required) formulated into submicron particles using a microfluidizer such as Model 110Y microfluidizer (Microfluidics, Newton, Mass.), (b) SAF, containing 10% Squalane, 0.4% Tween 80, 5% pluronic-blocked polymer L121, and thr-MDP (see below) either microfluidized into a submicron emulsion or vortexed to generate a larger particle size emulsion, and (c) Ribi™ adjuvant system (RAS), (Ribi Immunochem, Hamilton, Mont.) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+ CWS (Detox™); (3) saponin adjuvants, such as Stimulon™ (Cambridge Bioscience, Worcester, Mass.) may be used or particles generated therefrom such as ISCOMs (immunostimulating complexes); (4) Complete Freund's Adjuvant (CFA) and Incomplete Freund's Adjuvant (IFA); (5) cytokines, such as interleukins (eg. IL-1, IL-2, IL-4, IL-5, IL-6, IL-7, IL-12, etc.), interferons (eg. gamma interferon), macrophage colony stimulating factor (M-CSF), tumor necrosis factor c[NF), etc; and (6) other substances that act as immunostimulating agents to enhance the effectiveness of the composition. Alum and MF59™ are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (MTP-PE), etc.

The immunogenic compositions (eg. the immunising antigen/immunogen/polypeptide/protein/nucleic acid, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles.

Typically, the immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

Immunogenic compositions used as vaccines comprise an immunologically effective amount of the antigenic or immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (eg. nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

The immunogenic compositions are conventionally administered parenterally, eg. by injection, either subcutaneously, intramuscularly, or transdermally/transcutaneously (eg. WO98/20734). Additional formulations suitable for other modes of administration include oral and pulmonary formulations, suppositories, and transdermal applications. Dosage treatment may be a single dose schedule or a multiple dose schedule. The vaccine may be administered in conjunction with other immunoregulatory agents.

As an alternative to protein-based vaccines, DNA vaccination may be employed [eg. Robinson & Torres (1997) *Seminars in Immunology* 9:271–283; Donnelly et al. (1997) *Annu Rev Immunol* 15:617–648; see later herein].

Gene Delivery Vehicles

Gene therapy vehicles for delivery of constructs including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) *Cancer Gene Therapy* 1:51–64; Kimura (1994) *Human Gene Therapy* 5:845–852; Connelly (1995) *Human Gene Therapy* 6:185–193; and Kaplitt (1994) *Nature Genetics* 6:148–153.

Retroviral vectors are well known in the art and we contemplate that any retroviral gene therapy vector is employable in the invention, including B, C and D type retroviruses, xenotropic retroviruses (for example, NZB-X1, NZB-X2 and NZB9-1 (see O'Neill (1985) *J. Virol.* 53:160) polytropic retroviruses eg. MCF and MCF-MLV (see Kelly (1983) *J. Virol.* 45:291), spumaviruses and lentiviruses. See *RNA Tumor Viruses*, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92105266), and can be used to create producer cell lines (also termed vector cell lines or "VCLs") for the production of recombinant vector particles. Preferably, the packaging cell lines are made from human parent cells (eg. HT1080 cells) or mink parent cell lines, which eliminates inactivation in human serum.

Preferred retroviruses for the construction of retroviral gene therapy vectors include Avian Leukosis Virus, Bovine Leukemia, Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) *J Virol* 19:19–25), Abelson (ATCC No. VR-999), Friend (ATCC No. VR-245), Graffi, Gross (ATCC Nol VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") in Rockville, Maryland or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. No. 5,219,740, U.S. Pat. No. 4,405,712, U.S. Pat. No. 4,861,719, U.S. Pat. No. 4,980,289, U.S. Pat. No. 4,777,127, U.S. Pat. No. 5,591,624. See also Vile (1993) *Cancer Res* 53:3860–3864; Vile (1993) *Cancer Res* 53:962–967; Ram (1993) *Cancer Res* 53 (1993) 83–88; Takamiya (1992) *J Neurosci Res* 33:493–503; Baba (1993) *J Neurosurg* 79:729–735; Mann (1983) *Cell* 33:153; Cane (1984) *Proc Natl Acad Sci* 81:6349; and Miller (1990) *Human Gene Therapy* 1.

Human adenoviral gene therapy vectors are also known in the art and employable in this invention. See, for example, Berkner (1988) *Biotechniques* 6:616 and Rosenfeld (1991) *Science* 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94128938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) *Hum. Gene Ther.* 3:147–154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (ie. there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257–262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463470. Additional AAV gene therapy vectors are described in U.S. Pat. No. 5,354,678, U.S. Pat. No. 5,173,414, U.S. Pat. No. 5,139,941, and U.S. Pat. No. 5,252,479.

The gene therapy vectors of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) *Science* 241:1667–1669 and in WO90/09441 and WO92107945, HSV Us3::pgC-lacZ described in Fink (1992) *Human Gene Therapy* 3:11–19 and HSV 7134, 2 RH 105 and GALA described in EP 0453242 (Breakefield), and those deposited with the ATCC as accession numbers ATCC VR-977 and ATCC VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. No. 5,091,309 and U.S. Pat. No. 5,217,879 are employable. Such alpha viruses may be obtained from depositories or collections such as the ATCC in Rockville, Maryland or isolated from known sources using commonly available techniques. Preferably, alphavirus vectors with reduced cytotoxicity are used (see U.S. Ser. No. 08/679640).

DNA vector systems such as eukarytic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, Nature 339 (1989) 385 and Sabin (1973) *J. Biol. Standardization* 1:115; rhinovirus, for example ATCC VR-1110 and those described in Arnold (1990) *J Cell Biochem* LA01; pox viruses such as canary pox virus or vaccinia virus, for example ATCC VR-111 and ATCC VR-2010 and those described in Fisher-Hoch (1989) *Proc Natl Acad Sci* 86:317; Flexner (1989) *Ann NY Acad Sci* 569:86, Flexner (1990) *Vaccine* 8:17; in U.S. Pat. No. 4,603,112 and U.S. Pat. No. 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802–3805; Enami & Palese (1991) *J Virol* 65:2711–2713 and Luytjes (1989) *Cell* 59:110, (see also McMichael (1983) *NEJ Med* 309:13, and Yap (1978) *Nature* 273:238 and *Nature* (1979) 277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-1251, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see US Serial No. 08/366,787, filed Dec. 30, 1994 and Curiel (1992) *Hum Gene Ther* 3:147–154 ligand linked DNA, for example see Wu (1989) *J Biol Chem* 264:16985–16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411–2418 and in Woffendin (1994) *Proc Natl Acad Sci* 91:1581–1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429–4432, insulin as described in Hucked (1990) *Biochem Pharmacol* 40:253–263, galactose as described in Plank (1992) *Bioconjugate Chem* 3:533–539, lactose or transferrin.

Naked DNA may also be employed. Exemplary naked DNA introduction methods are described in WO 90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. Ser. No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24):11581–11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033.

Exemplary liposome and polycationic gene delivery vehicles are those described in U.S. Pat. No. 5,422,120 and 4,762,915; in WO 95/13796; WO94/23697; and WO91/14445; in EP-0524968; and in Stryer, Biochemistry, pages 236–240 (1975) W.H. Freeman, San Francisco; Szoka (1980) *Biochem Biophys Acta* 600:1; Bayer (1979) *Biochem Biophys Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprises therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Methods for the ex vivo delivery and reimplantation of transformed cells into a subject are known in the art and described in eg. WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of plasmodium falciparum known as RII.

B. Hormones, Vitamins, etc.

Other groups that can be included are, for example: hormones, steroids, androgens, estrogens, thyroid hormone, or vitamins, folic acid.

C. Polyalkylenes, Polysaccharides, etc.

Also, polyalkylene glycol can be included with the desired polynucleotides/polypeptides. In a preferred embodiment, the polyalkylene glycol is polyethlylene glycol. In addition, mono-, di-, or polysaccarides can be included. In a preferred embodiment of this aspect, the polysaccharide is dextran or DEAE-dextran. Also, chitosan and poly(lactide-co-glycolide)

D. Lipids, and Liposomes

The desired polynucleotide/polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide to lipid preparation can vary but will generally be around 1:1 (mg DNA:micromoles lipid), or more of lipid. For a review of the use of liposomes as carriers for delivery of nucleic acids, see, Hug and Sleight (1991) Biochim. Biophys. Acta. 1097:1–17; Straubinger (1983) Meth. Enzymol. 101:512–527.

Liposomal preparations for use in the present invention include cationic (positively charged), anionic (negatively charged) and neutral preparations. Cationic liposomes have been shown to mediate intracellular delivery of plasmid DNA (Felgner (1987) Proc. Natl. Acad. Sci. USA 84:7413–7416); mRNA (Malone (1989) Proc. Natl. Acad. Sci. USA 86:6077–6081); and purified transcription factors (Debs (1990) J. Biol. Chem. 265:10189–10192), in functional form. Cationic liposomes are readily available. For example, N[1-2,3-dioleyloxy)propyl]-N,N,N-triethylammonium (DOTMA) liposomes are available under the trademark Lipofectin, from GIBCO BRL, Grand Island, N.Y. (See, also, Feigner supra). Other commercially available liposomes include transfectace (DDAB/DOPE) and DOTAP/DOPE (Boerhinger). Other cationic liposomes can be prepared from readily available materials using techniques well known in the art. See, eg. Szoka (1978) Proc. Natl. Acad. Sci. USA 75:4194–4198; WO90/11092 for a description of the synthesis of DOTAP (1,2-bis(oleoyloxy)-3-(trimethylammonio)propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilamellar vesicles (MLVs), small unilamellar vesicles (SUVs), or large unilamellar vesicles (LUVs). The various liposome-nucleic acid complexes are prepared using methods known in the art. See eg. Straubinger (1983) Meth. Immunol. 101:512–527; Szoka (1978) Proc. Natl. Acad. Sci. USA 75:4194–4198; Papahadjopoulos (1975) Biochim. Biophys. Acta 394:483; Wilson (1979) Cell 17:77; Deamer & Bangham (1976) Biochim. Biophys. Acta 443:629; Ostro (1977) Biochem. Biophys. Res. Commun. 76:836; Fraley (1979) Proc. Natl. Acad. Sci. USA 76:3348); Enoch & Strittmatter (1979) Proc. Natl. Acad. Sci. USA 76:145; Fraley (1980) J. Biol. Chem. (1980) 255:10431; Szoka & Papahadjopoulos (1978) Proc. Natl. Acad. Sci. USA 75:145; and Schaefer-Ridder (1982) Science 215:166.

E. Lipoproteins

In addition, lipoproteins can be included with the polynucleotide/polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C, and E, over time these lipoproteins lose A and acquire C and E apoproteins. VLDL comprises A, B, C, and E apoproteins, LDL comprises apoprotein B; and HDL comprises apoproteins A, C, and E.

The amino acid of these apoproteins are known and are described in, for example, Breslow (1985) Annu Rev. Biochem 54:699; Law (1986) Adv. Exp Med. Biol. 151:162; Chen (1986) J Biol Chem 261:12918; Kane (1980) Proc Natl Acad Sci USA 77:2465; and Utermann (1984) Hum Genet 65:232.

Lipoproteins contain a variety of lipids including, triglycerides, cholesterol (free and esters), and phopholipids. The composition of the lipids varies in naturally occurring lipoproteins. For example, chylomicrons comprise mainly triglycerides. A more detailed description of the lipid content of naturally occurring lipoproteins can be found, for example, in *Meth Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454–5460 and Mahey (1979) *J Clin. Invest* 64:743–750. Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30: 443. Lipoproteins can also be purchased from commercial suppliers, such as Biomedical Techniologies, Inc., Stoughton, Mass., USA. Further description of lipoproteins can be found in Zuckermann et al. PCT/US97/14465.

F. Polycationic Agents

Polycationic agents can be included, with or without lipoprotein, in a composition with the desired polynucleotide/polypeptide to be delivered. Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples include histones, protamines, human serum albumin, DNA binding proteins, non-histone chromosomal proteins, coat proteins from DNA viruses, such as (X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic polycationic agents which are useful include, for example, DEAE-dextran, polybrene. Lipofectin™, and lipofectAMINE™ are monomers that form polycationic complexes when combined with polynucleotides/polypeptides.

Immunodiagnostic Assays

Neisserial antigens of the invention can be used in immunoassays to detect antibody levels (or, conversely, anti-Neisserial antibodies can be used to detect antigen levels). Immunoassays based on well defined, recombinant antigens can be developed to replace invasive diagnostics methods. Antibodies to Neisserial proteins within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTFO); concentration of the sequences; use of compounds to increase the rate of association of sequences (dextran sulfate or polyethylene glycol); and the stringency of the washing conditions following hybridization. See Sambrook et al. [supra] Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200 □C below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment (s) to be studied can vary a magnitude of 10, from 0.1 to 1 $\mu$g for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 $\mu$g of yeast DNA, blotting for two hours, and hybridizing for 4–8 hours with a probe of $10^8$ cpm/$\mu$g. For a single-copy mammalian gene a conservative approach would start with 10 μg of DNA, blot overnight, and hybridize overnight in the presence of 10% dextran sulfate using a probe of greater than $10^8$ cpm/μg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$Tm=81+16.6(\log_{10}Ci)+0.4[\%(G+C)]-0.6(\%formamide)-600/n-1.5(\%mismatch).$$

where Ci is the salt concentration (monovalent ions) and n is the length of the hybrid in base pairs (slightly modified from Meinkoth & Wahl (1984) *Anal. Biochem.* 138: 267–284).

In designing a hybridization experiment, some factors affecting nucleic acid hybridization can be conveniently altered. The temperature of the hybridization and washes and the salt concentration during the washes are the simplest to adjust. As the temperature of the hybridization increases (ie. stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C. for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA. A probe is said to "hybridize" with a sequence of the invention if it can form a duplex or double stranded complex, which is stable enough to be detected.

The nucleic acid probes will hybridize to the Neisserial nucleotide sequences of the invention (including both sense and antisense strands). Though many different nucleotide sequences will encode the amino acid sequence, the native Neisserial sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the Neisserial sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex. Additional Neisserial sequence may also be helpful as a label to detect the formed duplex. For example, a non-complementary nucleotide sequence may be attached to the 5' end of the probe, with the remainder of the probe sequence being complementary to a Neisserial sequence. Alternatively, non-complementary bases or longer sequences can be interspersed into the probe, provided that the probe sequence has sufficient complementarity with the a Neisserial sequence in order to hybridize therewith and thereby form a duplex which can be detected.

The exact length and sequence of the probe will depend on the hybridization conditions, such as temperature, salt condition and the like. For example, for diagnostic applications, depending on the complexity of the analyte sequence, the nucleic acid probe typically contains at least 10–20 nucleotides, preferably 15–25, and more preferably at least 30 nucleotides, although it may be shorter than this. Short primers generally require cooler temperatures to form sufficiently stable hybrid complexes with the template.

Probes may be produced by synthetic procedures, such as the triester method of Matteucci et al. [*J. Am. Chem. Soc.* (1981) 103:3185], or according to Urdea et al. [*Proc. Natl. Acad. Sci. USA* (1983) 80: 7461], or using commercially available automated oligonucleotide synthesizers.

The chemical nature of the probe can be selected according to preference. For certain applications, DNA or RNA are appropriate. For other applications, modifications may be incorporated eg. backbone modifications, such as phosphorothioates or methylphosphonates, can be used to increase in vivo half-life, alter RNA affinity, increase nuclease resistance etc. [eg. see Agrawal & Iyer (1995) *Curr Opin Biotechnol* 6:12–19; Agrawal (1996) *TIBTECH* 14:376–387]; analogues such as peptide nucleic acids may also be used [eg. see Corey (1997) *TIBTECH* 15:224–229; Buchardt et al. (]993) *TIBTECH* 11:384–386].

Alternatively, the polymerase chain reaction (PCR) is another well-known means for detecting small amounts of target nucleic acids. The assay is described in: Mullis et al. [*Meth. Enzymol.* (1987) 155: 335–350]; U.S. Pat. Nos. 4,683,195 and 4,683,202. Two "primer" nucleotides hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired Neisserial sequence.

A thermostable polymerase creates copies of target nucleic acids from the primers using the original target nucleic acids as a template. After a threshold amount of target nucleic acids are generated by the polymerase, they can be detected by more traditional methods, such as Southern blots. When using the Southern blot method, the labelled probe will hybridize to the Neisserial sequence (or its complement).

Also, mRNA or cDNA can be detected by traditional blotting techniques described in Sambrook et al [supra].

mRNA, or cDNA generated from mRNA using a polymerase enzyme, can be purified and separated using gel electrophoresis. The nucleic acids on the gel are then blotted onto a solid support, such as nitrocellulose. The solid support is exposed to a labelled probe and then washed to remove any unhybridized probe. Next, the duplexes containing the labeled probe are detected. Typically, the probe is labelled with a radioactive moiety.

BRIEF DESCRIPTION OF THE DRAWINGS

FIGS. 1–20 show biochemical data obtained in the Examples, and also sequence analysis, for ORFs 37 (FIGS. 1A–1E), 5 (FIGS. 2A–2B), 2 (FIGS. 3A–3D), 15 (FIGS. 4A–4C), 22 (FIGS. 5A–5C), 28 (FIGS. 6A–6B), 32 (FIGS. 7A–7B), 4 (FIGS. 8A–8F), 61 (FIG. 9), 76 (FIGS. 10A–10C), 89 (FIG. 11), 97 (FIGS. 12A–12E), 106 (FIGS. 13A–13C), 138 (FIGS. 14A–B), 23 (FIGS. 15A–15C), 25 (FIGS. 16A–16E), 27 FIGS. 17A–17B, 79 (FIGS. 18A–18B), 85 (FIGS. 19A–19D) and 132 (FIGS. 20A–20C). M1 and M2 are molecular weight markers. Arrows indicate the position of the main recombinant product or, in Western blots, the position of the main *N.meningitidis* immunoreactive band. TP indicates *N.meningitidis* total protein extract; OMV indicates *N.meningitidis* outer membrane vesicle preparation. In bactericidal assay results: a diamond (♦) shows preimmune data; a triangle (▲) shows GST control data; a circle ( ) shows data with recombinant *N.meningitidis* protein. Computer analyses show a hydrophilicity plot (upper), an antigenic index plot (middle), and an AMPHI analysis (lower). The AMPHI program has been used to predict T-cell epitopes [Gao et al. (1989) *J. Immunol.* 143:3007; Roberts et al. (1996) *AIDS Res Hum Retrovir* 12:593; Quakyi et al. (1992) *Scand J Immunol* suppl.11:9) and is available in the Protean package of DNASTAR, Inc. (1228 South Park Street, Madison, Wis. 53715 USA).

EXAMPLES

Figure 1A:
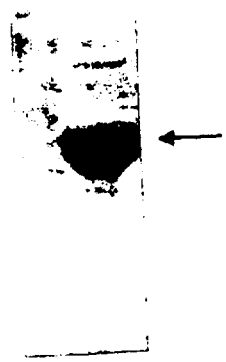

The examples describe nucleic acid sequences which have been identified in *N.meningitidis*, along with their putative translation products, and also those of *N.gonorrhoeae*. Not all of the nucleic acid sequences are complete ie. they encode less than the full-length wild-type protein.

The examples are generally in the following format:
a nucleotide sequence which has been identified in *N.meningitidis* (strain B)
the putative translation product of this sequence
a computer analysis of the translation product based on database comparisons
corresponding gene and protein sequences identified in *N.meningitidis* (strain A) and in *N.gonorrhoeae*
a description of the characteristics of the proteins which indicates that they might be suitably antigenic
results of biochemical analysis (expression, purification, ELISA, FACS etc.)

The examples typically include details of sequence identity between species and strains. Proteins that are similar in sequence are generally similar in both structure and function, and the sequence identity often indicates a common evolutionary origin. Comparison with sequences of proteins of known function is widely used as a guide for the assignment of putative protein function to a new sequence and has proved particularly useful in whole-genome analyses.

Sequence comparisons were performed at NCBI (ncbi.nlm.nih.gov) using the algorithms BLAST, BLAST2, BLASTn, BLASTp, tBLASTn, BLASTx, & tBLASTx [eg. see also Altschul et al. (1997) Gapped BLAST and PSI-BLAST: a new generation of protein database search programs. *Nucleic Acids Research* 25:2289–3402]. Searches were performed against the following databases: non-redundant GenBank+EMBL+DDBJ+PDB sequences and non-redundant GenBank CDS translations+PDB+SwissProt+SPupdate+PIR sequences.

To compare Meningococcal and Gonococcal sequences, the tBLASTx algorithm was used, as implemented at genome.ou.edu/gono_blast.html. The FASTA algorithm was also used to compare the ORFs (from GCG Wisconsin Package, version 9.0).

Dots within nucleotide sequences (eg. position 495 in SEQ ID NO: 1I) represent nucleotides which have been arbitrarily introduced in order to maintain a reading frame. In the same way, double-underlined nucleotides were removed. Lower case letters (eg. position 496 in SEQ ID NO: 11) represent ambiguities which arose during alignment of independent sequencing reactions (some of the nucleotide sequences in the examples are derived from combining the results of two or more experiments).

Nucleotide sequences were scanned in all six reading frames to predict the presence of hydrophobic domains using an algorithm based on the statistical studies of Esposti et al. [Critical evaluation of the hydropathy of membrane proteins (1990) *Eur J Biochem* 190:207–219]. These domains represent potential transmembrane regions or hydrophobic leader sequences.

Open reading frames were predicted from fragmented nucleotide sequences using the program ORFFINDER (NCBI).

Underlined amino acid sequences indicate possible transmembrane domains or leader sequences in the ORFs, as predicted by the PSORT algorithm (psort.nibb.ac.jp). Functional domains were also predicted using the MOTIFS program (GCG Wisconsin & PROSITE).

Various tests can be used to assess the in vivo immunogencity of the proteins identified in the examples. For example, the proteins can be expressed recombinantly and used to screen patient sera by immunoblot. A positive reaction between the protein and patient serum indicates that the patient has previously mounted an immune response to the protein in question ie. the protein is an immunogen. This method can also be used to identify immunodominant proteins.

The recombinant protein can also be conveniently used to prepare antibodies eg. in a mouse. These can be used for direct confirmation that a protein is located on the cell-surface. Labelled antibody (eg. fluorescent labelling for FACS) can be incubated with intact bacteria and the presence of label on the bacterial surface confirms the location of the protein.

In particular, the following methods (A) to (S) were used to express, purify and biochemically characterise the proteins of the invention:

A) Chromosomal DNA Preparation

*N.meningitidis* strain 2996 was grown to exponential phase in 100 ml of GC medium, harvested by centrifugation, and resuspended in 5 ml buffer (20% Sucrose, 50 mM Tris-HCl, 50 mM EDTA, pH8). After 10 minutes incubation on ice, the bacteria were lysed by adding 10 ml lysis solution (50 mM NaCl, 1% Na-Sarkosyl, 50 µg/ml Proteinase K), and the suspension was incubated at 37° C. for 2 hours. Two phenol extractions (equilibrated to pH 8) and one ChCl$_3$/isoamylalcohol (24:1) extraction were performed. DNA was precipitated by addition of 0.3M sodium acetate and 2 volumes ethanol, and was collected by centrifugation. The pellet was washed once with 70% ethanol and redissolved in 4 ml buffer (10 mM Tris-HCl, 1 mM EDTA, pH 8). The DNA concentration was measured by reading the OD at 260 nm.

B) Oligonucleotide Design

Synthetic oligonucleotide primers were designed on the basis of the coding sequence of each ORF, using (a) the meningococcus B sequence when available, or (b) the gonococcus/meningococcus A sequence, adapted to the codon preference usage of meningococcus as necessary. Any predicted signal peptides were omitted, by deducing the 5'-end amplification primer sequence immediately downstream from the predicted leader sequence.

For most ORFs, the 5' primers included two restriction enzyme recognition sites (BamHI-NdeI, BamHI-NheI, or EcoRI-NheI, depending on the gene's own restriction pattern); the 3' primers included a XhoI restriction site. This procedure was established in order to direct the cloning of each amplification product (corresponding to each ORF) into two different expression systems: pGEX-KG (using either BamHI-XhoI or EcoRI-XhoI), and pET21b+ (using either NdeI-XhoI or NheI-XhoI).

5'-end primer tail:
CGCGGATCCCATATG (SEQ ID NO: 1099) (BamHI-NdeI)
CGCGGATCCGCTAGC (SEQ ID NO: 1100) (BamHI-NheI)
CCGGAATTCTAGCTAGC (SEQ ID NO: 1101) (EcoRI-NheI)

3'-end primer tail:
CCCGCTCGAG (SEQ ID NO: 1102) (XhoI)

For ORFs 5, 15, 17, 19, 20, 22, 27, 28, 65 & 89, two different amplifications were performed to clone each ORF in the two expression systems. Two different 5' primers were used for each ORF; the same 3' XhoI primer was used as before:

5'-end primer tail: GGAATTCCATATGGCCATGG (SEQ ID NO: 1103) (NdeI)

5'-end primer tail: CGGGATCC (BamHI)

ORF 76 was cloned in the pTRC expression vector and expressed as an amino-terminus His-tag fusion. In this particular case, the predicted signal peptide was included in the final product. NheI-BamHI restriction sites were incorporated using primers:

5'-end primer tail: GATCAGCTAGCCATATG (SEQ ID NO: 1104) (NheI)
3'-end primer tail: CGGGATCC (BamHI)

As well as containing the restriction enzyme recognition sequences, the primers included nucleotides which hybridizeed to the sequence to be amplified. The number of hybridizing nucleotides depended on the melting temperature of the whole primer, and was determined for each primer using the formulae:

| | |
|---|---|
| $T_m = 4 (G + C) + 2 (A + T)$ | (tail excluded) |
| $T_m = 64.9 + 0.41 (\% GC) - 600/N$ | (whole primer) |

The average melting temperature of the selected oligos were 65–70° C. for the whole oligo and 50–55° C. for the hybridising region alone.

Table I shows the forward and reverse primers used for each amplification. In certain cases, it will be noted that the sequence of the primer does not exactly match the sequence in the ORF. When initial amplifications were performed, the complete 5' and/or 3' sequence was not known for some meningococcal ORFs, although the corresponding sequences had been identified in gonococcus. For amplification, the gonococcal sequences could thus be used as the basis for primer design, altered to take account of codon preference. In particular, the following codons were changed: ATA→ATT; TCG→TCT; CAG→CAA; AAG→AAA; GAG→GAA; CGA→CGC; CGG→CGC; GGG→GGC. Italicised nucleotides in Table I indicate such a change. It will be appreciated that, once the complete sequence has been identified, this approach is generally no longer necessary.

TABLE I

PCR primers

| ORF | Primer | Sequence | | Restriction sites |
|---|---|---|---|---|
| ORF 1 | Forward | CGCGGATCCGCTAGC-GGACACACTTATTTCGG | (SEQ ID NO: 924) | BamHI-NheI |
| | Reverse | CCCGCTCGAG-CCAGCGGTAGCCTAATT | (SEQ ID NO: 925) | XhoI |
| ORF 2 | Forward | GCGGATCCCATATG-TTTGATTTCGGTTTGGG | (SEQ ID NO: 926) | BamHI-NdeI |
| | Reverse | CCCGCTCGAG-GACGGCATAACGGCG | (SEQ ID NO: 927) | XhoI |
| ORF 2-1 | Forward | GCGGATCCCATATG-TTTGATTTCGGTTTGGG | (SEQ ID NO: 928) | BamHI-NdeI |
| | Reverse | CCCGCTCGAG-TGATTTACGGACGCGCA | (SEQ ID NO: 929) | XhoI |
| ORF 4 | Forward | GCGGATCCCATATG-TGCGGAGGTCAAAAAGAC | (SEQ ID NO: 930) | BamHI-NdeI |
| | Reverse | CCCGCTCGAG-TTTGGCTGCGCCTTC | (SEQ ID NO: 931) | XhoI |
| ORF 5 | Forward | GGAATTCCATATGGCCATGG-TGGAAGGCGCACAACC | (SEQ ID NO: 932) | NdeI-NcoI |
| | Forward | CGGGATCC-ATGGAAGGCGCACAAC | (SEQ ID NO: 933) | BamHI |
| | Reverse | CCCGCTCGAG-GACTGTGCAAAAACGG | (SEQ ID NO: 934) | XhoI |
| ORF 6 | Forward | CGCGGATCCCATATG-ACCCGTCAATCTCTGCA | (SEQ ID NO: 935) | BamHI-NdeI |
| | Reverse | CCCGCTCGAG-TGCGCCGAACACTTTC | (SEQ ID NO: 936) | XhoI |
| ORF 7 | Forward | CGCGGATCCGCTAGC-GCGCTGCTTTTTGTTCC | (SEQ ID NO: 937) | BamHI-NheI |
| | Reverse | CCCGCTCGAG-TTTCAAAATATATTTGCGGA | (SEQ ID NO: 938) | XhoI |
| ORF 8 | Forward | GCGGATCCCATATG-GCTCAACTGCTTCGTAC | (SEQ ID NO: 939) | BamHI-NdeI |
| | Reverse | CCCGCTCGAG-AGCAGGCTTTGGCGC | (SEQ ID NO: 940) | XhoI |
| ORF 9 | Forward | CGCGGATCCCATATG-CCGAAGGAAGTCGGAAA | (SEQ ID NO: 941) | BamHI-NdeI |
| | Reverse | CCCGCTCGAG-TTTCCGAGGTTTTCGGG | (SEQ ID NO: 942) | XhoI |
| ORF 10 | Forward | GCGGATCCCATATG-GACACAAAAGAAATCCTC | (SEQ ID NO: 943) | BamHI-NdeI |
| | Reverse | CCCGCTCGAG-TAATGGGAAACCTTGTTTT | (SEQ ID NO: 944) | XhoI |
| ORF 11 | Forward | GCGGATCCCATATG-GCGGTCAACCTCTACG | (SEQ ID NO: 945) | BamHI-NdeI |
| | Reverse | CCCGCTCGAG-GGAAACGACTTCGCC | (SEQ ID NO: 946) | XhoI |
| ORF 13 | Forward | CGCGGATCCCATATG-GCTCTGCTTTCCGCGC | (SEQ ID NO: 947) | BamHI-NdeI |
| | Reverse | CCCGCTCGAG-AGGGTGTGTGATAATAAG | (SEQ ID NO: 948) | XhoI |

TABLE I-continued

PCR primers

| ORF | Primer | Sequence | | Restriction sites |
|---|---|---|---|---|
| ORF 15 | Forward | GGAATTC<u>CATATG</u>GC<u>CATGG</u>-GCGGGACACTGACAG | (SEQ ID NO: 949) | NdeI-NcoI |
| | Forward | CG<u>GGATCC</u>-TGCGGGACACTGACAGG | (SEQ ID NO: 950) | BamHI |
| | Reverse | CCCG<u>CTCGAG</u>-AGGTTGGCCTTGTCTATG | (SEQ ID NO: 951) | XhoI |
| ORF 17 | Forward | GGAATTC<u>CATATG</u>GC<u>CATGG</u>-TTGCCGGCCTGTTCG | (SEQ ID NO: 952) | NdeI-NcoI |
| | Forward | CG<u>GGATCC</u>-ATTGCCGGCCTGTTCG | (SEQ ID NO: 953) | BamHI |
| | Reverse | CCCG<u>CTCGAG</u>-AAGCAGGTTGTACAGC | (SEQ ID NO: 954) | XhoI |
| ORF 18 | Forward | GC<u>GGATCCCATATG</u>-ATTTTGCTGCATTTGGAT | (SEQ ID NO: 955) | BamHI-NdeI |
| | Reverse | CCCG<u>CTCGAG</u>-TCTTCCAATTTCTGAAAGC | (SEQ ID NO: 956) | XhoI |
| ORF 19 | Forward | GGAATTC<u>CATATG</u>GC<u>CATGG</u>-TCGCCAGTGTTTTTACC | (SEQ ID NO: 957) | NdeI-NcoI |
| | Forward | CG<u>GGATCC</u>-TTCGCCAGTGTTTTTACCG | (SEQ ID NO: 958) | BamHI |
| | Reverse | CCCG<u>CTCGAG</u>-GGTGTTTTTGAAGCTGCC | (SEQ ID NO: 959) | XhoI |
| ORF 20 | Forward | GGAATTC<u>CATATG</u>GC<u>CATGG</u>-TCGGCGCGGGTATG | (SEQ ID NO: 960) | NdeI-NcoI |
| | Forward | CG<u>GGATCC</u>-TTCGGCGCGGGTATG | (SEQ ID NO: 961) | BamHI |
| | Reverse | CCCG<u>CTCGAG</u>-CGGCGAGCGAGAGCA | (SEQ ID NO: 962) | XhoI |
| ORF 22 | Forward | GGAATTC<u>CATATG</u>GC<u>CATGG</u>-TGATTAAAATCAAAAAAGGTCT | (SEQ ID NO: 963) | NdeI-NcoI |
| | Forward | CG<u>GGATCC</u>-ATGATTAAAATCAAAAAAGGTCTAAACC | (SEQ ID NO: 964) | BamHI |
| | Reverse | CCCG<u>CTCGAG</u>-ATTATGATAGCGGCCC | (SEQ ID NO: 965) | XhoI |
| ORF 23 | Forward | CG<u>GGATCCCATATG</u>-GATGTTTCTGTTTCAGAC | (SEQ ID NO: 966) | BamHI-NdeI |
| | Reverse | CCCG<u>CTCGAG</u>-TTTAAACCGATAGGTAAACG | (SEQ ID NO: 967) | XhoI |
| ORF 24 | Forward | GGAATTC<u>CATATG</u>GC<u>CATGG</u>-TGATGCCGGAAATGGTG | (SEQ ID NO: 968) | NdeI-NcoI |
| | Forward | CG<u>GGATCC</u>-ATGATGCCGGAAATGGTG | (SEQ ID NO: 969) | BamHI |
| | Reverse | CCCG<u>CTCGAG</u>-TGTCAGCGTGGCGCA | (SEQ ID NO: 970) | XhoI |
| ORF 25 | Forward | GC<u>GGATCCCATATG</u>-TATCGCAAACTGATTGC | (SEQ ID NO: 971) | BamHI-NdeI |
| | Reverse | CCCG<u>CTCGAG</u>-ATCGATGGAATAGCCG | (SEQ ID NO: 972) | XhoI |
| ORF 26 | Forward | GC<u>GGATCCCATATG</u>-CAGCTGATCGACTATTC | (SEQ ID NO: 973) | BamHI-NdeI |
| | Reverse | CCCG<u>CTCGAG</u>-GACATCGGCGCGTTTT | (SEQ ID NO: 974) | XhoI |
| ORF 27 | Forward | GGAATTC<u>CATATG</u>GC<u>CATGG</u>-AGACCTATTCTGTTTA | (SEQ ID NO: 1168) | NdeI-NcoI |
| | Forward | CG<u>GGATCC</u>-CAGACCTATTCTGTTTATTTTAATC | (SEQ ID NO: 975) | BamHI |
| | Reverse | CCCG<u>CTCGAG</u>-GGGTTCGATTAAATAACCAT | (SEQ ID NO: 976) | XhoI |
| ORF 28 | Forward | GGAATTC<u>CATATG</u>GC<u>CATGG</u>-ACGGCTGTACGTTGATGT | (SEQ ID NO: 977) | NdeI-NcoI |
| | Forward | CG<u>GGATCC</u>-AACGGCTGTACGTTGATG | (SEQ ID NO: 978) | BamHI |
| | Reverse | CCCG<u>CTCGAG</u>-TTTGTCAGAGGAATTCGCG | (SEQ ID NO: 979) | XhoI |
| ORF 29 | Forward | GC<u>GGATCCCATATG</u>-AACGGTTTGGATGCCCG | (SEQ ID NO: 980) | BamHI-NdeI |
| | Forward | CGC<u>GGATCCGCTAGC</u>-AACGGTTTGGATGCCCG | (SEQ ID NO: 981) | BamHI-NheI |
| | Reverse | CCCG<u>CTCGAG</u>-TTTGTCTAAGTTCCTGATATG | (SEQ ID NO: 982) | XhoI |
| ORF 32 | Forward | CGC<u>GGATCCCATATG</u>-AATACTCCTCCTTTTG | (SEQ ID NO: 983) | BamHI-NdeI |
| | Reverse | CCCG<u>CTCGAG</u>-GCGTATTTTTTGATGCTTTG | (SEQ ID NO: 984) | XhoI |
| ORF 33 | Forward | GC<u>GGATCCCATATG</u>-ATTGATAGGGATCGTATG | (SEQ ID NO: 985) | BamHI-NdeI |
| | Reverse | CCCG<u>CTCGAG</u>-TTGATCTTTCAAACGGCC | (SEQ ID NO: 986) | XhoI |
| ORF 35 | Forward | GC<u>GGATCCCATATG</u>-TTCAGAGCTCAGCTT | (SEQ ID NO: 987) | BamHI-NdeI |
| | Forward | CGC<u>GGATCCGCTAGC</u>-TTCAGAGCTCAGCTT | (SEQ ID NO: 988) | BamHI-NheI |
| | Reverse | CCCG<u>CTCGAG</u>-AAACAGCCATTTGAGCGA | (SEQ ID NO: 989) | XhoI |
| ORF 37 | Forward | GC<u>GGATCCCATATG</u>-GATGACGTATCGGATTTT | (SEQ ID NO: 990) | BamHI-NdeI |
| | Reverse | CCCG<u>CTCGAG</u>-ATAGCCCGCTTTCAGG | (SEQ ID NO: 991) | XhoI |
| ORF 58 | Forward | CGC<u>GGATCCGCTAGC</u>-TCCGAACGCGAGTGGAT | (SEQ ID NO: 992) | BamHI-NheI |
| | Reverse | CCCG<u>CTCGAG</u>-AGCATTGTCCAAGGGGAC | (SEQ ID NO: 993) | XhoI |
| ORF 65 | Forward | GGAATTC<u>CATATG</u>GC<u>CATGG</u>-TGCTGTATCTGAATCAAG | (SEQ ID NO: 994) | NdeI-NcoI |
| | Forward | CG<u>GGATCC</u>-TTGCTGTATCTGAATCAAGG | (SEQ ID NO: 995) | BamHI |
| | Reverse | CCCG<u>CTCGAG</u>-CCGCATCGGCAGACA | (SEQ ID NO: 996) | XhoI |
| ORF 66 | Forward | GC<u>GGATCCCATATG</u>-TACGCATTTACCGCCG | (SEQ ID NO: 997) | BamHI-NdeI |
| | Reverse | CCCG<u>CTCGAG</u>-TGGATTTTGCAGAGATGG | (SEQ ID NO: 998) | XhoI |
| ORF 72 | Forward | CGC<u>GGATCCCATATG</u>-AATGCAGTAAAAATATCTGA | (SEQ ID NO: 999) | BamHI-NdeI |
| | Reverse | CCCG<u>CTCGAG</u>-GCCTGAGACCTTTGCAA | (SEQ ID NO: 1000) | XhoI |
| ORF 73 | Forward | GC<u>GGATCCCATATG</u>-AGATTTTTCGGTATCGG | (SEQ ID NO: 1001) | BamHI-NdeI |
| | Reverse | CCCG<u>CTCGAG</u>-TTCATCTTTTTCATGTTCG | (SEQ ID NO: 1002) | XhoI |
| ORF 75 | Forward | GC<u>GGATCCCATATG</u>-TCTGTCTTTCAAACGGC | (SEQ ID NO: 1003) | BamHI-NdeI |
| | Reverse | CCCG<u>CTCGAG</u>-TTTGTTTTGCAAGACAG | (SEQ ID NO: 1004) | XhoI |
| ORF 76 | Forward | GATCA<u>GCTAGCCATATG</u>-AAACAGAAAAAAACCGC | (SEQ ID NO: 1005) | NheI-NdeI |
| | Reverse | CG<u>GGATCC</u>-TTACGGTTTGACACCGTT | (SEQ ID NO: 1006) | BamHI |
| ORF 79 | Forward | CGC<u>GGATCCCATATG</u>-GTTTCCGCCGCCG | (SEQ ID NO: 1007) | BamHI-NdeI |
| | Reverse | CCCG<u>CTCGAG</u>-GTGCTGATGCGCTTCG | (SEQ ID NO: 1008) | XhoI |
| ORF 83 | Forward | GC<u>GGATCCCATATG</u>-AAACCCTGCTGCTGC | (SEQ ID NO: 1009) | BamHI-NdeI |
| | Reverse | CCCG<u>CTCGAG</u>-GCCGCCTTTGCGGC | (SEQ ID NO: 1010) | XhoI |
| ORF 84 | Forward | GC<u>GGATCCCATATG</u>-GCAGAGATCTGTTTG | (SEQ ID NO: 1011) | BamHI-NdeI |
| | Reverse | CCCG<u>CTCGAG</u>-GTTTGCCGATCCGACCA | (SEQ ID NO: 1012) | XhoI |
| ORF 85 | Forward | CGC<u>GGATCCCATATG</u>-GCGGTTTGGGGCGGA | (SEQ ID NO: 1013) | BamHI-NdeI |
| | Reverse | CCCG<u>CTCGAG</u>-TCGGCGCGGCGGGC | (SEQ ID NO: 1014) | XhoI |
| ORF 89 | Forward | GGAATTC<u>CATATG</u>GC<u>CATGG</u>-CCATACCTTCTTATCA | (SEQ ID NO: 1015) | NdeI-NcoI |
| | Forward | CG<u>GGATCC</u>-GCCATACCTTCTTATCAGAG | (SEQ ID NO: 1016) | BamHI |
| | Reverse | CCCG<u>CTCGAG</u>-TTTTTTGCGATTAGAAAAGC | (SEQ ID NO: 1017) | XhoI |
| ORF 97 | Forward | GC<u>GGATCCCATATG</u>-CATCCTGCCAGCGAAC | (SEQ ID NO: 1018) | BamHI-NdeI |
| | Reverse | CCCG<u>CTCGAG</u>-TTCGCCTACGGTTTTTTG | (SEQ ID NO: 1019) | XhoI |
| ORF 98 | Forward | GC<u>GGATCCCATATG</u>-ACGGTAACTGCGG | (SEQ ID NO: 1020) | BamHI-NdeI |
| | Reverse | CCCG<u>CTCGAG</u>-TTGTTGTTCGGGCAAATC | (SEQ ID NO: 1021) | XhoI |

TABLE I-continued

PCR primers

| ORF | Primer | Sequence | | Restriction sites |
|---|---|---|---|---|
| ORF 100 | Forward | GC<u>GGATCCCATATG</u>-TCGGGCATTTACACCG | (SEQ ID NO: 1022) | BamHI-NdeI |
| | Reverse | CCCG<u>CTCGAG</u>-ACGGGTTTCGGCGGAA | (SEQ ID NO: 1023) | XhoI |
| ORF 101 | Forward | GC<u>GGATCCCATATG</u>-ATTTATCAAAGAAACCTC | (SEQ ID NO: 1024) | BamHI-NdeI |
| | Reverse | CCCG<u>CTCGAG</u>-TTTTCCGCCTTTCAATGT | (SEQ ID NO: 1025) | XhoI |
| ORF 102 | Forward | GC<u>GGATCCCATATG</u>-GCAGGGCTGTTTTACC | (SEQ ID NO: 1026) | BamHI-NdeI |
| | Reverse | CCCG<u>CTCGAG</u>-AAACGGTTTGAACACGAC | (SEQ ID NO: 1027) | XhoI |
| ORF 103 | Forward | GC<u>GGATCCCATATG</u>-AACCACGACATCAC | (SEQ ID NO: 1028) | BamHI-NdeI |
| | Reverse | CCCG<u>CTCGAG</u>-CAGCCACAGGACGGC | (SEQ ID NO: 1029) | XhoI |
| ORF 104 | Forward | GC<u>GGATCCCATATG</u>-ACGTGGGGAACGC | (SEQ ID NO: 1030) | BamHI-NdeI |
| | Reverse | CCCG<u>CTCGAG</u>-GCGGCGTTTGAACGGC | (SEQ ID NO: 1031) | XhoI |
| ORF 105 | Forward | GC<u>GGATCCCATATG</u>-ACCAAATTTCAAACCCCTC | (SEQ ID NO: 1032) | BamHI-NdeI |
| | Reverse | CCCG<u>CTCGAG</u>-TAAACGAATGCCGTCCAG | (SEQ ID NO: 1033) | XhoI |
| ORF 106 | Forward | GC<u>GGATCCCATATG</u>-AGGATAACCGACGGCG | (SEQ ID NO: 1034) | BamHI-NdeI |
| | Reverse | CCCG<u>CTCGAG</u>-TTTGTTCCCGATGATGTT | (SEQ ID NO: 1035) | XhoI |
| ORF 109 | Forward | GC<u>GGATCCCATATG</u>-GAAGATTTATATATAATACTCG | (SEQ ID NO: 1036) | BamHI-NdeI |
| | Reverse | CCCG<u>CTCGAG</u>-ATCAGCTTCGAACCGAAG | (SEQ ID NO: 1037) | XhoI |
| ORF 110 | Forward | AAA<u>GAATTC</u>-ATGAGTAAATCCCGTAGATCTCCC | (SEQ ID NO: 1038) | EcoRI |
| | Reverse | AAA<u>CTGCAG</u>-GGAAAACCACATCCGCACTCTGCC | (SEQ ID NO: 1039) | PstI |
| ORF 111 | Forward | AAA<u>GAATTC</u>-GCACCGCAAAAGGCAAAAACCGCA | (SEQ ID NO: 1040) | EcoRI |
| | Reverse | AAA<u>CTGCAG</u>-TCTGCGCGTTTTCGGGCAGGGTGG | (SEQ ID NO: 1041) | PstI |
| ORF 113 | Forward | AAA<u>GAATTC</u>-ATGAACAAAACCCTCTATCGTGTGATTTTCAACCG | (SEQ ID NO: 1042) | EcoRI |
| | Reverse | AAA<u>CTGCAG</u>-TTACGAATGCCTGCTTGCTCGACCGTACTG | (SEQ ID NO: 1043) | PstI |
| ORF 115 | Forward | AAA<u>GAATTC</u>-TTGCTTGTGCAAACAGAAAAAGACGG | (SEQ ID NO: 1044) | EcoRI |
| | Reverse | AAAAAA<u>GTCGAC</u>-CTATTTTTTAGGGGCTTTTGCTTGTTGAAAAGCCTGCC | (SEQ ID NO: 1045) | SalI |
| ORF 119 | Forward | AAA<u>GAATTC</u>-TACAACATGTATCAGGAAAACCAATACCG | (SEQ ID NO: 1046) | EcoRI |
| | Reverse | AAA<u>CTGCAG</u>-TTATGAAAACAGGCGCAGGGCGGTTTTGCC | (SEQ ID NO: 1047) | PstI |
| ORF 120 | Forward | AAA<u>GAATTC</u>-GCAAGGCTACCCCAATCCGCCGTG | (SEQ ID NO: 1048) | EcoRI |
| | Reverse | AAA<u>CTGCAG</u>-CGGTTTGGCTGCCTGGCCGTTGAT | (SEQ ID NO: 1049) | PstI |
| ORF 121 | Forward | AAA<u>GAATTC</u>-GCCTTGGTCTGGCTGGTTTTCGC | (SEQ ID NO: 1050) | EcoRI |
| | Reverse | AAA<u>CTGCAG</u>-TCATCCGCCACCCCACCTCGGCCATCCATC | (SEQ ID NO: 1051) | PstI |
| ORF 122 | Forward | AAAAAA<u>GTCGAC</u>-ATGTCTTACCGCGCAAGCAGTTCC | (SEQ ID NO: 1052) | SalI |
| | Reverse | AAA<u>CTGCAG</u>-TCAGGAACACAAACGATGACGAATATCCGTATC | (SEQ ID NO: 1053) | PstI |
| ORF 125 | Forward | AAA<u>GAATTC</u>-GCGCTGTTTTTTGCGGCGGCGTAT | (SEQ ID NO: 1054) | EcoRI |
| | Reverse | AAA<u>CTGCAG</u>-CGCCGTTTCAAGACGAAAAAGTCG | (SEQ ID NO: 1055) | PstI |
| ORF 126 | Forward | AAA<u>GAATTC</u>-GCGGAAACGGTCGAAG | (SEQ ID NO: 1056) | EcoRI |
| | Reverse | AAA<u>CTGCAG</u>-TTAATCTTGTCTTCCGATATAC | (SEQ ID NO: 1057) | PstI |
| ORF 127 | Forward | AAA<u>GAATTC</u>-ATGACTGATAATCGGGGGTTTACG | (SEQ ID NO: 1058) | EcoRI |
| | Reverse | AAAAAA<u>GTCGAC</u>-CTTAAGTAACTTGCAGTCCTTATC | (SEQ ID NO: 1059) | SalI |
| ORF 128 | Forward | AAA<u>GAATTC</u>-ATGCAAGCTGTCCGCTACAGGCC | (SEQ ID NO: 1060) | EcoRI |
| | Reverse | AAA<u>CTGCAG</u>-CTATTGCAATGCGCCGCCGCGGGAATGTTTGAGCAGGCG | (SEQ ID NO: 1061) | PstI |
| ORF 129 | Forward | AAA<u>GAATTC</u>-ATGGATTTTCGTTTTGACATTATTTACGAATACCG | (SEQ ID NO: 1062) | EcoRI |
| | Reverse | AAA<u>CTGCAG</u>-TTATTTTTTGATGAAATTTGGGGCGG | (SEQ ID NO: 1063) | PstI |
| ORF 130 | Forward | AAA<u>GAATTC</u>-GCAGTACTTGCCATTCTCGGTGCG | (SEQ ID NO: 1064) | EcoRI |
| | Reverse | AAA<u>CTGCAG</u>-CTCCGGATCGTCTGTAAACGCATT | (SEQ ID NO: 1065) | PstI |
| ORF 131 | Forward | GC<u>GGATCCCATATG</u>-GAAATTCGGGCAATAAAAT | (SEQ ID NO: 1066) | BamHI-NdeI |
| | Reverse | CCCG<u>CTCGAG</u>-CCAGCGGACGCGTTC | (SEQ ID NO: 1067) | XhoI |
| ORF 132 | Forward | GC<u>GGATCCCATATG</u>-AAAGAAGCGGGGTTTG | (SEQ ID NO: 1068) | BamHI-NdeI |
| | Reverse | CCCG<u>CTCGAG</u>-CCAATCTGCCAGCCGT | (SEQ ID NO: 1069) | XhoI |
| ORF 133 | Forward | CGC<u>GGATCCCATATG</u>-GAAGATGCAGGCGCG | (SEQ ID NO: 1070) | BamHI-NdeI |
| | Reverse | CCCG<u>CTCGAG</u>-AAACTTGTAGCTCATCGT | (SEQ ID NO: 1071) | XhoI |
| ORF 134 | Forward | GC<u>GGATCCCATATG</u>-TCTGTGCAAGCAGTATTG | (SEQ ID NO: 1072) | BamHI-NdeI |
| | Reverse | CCCG<u>CTCGAG</u>-ATCCTGTGCCAATGCG | (SEQ ID NO: 1073) | XhoI |
| ORF 135 | Forward | GC<u>GGATCCCATATG</u>-CCGTCTGAAAAAGCTTT | (SEQ ID NO: 1074) | BamHI-NdeI |
| | Reverse | CCCG<u>CTCGAG</u>-AAATACCGCTGAGGATG | (SEQ ID NO: 1075) | XhoI |
| ORF 136 | Forward | CGC<u>GGATCCGCTAGC</u>-ATGAAGCGGCGTATAGCC | (SEQ ID NO: 1076) | BamHI-NheI |
| | Reverse | CCCG<u>CTCGAG</u>-TTCCGAATATTTGGAACTTTT | (SEQ ID NO: 1077) | XhoI |
| ORF 137 | Forward | CGC<u>GGATCCCATATG</u>-GGCACGGCGGGAAATA | (SEQ ID NO: 1078) | BamHI-NdeI |
| | Reverse | CCCG<u>CTCGAG</u>-ATAACGGTATGCCGCC | (SEQ ID NO: 1079) | XhoI |
| ORF 138 | Forward | GC<u>GGATCCCATATG</u>-TTTCGTTTACAATTCAGGC | (SEQ ID NO: 1080) | BamHI-NdeI |
| | Reverse | CCCG<u>CTCGAG</u>-CGGCGTTTTTATAGCGG | (SEQ ID NO: 1081) | XhoI |
| ORF 139 | Forward | GC<u>GGATCCCATATG</u>-GCTTTTTTGGCGGTAATG | (SEQ ID NO: 1082) | BamHI-NdeI |
| | Reverse | CCCG<u>CTCGAG</u>-TAACGTTTCCGTGCGTTT | (SEQ ID NO: 1083) | XhoI |
| ORF 140 | Forward | GC<u>GGATCCCATATG</u>-TTGCCCACAGGCAGC | (SEQ ID NO: 1084) | BamHI-NdeI |
| | Reverse | CCCG<u>CTCGAG</u>-GACGATGGCAAACAGC | (SEQ ID.NO: 1085) | XhoI |
| ORF 141 | Forward | GC<u>GGATCCCATATG</u>-CCGTCTGAAGCAGTCT | (SEQ ID NO: 1086) | BamHI-NdeI |
| | Reverse | CCCG<u>CTCGAG</u>-ATCTGTTGTTTTAAAATATT | (SEQ ID NO: 1087) | XhoI |
| ORF 142 | Forward | GC<u>GGATCCCATATG</u>-GATAATTCTGGTAGTGAAG | (SEQ ID NO: 1088) | BamHI-NdeI |
| | Reverse | CCCG<u>CTCGAG</u>-AAACGTATAGCCTACCT | (SEQ ID NO: 1089) | XhoI |
| ORF 143 | Forward | GC<u>GGATCCCATATG</u>-GATACCGCTTTGAACCT | (SEQ ID NO: 1090) | BamHI-NdeI |
| | Reverse | CCCG<u>CTCGAG</u>-AATGGCTTCCGCAATATG | (SEQ ID NO: 1091) | XhoI |
| ORF 144 | Forward | GC<u>GGATCCCATATG</u>-ACCTTTTTACAACGTTTGC | (SEQ ID NO: 1092) | BamHI-NdeI |
| | Reverse | CCCG<u>CTCGAG</u>-AGATTGTTGTTGTTTTTTCG | (SEQ ID NO: 1093) | XhoI |

TABLE I-continued

PCR primers

| ORF | Primer | Sequence | | Restriction sites |
|---|---|---|---|---|
| ORF 147 | Forward | GCGGATCCCATATG-TCTGTCTTTCAAACGGC | (SEQ ID NO: 1094) | BamHI-NdeI |
| | Reverse | CCCGCTCGAG-TTTGTTTTTGCAAGACAG | (SEQ ID NO: 1095) | XhoI |

NB:
restriction sites are underlined
for ORFs 110–130, where the ORF itself carries an EcoRI site (eg. ORF122), a SalI site was used in the forward primer instead. Similarly, where the ORF carries a PstI site (eg. ORFs 115 and 127), a SalI site was used in the reverse primer.

Oligos were synthesized by a Perkin Elmer 394 DNA/RNA Synthesizer, eluted from the columns in 2 ml NH$_4$OH, and deprotected by 5 hours incubation at 56° C. The oligos were precipitated by addition of 0.3M Na-Acetate and 2 volumes ethanol. The samples were then centrifuged and the pellets resuspended in either 100 μl or 1 ml of water. OD$_{260}$ was determined using a Perkin Elmer Lambda Bio spectophotometer and the concentration was determined and adjusted to 2–10 pmol/μl.

C) Amplification

The standard PCR protocol was as follows: 50–200 ng of genomic DNA were used as a template in the presence of 20–40 μM of each oligo, 400–800 μM dNTPs solution, 1×PCR buffer (including 1.5 mM MgCl$_2$), 2.5 units Taql DNA polymerase (using Perkin-Elmer AmpliTaQ, GIBCO Platinum, Pwo DNA polymerase, or Tahara Shuzo Taq polymerase).

In some cases, PCR was optimsed by the addition of 10 μl DMSO or 50 μl 2M betaine.

After a hot start (adding the polymerase during a preliminary 3 minute incubation of the whole mix at 95° C.), each sample underwent a double-step amplification: the first 5 cycles were performed using as the hybridization temperature the one of the oligos excluding the restriction enzymes tail, followed by 30 cycles performed according to the hybridization temperature of the whole length oligos. The cycles were followed by a final 10 minute extension step at 72° C.

The standard cycles were as follows:

| | Denaturation | Hybridisation | Elongation |
|---|---|---|---|
| First 5 cycles | 30 seconds 95° C. | 30 seconds 50–55° C. | 30–60 seconds 72° C. |
| Last 30 cycles | 30 seconds 95° C. | 30 seconds 65–70° C. | 30–60 seconds 72° C. |

The elongation time varied according to the length of the ORF to be amplified.

The amplifications were performed using either a 9600 or a 2400 Perkin Elmer GeneAmp PCR System. To check the results, 1/10 of the amplification volume was loaded onto a 1–1.5% agarose gel and the size of each amplified fragment compared with a DNA molecular weight marker.

The amplified DNA was either loaded directly on a 1% agarose gel or first precipitated with ethanol and resuspended in a suitable volume to be loaded on a 1% agarose gel. The DNA fragment corresponding to the right size band was then eluted and purified from gel, using the Qiagen Gel Extraction Kit, following the instructions of the manufacturer. The final volume of the DNA fragment was 30 μl or 50 μl of either water or 10 mM Tris, pH 8.5.

D) Digestion of PCR Fragments

The purified DNA corresponding to the amplified fragment was split into 2 aliquots and double-digested with:
NdeI/XhoI or NheI/XhoI for cloning into pET-21b+ and further expression of the protein as a C-terminus His-tag fusion
BamHI/XhoI or EcoRI/XhoI for cloning into pGEX-KG and further expression of the protein as N-terminus GST fusion.
For ORF 76, NheI/BamHI for cloning into pTRC-HisA vector and further expression of the protein as N-terminus His-tag fusion.
EcoRI/PstI, EcoRI/SalI, SalI/PstI for cloning into pGex-His and further expression of the protein as N-terminus His-tag fusion Each purified DNA fragment was incubated (37° C. for 3 hours to overnight) with 20 units of each restriction enzyme (New England Biolabs) in a either 30 or 40 μl final volume in the presence of the appropriate buffer. The digestion product was then purified using the QIAquick PCR purification kit, following the manufacturer?s instructions, and eluted in a final volume of 30 or 50 μl of either water or 10 mM Tris-HCl, pH 8.5. The final DNA concentration was determined by 1% agarose gel electrophoresis in the presence of titrated molecular weight marker.

E) Digestion of the Cloning Vectors (pET22B, PGEX-KG, pTRC-His A, and pGex-His)

10 μg plasmid was double-digested with 50 units of each restriction enzyme in 200 μl reaction volume in the presence of appropriate buffer by overnight incubation at 37° C. After loading the whole digestion on a 1% agarose gel, the band corresponding to the digested vector was purified from the gel using the Qiagen QIAquick Gel Extraction Kit and the DNA was eluted in 50 μl of 10 nM Tris-HCl, pH 8.5. The DNA concentration was evaluated by measuring OD$_{260}$ of the sample, and adjusted to 50 μg/μl. 1 μl of plasmid was used for each cloning procedure.

The vector pGEX-His is a modified pGEX-2T vector carrying a region encoding six histidine residues upstream to the thrombin cleavage site and containing the multiple cloning site of the vector pTRC99 (Pharmacia).

F) Cloning

The fragments corresponding to each ORF, previously digested and purified, were ligated in both pET22b and pGEX-KG. In a final volume of 20 μl, a molar ratio of 3:1 fragment/vector was ligated using 0.5 μl of NEB T4 DNA ligase (400 units/μl), in the presence of the buffer supplied by the manufacturer. The reaction was incubated at room temperature for 3 hours. In some experiments, ligation was performed using the Boheringer "Rapid Ligation Kit", following the manufacturer's instructions.

In order to introduce the recombinant plasmid in a suitable strain, 100 μl E. coli DH5 competent cells were incubated with the ligase reaction solution for 40 minutes on ice, then at 37° C. for 3 minutes, then, after adding 800 µl LB broth, again at 37° C. for 20 minutes. The cells were then centrifuged at maximum speed in an Eppendorf microfuge and resuspended in approximately 200 µl of the supernatant. The suspension was then plated on LB ampicillin (100 mg/ml).

The screening of the recombinant clones was performed by growing 5 randomly-chosen colonies overnight at 37° C. in either 2 ml (PGEX or pTC clones) or 5 ml (pET clones) LB broth+100 µg/ml ampicillin. The cells were then pelletted and the DNA extracted using the Qiagen QIAprep Spin Miniprep Kit, following the manufacturer's instructions, to a final volume of 30p]. 5 µl of each individual miniprep (approximately 1 g) were digested with either NdeI/XhoI or BamHI/XhoI and the whole digestion loaded onto a 1–1.5% agarose gel (depending on the expected insert size), in parallel with the molecular weight marker (1 Kb DNA Ladder, GIBCO). The screening of the positive clones was made on the base of the correct insert size.

For the cloning of ORFs 110, 111, 113, 115, 119, 122, 125 & 130, the double-digested PCR product was ligated into double-digested vector using EcoRI-PstI cloning sites or, for ORFs 115 & 127, EcoRI-SalI or, for ORF 122, SalI-PstI. After cloning, the recombinant plasmids were introduced in the *E.coli* host W3110. Individual clones were grown overnight at 37° C. in L-broth with 50 µl/ml ampicillin.

G) Expression

Each ORF cloned into the expression vector was transformed into the strain suitable for expression of the recombinant protein product. 1 µl of each construct was used to transform 30 µl of *E.coli* BL21 (PGEX vector), *E.coli* TOP 10 (pTRC vector) or *E.coli* BL21-DE3 (pET vector), as described above. In the case of the pGEX-His vector, the same *E.coli* strain (W3110) was used for initial cloning and expression. Single recombinant colonies were inoculated into 2 ml LB+Amp (100 µg/ml), incubated at 37° C. overnight, then diluted 1:30 in 20 ml of LB+Amp (1001 µg/ml) in 100 ml flasks, making sure that the $OD_{600}$ ranged between 0.1 and 0.15. The flasks were incubated at 30° C. into gyratory water bath shakers until OD indicated exponential growth suitable for induction of expression (0.4–0.8 OD for pET and pTRC vectors; 0.8–1 OD for pGEX and pGEX-His vectors). For the pET, pTRC and pGEX-His vectors, the protein expression was induced by addition of 1 mM IPTG, whereas in the case of pGEX system the final concentration of IPTG was 0.2 mM. After 3 hours incubation at 30° C., the final concentration of the sample was checked by OD. In order to check expression, 1 ml of each sample was removed, centrifuged in a microfuge, the pellet resuspended in PBS, and analysed by 12% SDS-PAGE with Coomassie Blue staining. The whole sample was centrifuged at 6000 g and the pellet resuspended in PBS for further use.

H) GST-fusion Proteins Large-scale Purification

A single colony was grown overnight at 37° C. on LB+Amp agar plate. The bacteria were inoculated into 20 ml of LB+Amp liquid colture in a water bath shaker and grown overnight. Bacteria were diluted 1:30 into 600 ml of fresh medium and allowed to grow at the optimal temperature (20–37° C.) to $OD_{550}$ 0.8–1. Protein expression was induced with 0.2 mM IPTG followed by three hours incubation. The culture was centrifuged at 8000 rpm at 4° C. The supernatant was discarded and the bacterial pellet was resuspended in 7.5 ml cold PBS. The cells were disrupted by sonication on ice for 30 sec at 40W using a Branson sonifier B-15, frozen and thawed twice and centrifuged again. The supernatant was collected and mixed with 150 µl Glutatione-Sepharose 4B resin (Pharmacia) (previously washed with PBS) and incubated at room temperature for 30 minutes. The sample was centrifuged at 700 g for 5 minutes at 4° C. The resin was washed twice with 10 ml cold PBS for 10 minutes, resuspended in 1 ml cold PBS, and loaded on a disposable column. The resin was washed twice with 2 ml cold PBS until the flow-through reached $OD_{280}$ of 0.02–0.06. The GST-fusion protein was eluted by addition of 700 µl cold Glutathione elution buffer (10 mM reduced glutathione, 50 mM Tris-HCl) and fractions collected until the $OD_{280}$ was 0.1. 21 µl of each fraction were loaded on a 12% SDS gel using either Biorad SDS-PAGE Molecular weight standard broad range (M1) (200, 116.25, 97.4, 66.2, 45, 31, 21.5, 14.4, 6.5 kDa) or Amersham Rainbow Marker (M2) (220, 66, 46, 30, 21.5, 14.3 kDa) as standards. As the MW of GST is 26 kDa, this value must be added to the MW of each GST-fusion protein.

I) His-fusion Solubility Analysis (ORFs 111–129)

To analyse the solubility of the His-fusion expression products, pellets of 3 ml cultures were resuspended in buffer M1 [500 µl PBS pH 7.2]. 25 µl lysozyme (10 mg/ml) was added and the bacteria were incubated for 15 min at 4° C. The pellets were sonicated for 30 sec at 40W using a Branson sonifier B-15, frozen and thawed twice and then separated again into pellet and supernatant by a centrifugation step. The supernatant was collected and the pellet was resuspended in buffer M2 [8M urea, 0.5M NaCl, 20 mM imidazole and 0.1M $NaH_2PO_4$] and incubated for 3 to 4 hours at 4° C. After centrifugation, the supernatant was collected and the pellet was resuspended in buffer M3 [6M guanidinium-HCl, 0.5M NaCl, 20 mM imidazole and 0.1M $NaH_2PO_4$] overnight at 4° C. The supernatants from all steps were analysed by SDS-PAGE.

The proteins expressed from ORFs 113, 119 and 120 were found to be soluble in PBS, whereas ORFs 111, 122, 126 and 129 need urea and ORFs 125 and 127 need guanidium-HCl for their solubilization.

J) His-fusion Large-scale Purification.

A single colony was grown overnight at 37° C. on a LB+Amp agar plate. The bacteria were inoculated into 20 ml of LB+Amp liquid culture and incubated overnight in a water bath shaker. Bacteria were diluted 1:30 into 600 ml fresh medium and allowed to grow at the optimal temperature (20–37° C.) to $OD_{550}$ 0.6–0.8. Protein expression was induced by addition of 1 mM IPTG and the culture further incubated for three hours. The culture was centrifuged at 8000 rpm at 4° C., the supernatant was discarded and the bacterial pellet was resuspended in 7.5 ml of either (i) cold buffer A (300 mM NaCl, 50 mM phosphate buffer, 10 mM imidazole, pH 8) for soluble proteins or (ii) buffer B (urea 8M, 10 mM Tris-HCl, 100 mM phosphate buffer, pH 8.8) for insoluble proteins.

The cells were disrupted by sonication on ice for 30 sec at 40W using a Branson sonifier B-15, frozen and thawed two times and centrifuged again.

For insoluble proteins, the supernatant was stored at −20° C., while the pellets were resuspended in 2 ml buffer C (6M guanidine hydrochloride, 100 mM phosphate buffer, 10 mM Tris-HCl, pH 7.5) and treated in a homogenizer for 10 cycles. The product was centrifuged at 13000 rpm for 40 minutes.

Supernatants were collected and mixed with 150 µl $Ni^{2+}$-resin (Pharmacia) (previously washed with either buffer A or buffer B, as appropriate) and incubated at room temperature with gentle agitation for 30 minutes. The sample was centrifuged at 700 g for 5 minutes at 4° C. The resin was washed twice with 10 ml buffer A or B for 10 minutes, resuspended in 1 ml buffer A or B and loaded on a disposable column. The resin was washed at either (i) 4° C. with 2 ml cold buffer A or (ii) room temperature with 2 ml buffer B, until the flow-through reached $OD_{280}$ of 0.02–0.06.

The resin was washed with either (i) 2 ml cold 20 mM imidazole buffer (300 mM NaCl, 50 mM phosphate buffer, 20 mM imidazole, pH 8) or (ii) buffer D (urea 8M, 10 mM Tris-HCl, 110 mM phosphate buffer, pH 6.3) until the flow-through reached the $O.D_{280}$ of 0.02–0.06. The His-fusion protein was eluted by addition of 700 ∥l of either (i) cold elution buffer A (300 mM NaCl, 50 mM phosphate buffer, 250 mM imidazole, pH 8) or (ii) elution buffer B (urea 8M, 10 mM Tris-HCl, 100 mM phosphate buffer, pH 4.5) and fractions collected until the $O.D_{280}$ was 0.1. 21 µl of each fraction were loaded on a 12% SDS gel.

K) His-fusion Proteins Renaturation

10% glycerol was added to the denatured proteins. The proteins were then diluted to 20 µg/ml using dialysis buffer I (10% glycerol, 0.5M arginine, 50 mM phosphate buffer, 5 mM reduced glutathione, 0.5 mM oxidised glutathione, 2M urea, pH 8.8) and dialysed against the same buffer at 4° C. for 12–14 hours. The protein was further dialysed against dialysis buffer II (10% glycerol, 0.5M arginine, 50 mM phosphate buffer, 5 mM reduced glutathione, 0.5 mM oxidised glutathione, pH 8.8) for 12–14 hours at 4° C. Protein concentration was evaluated using the formula:

$$\text{Protein (mg/ml)} = (1.55 \times OD_{280}) - (0.76 \times OD_{260})$$

L) His-fusion Large-scale Purification (ORFs 111–129)

500 ml of bacterial cultures were induced and the fusion proteins were obtained soluble in buffer M1, M2 or M3 using the procedure described above. The crude extract of the bacteria was loaded onto a Ni-NTA superflow column (Quiagen) equilibrated with buffer M1, M2 or M3 depending on the solubilization buffer of the fusion proteins. Unbound material was eluted by washing the column with the same buffer. The specific protein was eluted with the corresponding buffer containing 500 mM imidazole and dialysed against the corresponding buffer without imidazole. After each run the columns were sanitized by washing with at least two column volumes of 0.5 M sodium hydroxide and reequilibrated before the next use.

M) Mice Immunisations

20 µg of each purified protein were used to immunise mice intraperitoneally. In the case of ORFs 2, 4, 15, 22, 27, 28, 37, 76, 89 and 97, Balb-C mice were immunised with Al(OH)$_3$ as adjuvant on days 1, 21 and 42, and immune response was monitored in samples taken on day 56. For ORFs 44, 106 and 132, CD1 mice were immunised using the same protocol. For ORFs 25 and 40, CD1 mice were immunised using Freund's adjuvant, rather than Al(OH)$_3$, and the same immunisation protocol was used, except that the immune response was measured on day 42, rather than 56. Similarly, for ORFs 23, 32, 38 and 79, CD1 mice were immunised with Freund's adjuvant, but the immune response was measured on day 49.

N) ELISA Assay (Sera Analysis)

The acapsulated MenB M7 strain was plated on chocolate agar plates and incubated overnight at 37° C. Bacterial colonies were collected from the agar plates using a sterile dracon swab and inoculated into 7 ml of Mueller-Hinton Broth (Difco) containing 0.25% Glucose. Bacterial growth was monitored every 30 minutes by following $OD_{620}$. The bacteria were let to grow until the OD reached the value of 0.3–0.4. The culture was centrifuged for 10 minutes at 100000 rpm. The supernatant was discarded and bacteria were washed once with PBS, resuspended in PBS containing 0.025% formaldehyde, and incubated for 2 hours at room temperature and then overnight at 4° C. with stirring. 100 µl bacterial cells were added to each well of a 96 well Greiner plate and incubated overnight at 4° C. The wells were then washed three times with PBT washing buffer (0.1% Tween-20 in PBS). 200 µl of saturation buffer (2.7% Polyvinylpyrrolidone 10 in water) was added to each well and the plates incubated for 2 hours at 37° C. Wells were washed three times with PBT. 200 µl of diluted sera (Dilution buffer: 1% BSA, 0.1% Tween-20, 0.1% NaN$_3$ in PBS) were added to each well and the plates incubated for 90 minutes at 37° C. Wells were washed three times with PBT. 100 µl of HRP-conjugated rabbit anti-mouse (Dako) serum diluted 1:2000 in dilution buffer were added to each well and the plates were incubated for 90 minutes at 37° C. Wells were washed three times with PBT buffer. 100 µl of substrate buffer for HRP (25 ml of citrate buffer pH5, 10 mg of O-phenildiamine and 10 µl of H$_2$O) were added to each well and the plates were left at room temperature for 20 minutes. 100 µl H$_2$SO$_4$ was added to each well and $OD_{490}$ was followed. The ELISA was considered positive when $OD_{490}$ was 2.5 times the respective pre-immune sera.

O) FACScan Bacteria Binding Assay Procedure.

The acapsulated MenB M7 strain was plated on chocolate agar plates and incubated overnight at 37° C. Bacterial colonies were collected from the agar plates using a sterile dracon swab and inoculated into 4 tubes containing 8 ml each Mueller-Hinton Broth (Difco) containing 0.25% glucose. Bacterial growth was monitored every 30 minutes by following $OD_{620}$. The bacteria were let to grow until the OD reached the value of 0.35–0.5. The culture was centrifuged for 10 minutes at 4000 rpm. The supernatant was discarded and the pellet was resuspended in blocking buffer (1% BSA, 0.4% NaN$_3$) and centrifuged for 5 minutes at 4000 rpm. Cells were resuspended in blocking buffer to reach $OD_{620}$ of 0.07. 100 µl bacterial cells were added to each well of a Costar 96 well plate. 100 µl of diluted (1:200) sera (in blocking buffer) were added to each well and plates incubated for 2 hours at 4° C. Cells were centrifuged for 5 minutes at 4000 rpm, the supernatant aspirated and cells washed by addition of 200 µl/well of blocking buffer in each well. 100 µl of R-Phicoerytrin conjugated F(ab)$_2$ goat anti-mouse, diluted 1:100, was added to each well and plates incubated for 1 hour at 4° C. Cells were spun down by centrifugation at 4000 rpm for 5 minutes and washed by addition of 200 µl/well of blocking buffer. The supernatant was aspirated and cells resuspended in 200 µl/well of PBS, 0.25% formaldehyde. Samples were transferred to FACScan tubes and read. The condition for FACScan setting were: FL1 on, FL2 and FL3 off; FSC-H threshold:92; FSC PMT Voltage: E 02; SSC PMT: 474; Amp. Gains 7.1; FL-2 PMT: 539; compensation values: 0.

P) OMV Preparations

Bacteria were grown overnight on 5 GC plates, harvested with a loop and resuspended in 10 ml 20 mM Tris-HCl. Heat inactivation was performed at 56° C. for 30 minutes and the bacteria disrupted by sonication for 10 minutes on ice (50% duty cycle, 50% output). Unbroken cells were removed by centrifugation at 5000 g for 10 minutes and the total cell envelope fraction recovered by centrifugation at 50000 g at 4° C. for 75 minutes. To extract cytoplasmic membrane proteins from the crude outer membranes, the whole fraction was resuspended in 2% sarkosyl (Sigma) and incubated at room temperature for 20 minutes. The suspension was centrifuged at 10000 g for 10 minutes to remove aggregates, and the supernatant further ultracentrifuged at 5000 g for 75 minutes to pellet the outer membranes. The outer membranes were resuspended in 10 mM Tris-HCl, pH8 and the protein concentration measured by the Bio-Rad Protein assay, using BSA as a standard.

Q) Whole Extracts Preparation

Bacteria were grown overnight on a GC plate, harvested with a loop and resuspended in 1 ml of 20 mM Tris-HCl. Heat inactivation was performed at 56° C. for 30 minutes.

R) Western Blotting

Purified proteins (500 ng/lane), outer membrane vesicles (5 μg) and total cell extracts (25 μg) derived from MenB strain 2996 were loaded on 15% SDS-PAGE and transferred to a nitrocellulose membrane. The transfer was performed for 2 hours at 150 mA at 4° C., in transferring buffer (0.3% Tris base, 1.44% glycine, 20% methanol). The membrane was saturated by overnight incubation at 4° C. in saturation buffer (10% skimmed milk, 0.1% Triton X100 in PBS). The membrane was washed twice with washing buffer (3% skimmed milk, 0.1% Triton X100 in PBS) and incubated for 2 hours at 37° C. with mice sera diluted 1:200 in washing buffer. The membrane was washed twice and incubated for 90 minutes with a 1:2000 dilution of horseradish peroxidase labelled anti-mouse Ig. The membrane was washed twice with 0.1% Triton X100 in PBS and developed with the Opti-4CN Substrate Kit (Bio-Rad). The reaction was stopped by adding water.

S) Bactericidal Assay

MC58 strain was grown overnight at 37° C. on chocolate agar plates. 5–7 colonies were collected and used to inoculate 7 ml Mueller-Hinton broth. The suspension was incubated at 37° C. on a nutator and let to grow until $OD_{620}$ was 0.5–0.8. The culture was aliquoted into sterile 1.5 ml Eppendorf tubes and centrifuged for 20 minutes at maximum speed in a microfuge. The pellet was washed once in Gey's buffer (Gibco) and resuspended in the same buffer to an $OD_{620}$ of 0.5, diluted 1:20000 in Gey's buffer and stored at 25° C.

50 μl of Gey's buffer/1% BSA was added to each well of a 96-well tissue culture plate. 25 μl of diluted mice sera (1:100 in Gey's buffer/0.2% BSA) were added to each well and the plate incubated at 4° C. 25 μl of the previously described bacterial suspension were added to each well. 25 μl of either heat-inactivated (56° C. waterbath for 30 minutes) or normal baby rabbit complement were added to each well. Immediately after the addition of the baby rabbit complement, 22 μl of each sample/well were plated on Mueller-Hinton agar plates (time 0). The 96-well plate was incubated for 1 hour at 37° C. with rotation and then 22 μl of each sample/well were plated on Mueller-Hinton agar plates (time 1). After overnight incubation the colonies corresponding to time 0 and time 1 hour were counted.

Table II gives a summary of the cloning, expression and prurification results.

TABLE II

Summary of cloning, expression and purification

| ORF | PCR/cloning | His-fusion expression | GST-fusion expression | Purification |
|---|---|---|---|---|
| orf 1 | + | + | + | His-fusion |
| orf 2 | + | + | + | GST-fusion |
| orf 2.1 | + | n.d. | + | GST-fusion |
| orf 4 | + | + | + | His-fusion |
| orf 5 | + | n.d. | + | GST-fusion |
| orf 6 | + | + | + | GST-fusion |
| orf 7 | + | + | + | GST-ftision |
| orf 8 | + | n.d. | n.d | |
| orf 9 | + | + | + | GST-fusion |
| orf 10 | + | n.d. | n.d. | |
| orf 11 | + | n.d. | n.d. | |
| orf 13 | + | n.d. | + | GST-fusion |
| orf 15 | + | + | + | GST-fusion |
| orf 17 | + | n.d. | n.d. | |
| orf 18 | + | n.d. | n.d. | |
| orf 19 | + | n.d. | n.d. | |
| orf 20 | + | n.d. | n.d. | |
| orf 22 | + | + | + | GST-fusion |
| orf 23 | + | + | + | His-fusion |
| orf 24 | + | n.d. | n.d. | |
| orf 25 | + | + | + | His-fusion |
| orf 26 | + | n.d. | n.d. | |
| orf 27 | + | + | + | GST-fusion |
| orf 28 | + | + | + | GST-fusion |
| orf 29 | + | n.d. | n.d. | |
| orf 32 | + | + | + | His-fusion |
| orf 33 | + | n.d. | n.d. | |
| orf 35 | + | n.d. | n.d. | |
| orf 37 | + | + | + | GST-fusion |
| orf 58 | + | n.d. | n.d. | |
| orf 65 | + | n.d. | n.d. | |
| orf 66 | + | n.d. | n.d. | |
| orf 72 | + | + | n.d. | His-fusion |
| orf 73 | + | n.d. | + | n.d. |
| orf 75 | + | n.d. | n.d. | |
| orf 76 | + | + | n.d. | His-fusion |
| orf 79 | + | + | n.d. | His-fusion |
| orf 83 | + | n.d. | + | n.d. |
| orf 84 | + | n.d. | n.d. | |
| orf 85 | + | n.d. | + | GST-fusion |
| orf 89 | + | n.d. | + | GST-fusion |
| orf 97 | + | + | + | GST-fusion |
| orf 98 | + | n.d. | n.d. | |
| orf 100 | + | n.d. | n.d. | |
| orf 101 | + | n.d. | n.d. | |
| orf 102 | + | n.d. | n.d. | |
| orf 103 | + | n.d. | n.d. | |
| orf 104 | + | n.d. | n.d. | |
| orf 105 | + | n.d. | n.d. | |
| orf 106 | + | + | + | His-fusion |
| orf 109 | + | n.d. | n.d. | |
| orf 110 | + | n.d. | n.d. | |
| orf 111 | + | + | n.d. | His-fusion |
| orf 113 | + | + | n.d. | His-fusion |
| orf 115 | n.d. | n.d. | n.d. | |
| orf 119 | + | + | n.d. | His-fusion |
| orf 120 | + | + | n.d. | His-fusion |
| orf 121 | + | n.d. | n.d. | |
| orf 122 | + | + | n.d. | His-fusion |
| orf 125 | + | + | n.d. | His-fusion |
| orf 126 | + | + | n.d. | His-fusion |
| orf 127 | + | + | n.d. | His-fusion |
| orf 128 | + | n.d. | n.d. | |
| orf 129 | + | + | n.d. | His-fusion |
| orf 130 | + | n.d. | n.d. | |
| orf 131 | + | + | + | n.d. |
| orf 132 | + | + | + | His-fusion |
| orf 133 | + | n.d. | + | GST-fusion |
| orf 134 | + | n.d. | n.d. | |
| orf 135 | + | n.d. | n.d. | |
| orf 136 | + | n.d. | n.d. | |
| orf 137 | + | n.d. | + | GST-fusion |
| orf 138 | + | n.d. | + | GST-fusion |
| orf 139 | + | n.d. | n.d. | |
| orf 140 | + | n.d. | n.d. | |
| orf 141 | + | n.d. | n.d. | |
| orf 142 | + | n.d. | n.d. | |
| orf 143 | + | n.d. | n.d. | |
| orf 144 | + | n.d. | + | n.d. |
| orf 147 | + | n.d. | n.d. | |

Example 1

The following partial DNA sequence was identified in *N.meningitidis* (SEQ ID NO: 1):

```
  1 ATGAAACAGA CAGTCAA.AT GCTTGCCGCC GCCCTGATTG CCTTGGGCTT
 51 GAACCGACCG GTGTGGNCGG ATGACGTATC GGATTTTCGG GAAAACTTGC
101 A.GCGGCAGC ACAGGGAAAT GCAGCAGCCC AATACAATTT GGGCGCAATG
151 TAT.TACAAA GGACGCGCGT GCGCCGGGAT GATGCTGAAG CGGTCAGATG
201 GTATCGGCAG CCGGCGGAAC AGGGGTTAGC CCAAGCCCAA TACAATTTGG
251 GCTGGATGTA TGCCAACGGG CGCGC.GTGC GCCAAGATGA TACCGAAGCG
301 GTCAGATGGT ATCGGCAGGC GGCAGCGCAG GGGGTTGTCC AAGCCCAATA
351 CAATTTGGGC GTGATATATG CCGAAGGACG TGGAGTGCGC CAAGACGATG
401 TCGAAGCGGT CAGATGGTTT CGGCAGGCGG CAGCGCAGGG GGTAGCCCAA
451 GCCCAAAACA ATTTGGGCGT GATGTATGCC GAAAGANCGC GCGTGCGCCA
501 AGACCG...
```

This corresponds to the amino acid sequence (SEQ ID NO: 2; ORF37):

```
  1 MKQTVXMLAA ALIALGLNRP VWXDDVSDFR ENLXAAAQGN AAAQYNLGAM
 51 YXQRTRVRRD DAEAVRWYRQ PAEQGLAQAQ YNLGWMYANG RXVRQDDTEA
101 VRWYRQAAAQ GVVQAQYNLG VIYAEGRGVR QDDVEAVRWF RQAAAQGVAQ
151 AQNNLGVMYA ERXRVRQD...
```

Further work revealed the complete nucleotide sequence (SEQ ID NO: 3):

```
  1 ATGAAACAGA CAGTCAAATG GCTTGCCGCC GCCCTGATTG CCTTGGGCTT
 51 GAACCGAGCG GTGTGGGCGG ATGACGTATC GGATTTTCGG GAAAACTTGC
101 AGGCGGCAGC ACAGGGAAAT GCAGCAGCCC AATACAATTT GGGCGCAATG
151 TATTACAAAG GACGCGGCGT GCGCCGGGAT GATGCTGAAG CGGTCAGATG
201 GTATCGGCAG GCGGCGGAAC AGGGGTTAGC CCAAGCCCAA TACAATTTGG
251 GCTGGATGTA TGCCAACGGG CGCGGCGTGC GCCAAGATGA TACCGAAGCG
301 GTCAGATGGT ATCGGCAGGC GGCAGCGCAG GGGGTTGTCC AAGCCCAATA
351 CAATTTGGGC GTGATATATG CCGAAGGACG TGGAGTGCGC CAAGACGATG
401 TCGAAGCGGT CAGATGGTTT CGGCAGGCGG CAGCGCAGGG GGTAGCCCAA
451 GCCCAAAACA ATTTGGGCGT GATGTATGCC GAAAGACGCG GCGTGCGCCA
501 AGACCGCGCC CTTGCACAAG AATGGTTTGG CAAGGCTTGT CAAAACGGAG
551 ACCAAGACGG CTGCGACAAT GACCAACGCC TGAAGGCGGG TTATTGA
```

This corresponds to the amino acid sequence (SEQ ID NO: 4; ORF37-1):

```
  1  MKQTVKWLAA ALIALGLNRA VWADDVSDFR ENLQAAAQGN AAAQYNLGAM

51  YYKGRGVRRD DAEAVRWYRQ AAEQGLAQAQ YNLGWMYANG RGVRQDDTEA

101  VRWYRQAAAQ GVVQAQYNLG VIYAEGRGVR QDDVEAVRWF RQAAAQGVAQ

151  AQNNLGVMYA ERRGVRQDRA LAQEWFGKAC QNGDQDGCDN DQRLKAGY*
```

Further work identified the corresponding gene in strain A of *N.meningitidis* (SEQ ID NO: 5):

```
  1  ATGAAACAGA CAGTCAAATG GCTTGCCGCC GCCCTGATTG CCTTGGGCTT

51  GAACCAAGCG GTGTGGGCGG ATGACGTATC GGATTTTCGG GAAAACTTGC

101  AGGCGGCAGC ACAGGGAAAT GCAGCAGCCC AAAACAATTT GGGCGTGATG

151  TATGCCGAAA GACGCGGCGT GCGCCAAGAC CGCGCCCTTG CACAAGAATG

201  GCTTGGCAAG GCTTGTCAAA ACGGATACCA AGACAGCTGC GACAATGACC

251  AACGCCTGAA AGCGGGTTAT TGA
```

This encodes a protein having amino acid sequence (SEQ ID NO: 6; ORF37a):

```
  1  MKQTVKWLAA ALIALGLNQA VWADDVSDFR ENLQAAAQGN AAAQNNLGVM

51  YAERRGVRQD RALAQEWLGK ACQNGYQDSC DNDQRLKAGY *
```

The originally-identified partial strain B sequence (ORF37) (SEQ ID NO: 2) shows 68.0% identity over a 75aa overlap with ORF37a (SEQ ID NO: 6):

```
                    10         20         30         40         50         60
orf37.pep   MKQTVXMLAAALIALGLNRPVWXDDVSDFRENLXAAAQGNAAAQYNLGAMYXQRTRVRRD
            |||||   |||||||||||| : || ||||||||||| |||||||||| |||:||  :|    ||:|
orf37a      MKQTVKWLAAALIALGLNQAVWADDVSDFRENLQAAAQGNAAAQNNLGVMYAERRGVRQD
                    10         20         30         40         50         60

70         80         90        100        110        120
orf37.pep   DAEAVRWYRQPAEQGLAQAQYNLGWMYANGRXVRQDDTEAVRWYRQAAAQGVVQAQYNLG
            |  |  :|    :  ::|
orf37a      RALAQEWLGKACQNGYQDSCDNDQRLKAGYX
                    70         80         90
```

Further work identified the corresponding gene in *N.gonorrhoeae* (SEQ ID NO: 7):

```
  1  ATGAAACAGA CAGTCAAATG GCTTGCCGCC GCCCTGATTG CCTTGGGCTT

51  GAACCAAGCG GTGTGGGCGG GTGACGTATC GGATTTTCGG GAAAACTTGC

101  AGgcggcaGA ACAggGAAAT GCAGCAGCCC AATTCAATTT GGGCGTGATG

151  TATGAAAATG GACAAGGAGT TCGTCAAGAT TATGTACAGG CAGTGCAGTG

201  GTATCGCAAG GCTTCAGAAC AAGGGGATGC CCAAGCCCAA TACAATTTGG

251  GCTTGATGTA TTACGATGGA CGCGGCGTGC GCCAAGACCT TGCGCTCGCT

301  CAACAATGGC TTGGCAAGGC TTGTCAAAAC GGAGACCAAA ACAGCTGCGA

351  CAATGACCAA CGCCTGAAGG CGGGTTATTA A
```

This encodes a protein having amino acid sequence (SEQ ID NO: 8; ORF37ng):

```
  1  MKQTVKWLAA ALIALGLNQA VWAGDVSDFR ENLQAAEQGN AAAQFNLGVM

51  YENGQGVRQD YVQAVQWYRK ASEQGDAQAQ YNLGLMYYDG RGVRQDLALA

101  QQWLGKACQN GDQNSCDNDQ RLKAGY*
```

The originally-identified partial strain B sequence (ORF37) (SEQ ID NO: 2) shows 64.9% identity over a 111aa overlap with ORF37ng (SEQ ID NO: 8):

```
orf37.pep  MKQTVXMLAAALIALGLNRPVWXDDVSDFRENLXAAAQGNAAAQYNLGAMYXQRTRVRRD   60
           |||||  |||||||||||: ||  |||||||||| ||  ||||||||:|||:||  :   ||:|
orf37ng    MKQTVKWLAAALIALGLNQAVWAGDVSDFRENLQAAEQGNAAAQFNLGVMYENGQGVRQD   60 orf37.pep  DAEAVRWYRQPAEQGLAQAQYNLGWMYANGRXVRQDDTEAVRWYRQAAAQGVVQAQYNLG  120
           ::||:|||: :||| ||||||||| ||  :|| ||||  :  | :|   :|   :|
orf37ng    YVQAVQWYRKASEQGDAQAQYNLGLMYYDGRGVRQDLALAQQWLGKACQNGDQNSCDNDQ  120 orf37.pep  VIYAEGRGVRQDDVEAVRWFRQAAAQGVAQAQNNLGVMYAERXRVRQD              168 orf37ng    RLKAGY                                                        126
```

The complete strain B sequence (ORF37-1) (SEQ ID NO: 4) and ORF37ng (SEQ ID NO: 8) show 51.5% identity in 198 aa overlap:

```
                    10         20         30         40         50         60
orf37-1.pep  MKQTVKWLAAALIALGLNRAVWADDVSDFRENLQAAAQGNAAAQYNLGAMYYKGRGVRRD
             |||||||||||||||||||:||||  ||||||||||||  ||||||||:|||:||  :|:|||:|
orf37ng      MKQTVKWLAAALIALGLNQAVWAGDVSDFRENLQAAEQGNAAAQFNLGVMYENGQGVRQD
                    10         20         30         40         50         60

70         80         90        100        110        120
orf37-1.pep  DAEAVRWYRQAAEQGLAQAQYNLGWMYANGRGVRQDDTEAVRWYRQAAAQGVVQAQYNLG
             ::||:|||:|:||| ||||||||| ||  :|||||||
orf37ng      YVQAVQWYRKASEQGDAQAQYNLGLMYYDGRGVRQD------------------------
                    70         80         90

130        140        150        160        170        180
orf37-1.pep  VIYAEGRGVRQDDVEAVRWFRQAAAQGVAQAQNNLGVMYAERRGVRQDRALAQEWFGKAC
                                                             ||||:|:||||
orf37ng      ------------------------------------------------LALAQQWLGKAC
                                                                      100

190    199
orf37-1.pep  QNGDQDGCDNDQRLKAGYX
             |||||::|||||||||||||
orf37ng      QNGDQNSCDNDQRLKAGYX
                   110        120
```

Computer analysis of these amino acid sequences indicates a putative leader sequence, and it was predicted that the proteins from *N.meningitidis* and *N.gonorrhoeae*, and their epitopes, could be useful antigens for vaccines or diagnostics, or for raising antibodies.

Figure 1B:
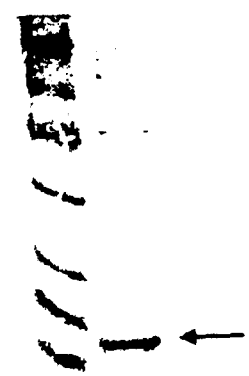
Figure 1C:
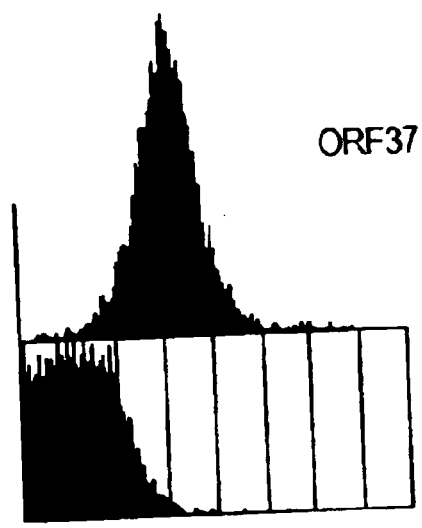
Figure 1D:
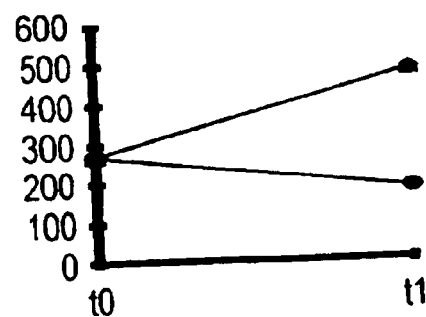

ORF37-1 (SEQ ID NO: 4) (11 kDa) was cloned in pET and pGex vectors and expressed in *E.coli*, as described above. The products of protein expression and purification were analyzed by SDS-PAGE. FIG. 1A shows the results of affinity purification of the GST-fusion protein, and FIG. 1B shows the results of expression of the His-fusion in *E.coli*. Purified GST-fusion protein was used to immunise mice, whose sera were used for ELISA (positive result), FACS analysis (FIG. 1C), and a bactericidal assay (FIG. 1D). These experiments confirm that ORF37-1 (SEQ ID NO: 4) is a surface-exposed protein, and that it is a useful immunogen.

Figure 1E:
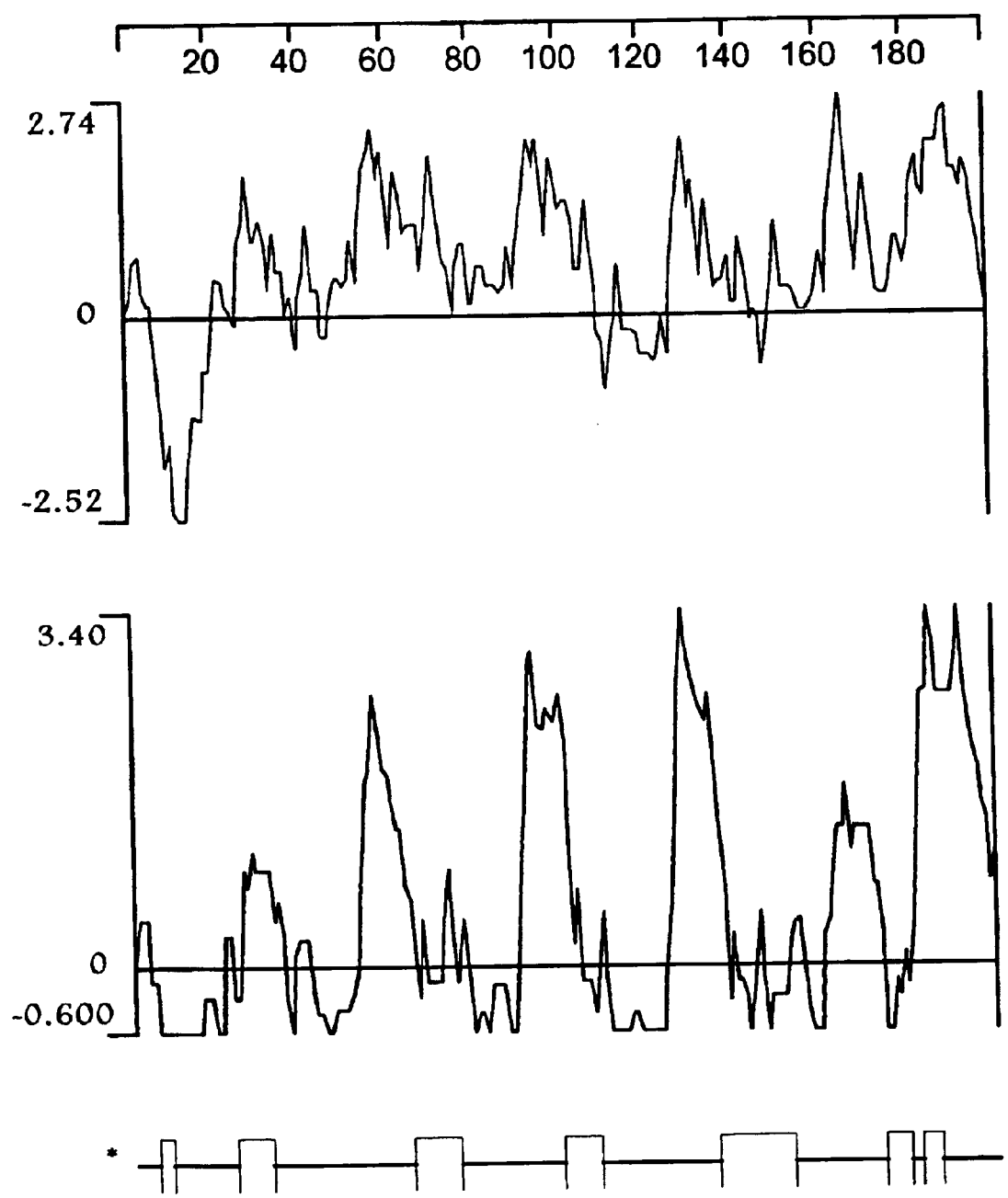

FIG. 1E shows plots of hydrophilicity, antigenic index, and AMPHI regions for ORF37-1 (SEQ ID NO: 4).

Example 2

The following partial DNA sequence was identified in *N.meningitidis* (SEQ ID NO: 9):

```
TTCGGCGA CATCGGCGGT TTGAAGGTCA ATGCCCCCGT CAAATCCGCA
GGCGTATTGG TCGGGCGCGT CGGCGCTATC GGACTTGACC CGAAATCCTA
TCAGGCGAGG GTGCGCCTCG ATTTGGACGG CAAGTATCAG TTCAGCAGCG
ACGTTTCCGC GCAAATCCTG ACTTCsGGAC TTTTGGGCGA GCAGTACATC
GGGCTGCAGC AGGGCGGCGA CACGGAAAAC CTTGCTGCCG GCGACACCAT
CTCCGTAACC AGTTCTGCAA TGGTTCTGGA AAACCTTATC GGCAAATTCA
TGACGAGTTT TGCCGAGAAA AATGCCGACG GCGGCAATGC GGAAAAAGCC
GCCGAATAA
```

This corresponds to the amino acid sequence (SEQ ID NO: 10):

```
  1  FGDIGGLKVN APVKSAGVLV GRVGAIGLDP KSYQARVRLD LDGKYQFSSD

51  VSAQILTSGL LGEQYIGLQQ GGDTENLAAG DTISVTSSAM VLENLIGKFM

101  TSFAEKNADG GNAEKAAE*
```

Computer analysis of this amino acid sequence gave the following results:
Homology with a Hypothetical *H.influenzae* Protein 25 (ybrd.haein; Accession Number p45029 (SEQ ID NO: 1105))
SEQ ID NO: 9 and ybrd.haein (SEQ ID NO: 1105) show 48.4% aa identity in 122 aa overlap:

```
                20         30         40         50         60         70
yrbd.h LGIGALVFLGLRVANVQGFAETKSYTVTATFDNIGGLKVRAPLKIGGVVIGRVSAITLDE
                                  |::||||||:||:| :||::|||:||:||
                            N.m FGDIGGLKVNAPVKSAGVLVGRVGAIGLDP
                                          10         20         30

80         90        100        110        120        130
yrbd.h KSYLPKVSIAINQEYNEIPENSSLSIKTSGLLGEQYIALTMGFDDGDTAMLKNGSQIQDT
       |||  ::|:::::  :|  :::::  |   |  ||||||||||:|   |   |||: | :|:  |   |
N.m    KSYQARVRLDLDGKY-QFSSDVSAQILTSGLLGEQYIGLQQG---GDTENLAAGDTISVT
                40         50         60         70         80

140        150        160
yrbd.h TSAMVLEDLIGQFL--YGSKKSDGNEKSESTEQ
       :||||||:|||:|:   :::|::||::  ::::|:
N.m    SSAMVLENLIGKFMTSFAEKNADGGNAEKAAEX
               90        100        110        120
```

Homology with a Predicted ORF from *N.gonorrhoeae*
SEQ ID NO: 9 shows 99.2% identity over a 118aa overlap with a predicted ORF from *N. gonorrhoeae* (SEQ ID NO: 1106 yrbx):

```
              20         30         40         50         60         70
yrbd   GAAAVAFLAFRVAGGAAFGGSDKTYAVYADFGDIGGLKVNAPVKSAGVLVGRVGAIGLDP
                                  ||||||||||||||||||||||||||||||
                            N.m FGDIGGLKVNAPVKSAGVLVGRVGAIGLDP
                                          10         20         30

80         90        100        110        120        130
yrbd   KSYQARVRLDLDGKYQFSSDVSAQILTSGLLGEQYIGLQQGGDTENLAAGDTISVTSSAM
       ||||||||||||||||||||||||||||||||||||||||||||||||||||||||||||
N.m    KSYQARVRLDLDGKYQFSSDVSAQILTSGLLGEQYIGLQQGGDTENLAAGDTISVTSSAM
                40         50         60         70         80         90

140        150        160
yrbd   VLENLIGKFMTSFAEKNAEGGNAEKAAEX
       |||||||||||||||||||:|||||||||
N.m    VLENLIGKFMTSFAEKNADGGNAEKAAEX
              100        110        120
```

The complete yrbd H.influenzae sequence has a leader sequence and it is expected that the full-length homologous N.meningitidis protein will also have one. This suggests that it is either a membrane protein, a secreted protein, or a surface protein and that the protein, or one of its epitopes, could be a useful antigen for vaccines or diagnostics.

Example 3

The following partial DNA sequence was identified in *N.meningitidis* (SEQ ID NO: 11):

```
  1  ..ATTTTGATAT ACCTCATCCG CAAGAATCTA GGTTCGCCCG TCTTCTTCTT
 51    TCAGGAACGC CCCGGAAAGG ACGGAAAACC TTTTAAAATG GTCAAATTCC
101    GTTCCATGCG CGACGGCTTG TATTCAGACG GCATTCCGCT GCCCGACGGA
151    GAACGCCTGA CACCGTTCGG CAAAAAACTG CGTGCCGcCA GTwTGGACGA
201    ACTGCCTGAA TTATGGAATA TCTTAAAAGG CGAGATGAGC CTGGTCGGCC
251    CCCGCCCGCT GCTGATGCAA TATCTGCCGC TGTACGACAA CTTCCAAAAC
301    CGCCGCCACG AAATGAAACC CGGCATTACC GGCTGGGCGC AGGTCAACGG
351    GCGCAACGCg CTTTCGTGGG ACGAAAAATT CGCCTGCGAT GTTTGGTATA
401    TCGACCACTT CAGCCTGTGC CTCGACATCA AAATCCTACT GCTGACGGTT
451    AAAAAAGTAT TAATCAAGGA AGGGATTTCC GCACAGGGCG AACA.aCCAT
501    GCCCCCTTTC ACAGGAAAAC GCAAACTCGC CGTCGTCGGT GCGGGCGGAC
551    ACGGAAAAGT CGTTGCCGAC CTTGCCGCCG CACTCGGCCG GTACAGGGAA
601    ATCGTTTTTC TGGACGACCG CGCACAAGGC AGCGTCAACG GCTTTTCCGT
651    CATCGGCACG ACGCTGCTGC TTGAAAACAG TTTATCGCCC GAACAATACG
701    ACGTCGCCGT CGCCGTCGGC AACAACCGCA TCCGCCGCCA AATCGCCGAA
751    AAAGCCGCCG CGCTCGGCTT CGCCCTGCCC GTACTGGTTC ATCCGGACGC
801    GACCGTCTCG CCTTCTGCAA CAGTCGGACA AGGCAGCGTC GTTATGGCGA
851    AAGCGGTCG..
```

This corresponds to the amino acid sequence (SEQ ID NO: 12; ORF3):

```
  1  ..ILIYLIRKNL GSPVFFFQER PGKDGKPFKM VKFRSMRDGL YSDGIPLPDG
 51    ERLTPFGKKL RAASXDELPE LWNILKGEMS LVGPRPLLMQ YLPLYDNFQN
101    RRHEMKPGIT GWAQVNGRNA LSWDEKFACD VWYIDHFSLC LDIKILLLTV
151    KKVLIKEGIS AQGEXTMPPF TGKRKLAVVG AGGHGKVVAD LAAALGRYRE
201    IVFLDDRAQG SVNGFSVIGT TLLLENSLSP EQYDVAVAVG NNRIRRQIAE
251    KAAALGFALP VLVHPDATVS PSATVGQGSV VMAKAV..
```

Further sequence analysis revealed the complete nucleotide sequence (SEQ ID NO: 13):

```
  1  ATGAGTAAAT TCTTCAAACG CCTGTTTGAC ATTGTTGCCT CCGCCTCGGG
 51  ACTGATTTTC CTCTCGCCAG TATTTTTGAT TTTGATATAC CTCATCCGCA
101  AGAATCTAGG TTCGCCCGTC TTCTTCTTTC AGGAACGCCC CGGAAAGGAC
151  GGAAAACCTT TTAAAATGGT CAAATTCCGT TCCATGCGCG ACGCGCTTGA
201  TTCAGACGGC ATTCCGCTGC CCGACGGAGA ACGCCTGACA CCGTTCGGCA
```

```
-continued
 251   AAAAACTGCG TGCCGCCAGT TTGGACGAAC TGCCTGAATT ATGGAATATC

301   TTAAAAGGCG AGATGAGCCT GGTCGGCCCC CGCCCGCTGC TGATGCAATA

351   TCTGCCGCTG TACGACAACT TCCAAAACCG CCGCCACGAA ATGAAACCCG

401   GCATTACCGG CTGGGCGCAG GTCAACGGGC GCAACGCGCT TTCGTGGGAC

451   GAAAAATTCG CCTGCGATGT TTGGTATATC GACCACTTCA GCCTGTGCCT

501   CGACATCAAA ATCCTACTGC TGACGGTTAA AAAAGTATTA ATCAAGGAAG

551   GGATTTCCGC ACAGGGCGAA GCCACCATGC CCCCTTTCAC AGGAAAACGC

601   AAACTCGCCG TCGTCGGTGC GGGCGGACAC GGAAAAGTCG TTGCCGACCT

651   TGCCGCCGCA CTCGGCCGGT ACAGGGAAAT CGTTTTTCTG GACGACCGCG

701   CACAAGGCAG CGTCAACGGC TTTTCCGTCA TCGGCACGAC GCTGCTGCTT

751   GAAAACAGTT TATCGCCCGA ACAATACGAC GTCGCCGTCG CCGTCGGCAA

801   CAACCGCATC CGCCGCCAAA TCGCCGAAAA AGCCGCCGCG CTCGGCTTCG

851   CCCTGCCCGT TCTGGTTCAT CCGGACGCGA CCGTCTCGCC TTCTGCAACA

901   GTCGGACAAG GCAGCGTCGT TATGGCGAAA GCCGTCGTAC AGGCAGGCAG

951   CGTATTGAAA GACGGCGTGA TTGTGAACAC TGCCGCCACC GTCGATCACG

1001   ACTGCCTGCT TAACGCTTTC GTCCACATCA GCCCAGGCGC GCACCTGTCG

1051   GGCAACACGC ATATCGGCGA AGAAAGCTGG ATAGGCACGG GCGCGTGCAG

1101   CCGCCAGCAG ATCCGTATCG GCAGCCGCGC AACCATTGGA GCGGGCGCAG

1151   TCGTCGTACG CGACGTTTCA GACGGCATGA CCGTCGCGGG CAATCCGGCA

1201   AAGCCGCTGC CGCGCAAAAA CCCCGAGACC TCGACAGCAT AA
```

This corresponds to the amino acid sequence (SEQ ID NO: 14; ORF3-1):

```
  1   MSKFFKRLFD IVASASGLIF LSPVFLILIY LIRKNLGSPV FFFQERPGKD

51   GKPFKMVKFR SMRDALDSDG IPLPDGERLT PFGKKLRAAS LDELPELWNI

101   LKGEMSLVGP RPLLMQYLPL YDNFQNRRHE MKPGITGWAQ VNGRNALSWD

151   EKFACDVWYI DHFSLCLDIK ILLLTVKKVL IKEGISAQGE ATMPPFTGKR

201   KLAVVGAGGH GKVVADLAAA LGRYREIVFL DDRAQGSVNG FSVIGTTLLL

251   ENSLSPEQYD VAVAVGNNRI RRQIAEKAAA LGFALPVLVH PDATVSPSAT

301   VGQGSVVMAK AVVQAGSVLK DGVIVNTAAT VDHDCLLNAF VHISPGAHLS

351   GNTHIGEESW IGTGACSRQQ IRIGSRATIG AGAVVVRDVS DGMTVAGNPA

401   KPLPRKNPET STA*
```

Computer analysis of this amino acid sequence gave the following results:
Homology with a Predicted ORF from *N.meningitidis* (Strain A)

ORF3 (SEQ ID NO: 12) shows 93.0% identity over a 286aa overlap with an ORF (ORF3a) (SEQ ID NO: 16) from strain A of *N. meningitidis*:

```
                                    10         20         30
        orf3.pep                    ILIYLIRKNLGSPVFFFQERPGKDGKPFKMVKFR
                                    |||||||||||||||||||||||||||||||||
        orf3a       MSKFFKRLFDIVASASGLIFLSPVFLILIYLIRKNLGSPVFFFQERPGKDGKPFKMVKFR
                            10         20         30         40         50         60
```

```
                40        50        60        70        80        90
orf3.pep  SMRDGLYSDGIPLPDGERLTPFGKKLRAASXDELPELWNILKGEMSLVGPRPLLMQYLPL
          ||:|:| |||| |||||||||||||||||| ||||||||:|||:||||||||||||||||
orf3a     SMHDALDSDGILLPDGERLTPFGKKLRAASLDELPELWNVLKGDMSLVGPRPLLMQYLPL
                70        80        90       100       110       120

100       110       120       130       140       150
orf3.pep  YDNFQNRRHEMKPGITGWAQVNGRNALSWDEKFACDVWYIDHFSLCLDIKILLLTVKKVL
          |||||||||||||||||||||||||||||||:||||:|||||||||||||||||||||||
orf3a     YDNFQNRRHEMKPGITGWAQVNGRNALSWDERFACDIWYIDHFSLCLDIKILLLTVKKVL
                130       140       150       160       170       180

160       170       180       190       200       210
orf3.pep  IKEGISAQGEXTMPPFTGKRKLAVVGAGGHGKVVADLAAALGRYREIVFLDDRAQGSVNG
          |||||||||| |||||||||||||||||||||||:|||| |||||:||||||:|||||
orf3a     IKEGISAQGEATMPPFTGKRKLAVVGAGGHGKVVAELAAALGTYGEIVFLDDRVQGSVNG
                190       200       210       220       230       240

220       230       240       250       260       270
orf3.pep  FSVIGTTLLLENSLSPEQYDVAVAVGNNRIRRQIAEKAAALGFALPVLVHPDATVSPSAT
          | ||||||||||||||||||:|:|||||||||||||||||||||||||:|||:||||||
orf3a     FPVIGTTLLLENSLSPEQFDIAVAVGNNRIRRQIAEKAAALGFALPVLIHPDSTVSPSAT
                250       260       270       280       290       300

280
orf3.pep  VGQGSVVMAKAV
          ||||:|||||||
orf3a     VGQGGVVMAKAVVQADSVLKDGVIVNTAATVDHDCLLDAFVHISPGAHLSGNTRIGEESW
                310       320       330       340       350       360
```

The complete length ORF3a nucleotide sequence (SEQ ID NO: 15) is:

```
   1  ATGAGTAAAT TCTTCAAACG CCTGTTTGAC ATTGTTGCCT CCGCCTCGGG
  51  ACTGATTTTC CTCTCGCCAG TATTTTTGAT TTTGATATAC CTCATCCGCA
 101  AGAATCTGGG TTCGCCCGTC TTCTTCTTTC AGGAACGCCC CGGAAAGGAC
 151  GGAAAACCTT TTAAAATGGT CAAATTCCGT TCCATGCACG ACGCGCTTGA
 201  TTCAGACGGC ATTCTGCTGC CGACGGAGA ACGCCTGACA CCGTTCGGCA
 251  AAAAACTGCG TGCCGCCAGT TTGGACGAAC TGCCCGAACT GTGGAACGTC
 301  CTCAAAGGCG ACATGAGCCT GGTCGGCCCC CGCCCGCTGC TGATGCAATA
 351  TCTGCCGCTG TACGACAACT TCCAAAACCG CCGCCACGAA ATGAAACCGG
 401  GCATTACCGG CTGGGCGCAG GTCAACGGGC GCAACGCGCT TTCGTGGGAC
 451  GAACGCTTCG CATGCGACAT CTGGTATATC GACCACTTCA GCCTGTGCCT
 501  CGACATCAAA ATCCTACTGC TGACGGTTAA AAAAGTATTA ATCAAAGAAG
 551  GGATTTCCGC ACAGGGCGAA GCCACCATGC CCCCTTTCAC AGGAAAACGC
 601  AAACTTGCCG TCGTCGGTGC GGGCGGACAC GGCAAAGTCG TTGCCGAGCT
 651  TGCCGCCGCA CTCGGCACAT ACGGCGAAAT CGTTTTTCTG GACGACCGCG
 701  TCCAAGGCAG CGTCAACGGC TTCCCCGTCA TCGGCACGAC GCTGCTGCTT
 751  GAAAACAGTT TATCGCCCGA ACAATTCGAC ATCGCCGTCG CCGTCGGCAA
 801  CAACCGCATC CGCCGCCAAA TCGCCGAAAA AGCCGCCGCG CTCGGCTTCG
 851  CCCTGCCCGT CCTGATTCAT CCGGACTCGA CCGTCTCGCC TTCTGCAACA
 901  GTCGGACAAG GCGGCGTCGT TATGGCGAAA GCCGTCGTAC AGGCTGACAG
 951  CGTATTGAAA GACGGCGTAA TTGTGAACAC TGCCGCCACC GTCGATCACG
1001  ATTGCCTGCT TGATGCTTTC GTCCACATCA GCCCGGGCGC GCACCTGTCG
1051  GGCAACACGC GTATCGGCGA AGAAAGCTGG ATAGGCACAG GCGCGTGCAG
```

-continued

```
1101  CCGCCAGCAG ATCCGTATCG GCAGCCGCGC AACCATTGGA GCGGGCGCAG

1151  TCGTCGTGCG CGACGTTTCA GACGGCATGA CCGTCGCGGG CAACCCGGCA

1201  AAACCATTGG CAGGCAAAAA TACCGAGACC CTGCGGTCGT AA
```

This is predicted to encode a protein having amino acid sequence (SEQ ID NO: 16):

```
  1  MSKFFKRLFD IVASASGLIF LSPVFLILIY LIRKNLGSPV FFFQERPGKD

51  GKPFKMVKFR SMHDALDSDG ILLPDGERLT PFGKKLRAAS LDELPELWNV

101  LKGDMSLVGP RPLLMQYLPL YDNFQNRRHE MKPGITGWAQ VNGRNALSWD

151  ERFACDIWYI DHFSLCLDIK ILLLTVKKVL IKEGISAQGE ATMPPFTGKR

201  KLAVVGAGGH GKVVAELAAA LGTYGEIVFL DDRVQGSVNG FPVIGTTLLL

251  ENSLSPEQFD IAVAVGNNRI RRQIAEKAAA LGFALPVLIH PDSTVSPSAT

301  VGQGGVVMAK AVVQADSVLK DGVIVNTAAT VDHDCLLDAF VHISPGAHLS

351  GNTRIGEESW IGTGACSRQQ IRIGSRATIG AGAVVVRDVS DGMTVAGNPA

401  KPLAGKNTET LRS*
```

Two transmembrane domains are underlined.
ORF3-1 (SEQ ID NO: 14) shows 94.6% identity in 410 aa overlap with ORF3a (SEQ ID NO: 16):

```
                 10        20        30        40        50        60
orf3a.pep  MSKFFKRLFDIVASASGLIFLSPVFLILIYLIRKNLGSPVFFFQERPGKDGKPFKMVKFR
           ||||||||||||||||||||||||||||||||||||||||||||||||||||||||||||
orf3-1     MSKFFKRLFDIVASASGLIFLSPVFLILIYLIRKNLGSPVFFFQERPGKDGKPFKMVKFR
                 10        20        30        40        50        60

70        80        90       100       110       120
orf3a.pep  SMHDALDSDGILLPDGERLTPFGKKLRAASLDELPELWNVLKGDMSLVGPRPLLMQYLPL
           ||:|||||||| |||||||||||||||||||||||||||:|||:||||||||||||||||
orf3-1     SMRDALDSDGIPLPDGERLTPFGKKLRAASLDELPELWNILKGEMSLVGPRPLLMQYLPL
                 70        80        90       100       110       120

130       140       150       160       170       180
orf3a.pep  YDNFQNRRHEMKPGITGWAQVNGRNALSWDERFACDIWYIDHFSLCLDIKILLLTVKKVL
           |||||||||||||||||||||||||||||||:||||:|||||||||||||||||||||||
orf3-1     YDNFQNRRHEMKPGITGWAQVNGRNALSWDEKFACDVWYIDHFSLCLDIKILLLTVKKVL
                130       140       150       160       170       180

190       200       210       220       230       240
orf3a.pep  IKEGISAQGEATMPPFTGKRKLAVVGAGGHGKVVAELAAALGTYGEIVFLDDRVQGSVNG
           ||||||||||||||||||||||||||||||||||:||||||||:|||||||||:|||||
orf3-1     IKEGISAQGEATMPPFTGKRKLAVVGAGGHGKVVADLAAALGRYREIVFLDDRAQGSVNG
                190       200       210       220       230       240

250       260       270       280       290       300
orf3a.pep  FPVIGTTLLLENSLSPEQFDIAVAVGNNRIRRQIAEKAAALGFALPVLIHPDSTVSPSAT
           | |||||||||||||||||:|:|||||||||||||||||||||||||||:|||:|||||
orf3-1     FSVIGTTLLLENSLSPEQYDVAVAVGNNRIRRQIAEKAAALGFALPVLVHPDATVSPSAT
                250       260       270       280       290       300

310       320       330       340       350       360
orf3a.pep  VGQGGVVMAKAVVQADSVLKDGVIVNTAATVDHDCLLDAFVHISPGAHLSGNTRIGEESW
           ||||:|||||||||||:|||||||||||||||||||:||||||||||||||||:||||||
orf3-1     VGQGSVVMAKAVVQAGSVLKDGVIVNTAATVDHDCLLNAFVHISPGAHLSGNTHIGEESW
                310       320       330       340       350       360

370       380       390       400       410
orf3a.pep  IGTGACSRQQIRIGSRATIGAGAVVVRDVSDGMTVAGNPAKPLAGKNTETLRSX
           |||||||||||||||||||||||||||||||||||||||||| || ||
orf3-1     IGTGACSRQQIRIGSRATIGAGAVVVRDVSDGMTVAGNPAKPLPRKNPETSTAX
                370       380       390       400       410
```

Homology with Hypothetical Protein Encoded by yvfc Gene (accession Z71928) (SEQ ID NO: 1108) of *B. subtilis*

ORF3 (SEQ ID NO: 12) and YVFC proteins (SEQ ID NO: 1108) show 55% aa identity in 170 aa overlap (BLASTp):

```
ORF3      3  IYLIRKNLGSPVFFFQERPGKDGKPFMVKFRSMRDGLYSDGIPLPDGERLTPFGKKLRA    62
             I ++R +GSPVFF Q RPG  GKPF + KFR+M D    S G  LPD  RLT  G+ +R
yvfc     27  IAVVRLKIGSPVFFKQVRPGLHGKPFTLYKFRTMTDERDSKGNLLPDEVRLTKTGRLIRK   86

ORF3     63  ASXDELPELWNILKGEMSLVGPRPLLMQYLPLYDNFQNRRHEMKPGITGWAQVNGRNALS  122
               S DELP+L N+LKG++SLVGPRPLLM YLPLY    Q RRHE+KPGITGWAQ+NGRNA+S
yvfc     87  LSIDELPQLLNVLKGDLSLVGPRPLLMDYLPLYTEKQARRHEVKPGITGWAQINGRNAIS  146

ORF3    123  WDEKFACDVWYIDHFSLCLDXXXXXXXXXXXXXXXEGISAQGEXTMPPFTG           172
             W++KF  DVWY+D++S  LD               EGI   T   FTG
yvfc    147  WEKKFELDVWYVDNWSFFLDLKILCLTVRKVLVSEGIQQTNHVTAERFTG           196
```

Homology with a Predicted ORF from *N. gonorrhoeae*

ORF3 (SEQ ID NO: 12) shows 86.3% identity over a 286aa overlap with a predicted ORF (ORF3.ng) (SEQ ID NO: 18) from *N. gonorrhoeae*:

```
orf3                              ILIYLIRKNLGSPVFFFQERPGKDGKPFMVKFR   34
                                  :||||||||| ||||||::||||||||||||||
orf3ng  MSKAVKRLFDIIASASGLIVLSPVFLVLIYLIRKNKGSPVFFIRERPGKDGKPFKMVKFR   60 orf3    SMRDGLYSDGIPLPDGERLTPFGKKLRAASXDELPELWNILKGEMSLVGPRPLLMQYLPL   94
        ||||:| ||||||||| |||| |||||||:| |||||||||:||||||||||||||||||
orf3ng  SMRDALDSDGIPLPDSERLTDFGKKLRATSLDELPELWNVLKGEMSLVGPRPLLMQYLPL  120 orf3    YDNFQNRRHEMKPGITGWAQVNGRNALSWDEKFACDVWYIDHFSLCLDIKILLLTVKKVL  154
        |::|||||||||||||||||||||||||||||:|||| |:|:  ||:|||:||||||||
orf3ng  YNKFQNRRHEMKPGITGWAQVNGRNALSWDEKFSCDVWYTDNFSFWLDMKILFLTVKKVL  180 orf3    IKEGISAQGEXTMPPFTGKRKLAVVGAGGHGKVVADLAAALGRYREIVFLDDRAQGSVNG  214
        ||||||||||  ||||:|:|||||:|||||||||:|||||||:||||||||||:||||||
orf3ng  IKEGISAQGEATMPPFAGNRKLAVIGAGGHGKVVAELAAALGTYGEIVFLDDRTQGSVNG  240 orf3    FSVIGTTLLLENSLSPEQYDVAVAVGNNRIRRQIAEKAAALGFALPVLVHPDATVSPSAT  274
        | ||||||||||||||||:|::||||||||||||:|:|||||| ||||:|||||||||||
orf3ng  FPVIGTTLLLENSLSPEQFDITVAVGNNRIRRQITENAAALGFKLPVLIHPDATVSPSAI  300 orf3    VGQGSVVMAKAV                                                 286
        :|||||||||||
orf3ng  IGQGSVVMAKAVVQAGSVLKDGVIVNTAATVDHDCLLDAFVHISPGAHLSGNTRIGEESR  360
```

The complete length ORF3ng nucleotide sequence (SEQ ID NO: 17) is:

```
  1  ATGAGTAAAG CCGTCAAACG CCTGTTCGAC ATCATCGCAT CCGCATCGGG
 51  GCTGATTGTC CTGTCGCCCG TGTTTTTGGT TTTAATATAC CTCATCCGCA
101  AAAACTTAGG TTCGCCCGTC TTCTTCattC GGGAACGCCc cgGAAAGCAc
151  ggaaaacCTT TTAAAATGGT CAAATTCCGT TCCAtgcgcg acgcgcttGA
201  TTCAGACGGC ATTCCGCTGC CCGATAGCGA ACGCCTGACC GATTTCGGCA
251  AAAAATTACG CGCCACCAGT TTGGACGAAC TTCCTGAATT ATGGAATGTC
301  CTCAAAGGCG AGATGAGCCT GGTCGGCCCC CGCCCGCTTT TGATGCAGTA
351  TCTGCCGCTT TACAACAAAT TTCAAAACCG CCGCCACGAA ATGAAACCGG
401  GCATTACCGG CTGGGCGCAG GTCAACGGGC GCAACGCGCT TTCGTGGGAC
451  GAAAAGTTCT CCTGCGATGT TTGGTACACC GACAATTTCA GCTTTTGGCT
501  GGATATGAAA ATCCTGTTTC TGACAGTCAA AAAGTCTTG ATTAAAGAAG
```

```
 551   GCATTTCGGC GCAAGGGGAA GCCACCATGC CCCCTTTCGC GGGGAATCGC

601   AAACTCGCCG TTATCGGCGC GGGCGGACAC GGCAAAGTCG TTGCCGAGCT

651   TGCCGCCGCA CTCGGCACAT ACGGCGAAAT CGTTTTTCTG GACGACCGCA

701   CCCAAGGCAG CGTCAACGGC TTCCCCGTCA TCGGCACGAC GCTGCTGCTT

751   GAAAACAGTT TATCGCCCGA ACAATTCGAC ATCACCGTCG CCGTCGGCAA

801   CAACCGCATC CGCCGCCAAA TCACCGAAAA CGCCGCCGCG CTCGGCTTCA

851   AACTGCCCGT TCTGATTCAT CCCGACGCGA CCGTCTCGCC TTCTGCAATA

901   ATCGGACAAG GCAGCGTCGT AATGGCGAAA GCCGTCGTAC AGGCCGGCAG

951   CGTATTGAAA GACGGCGTGA TTGTGAACAC TGCCGCCACC GTCGATCACG

1001   ACTGCCTGCT TGACGCTTTC GtccaCATCA GCCCGGGCGC GCACCTGTCG

1051   GGCAACACGC GTATCGGCGA AGAAAGCCGG ATAGGCACGG GCGCGTGCAG

1101   CCGCCAGCAG ACAACCGTCG GCAGCGGGGT TACCgccgGT GCAGGGgcGG

1151   TTATCGTATG CGACATCCCG GACGGCATGA CCGTCGCGGG CAACCCGGCA

1201   AAGCCCCTTA CGGGCAAAAA CCCCAAGACC GGGACGGCAT AA
```

This encodes a protein having amino acid sequence (SEQ ID NO: 18):

```
  1   MSKAVKRLFD IIASASGLIV LSPVFLVLIY LIRKNLGSPV FFIRERPGKD

51   GKPFKMVKFR SMRDALDSDG IPLPDSERLT DFGKKLRATS LDELPELWNV

101   LKGEMSLVGP RPLLMQYLPL YNKFQNRRHE MKPGITGWAQ VNGRNALSWD

151   EKFSCDVWYT DNFSFWLDMK ILFLTVKKVL IKEGISAQGE ATMPPFAGNR

201   KLAVIGAGGH GKVVAELAAA LGTYGEIVFL DDRTQGSVNG FPVIGTTLLL

251   ENSLSPEQFD ITVAVGNNRI RRQITENAAA LGFKLPVLIH PDATVSPSAI

301   IGQGSVVMAK AVVQAGSVLK DGVIVNTAAT VDHDCLLDAF VHISPGAHLS

351   GNTRIGEESR IGTGACSRQQ TTVGSGVTAG AGAVIVCDIP DGMTVAGNPA

401   KPLTGKNPKT GTA*
```

This protein shows 86.9% identity in 413 aa overlap with ORF3-1 (SEQ ID NO: 14):

```
                    10         20         30         40         50         60
orf3-1.pep  MSKFFKRLFDIVASASGLIFLSPVFLILIYLIRKNLGSPVFFFQERPGKDGKPFKMVKFR
            |||  ||||| :||||||| ||||||:|||||||||||||||  ::||||||||||||||
orf3ng      MSKAVKRLFDIIASASGLIVLSPVFLVLIYLIRKNLGSPVFFIRERPGKDGKPFKMVKFR
                    10         20         30         40         50         60

70         80         90        100        110        120
orf3-1.pep  SMRDALDSDGIPLPDGERLTPFGKKLRAASLDELPELWNILKGEMSLVGPRPLLMQYLPL
            ||||||||||||||:||||| :||||||| :|||||||||:|||||||||||||||||||
orf3ng      SMRDALDSDGIPLPDSERLTDFGKKLRATSLDELPELWNVLKGEMSLVGPRPLLMQYLPL
                    70         80         90        100        110        120

130        140        150        160        170        180
orf3-1.pep  YDNFQNRRHEMKPGITGWAQVNGRNALSWDEKFACDVWYIDHFSLCLDIKILLLTVKKVL
            |::|||||||||||||||||||||||||||||| :|||| |:|| :||:|||:||||||
orf3ng      YNKFQNRRHEMKPGITGWAQVNGRNALSWDEKFSCDVWYTDNFSFWLDMKILFLTVKKVL
                   130        140        150        160        170        180
```

-continued

```
            190        200        210        220        230        240
orf3-1.pep  IKEGISAQGEATMPPFTGKRKLAVVGAGGHGKVVADLAAALGRYREIVFLDDRAQGSVNG
            ||||||||||||||:|:|||||:||||||||||:||||| | ||||||||:||||||
orf3ng      IKEGISAQGEATMPPFAGNRKLAVIGAGGHGKVVAELAAALGTYGEIVFLDDRTQGSVNG
            190        200        210        220        230        240

250        260        270        280        290        300
orf3-1.pep  FSVIGTTLLLENSLSPEQYDVAVAVGNNRIRRQIAEKAAALGFALPVLVHPDATVSPSAT
            | ||||||||||||||||:|::|||||||||||:|:||||| |||:||||||||||:|
orf3ng      FPVIGTTLLLENSLSPEQFDITVAVGNNRIRRQITENAAALGFKLPVLIHPDATVSPSAI
            250        260        270        280        290        300

310        320        330        340        350        360
orf3-1.pep  VGQGSVVMAKAVVQAGSVLKDGVIVNTAATVDHDCLLNAFVHISPGAHLSGNTHIGEESW
            :||||||||||||||||||||||||||||||||||||:||||||||||||||:|||||
orf3ng      IGQGSVVMAKAVVQAGSVLKDGVIVNTAATVDHDCLLDAFVHISPGAHLSGNTRIGEESR
            310        320        330        340        350        360

370        380        390        400        410
orf3-1.pep  IGTGACSRQQIRIGSRATIGAGAVVVRDVSDGMTVAGNPAKPLPRKNPETSTAX
            ||||||||||  :|| :| ||||:| |: |||||||||||||   |||:|:|||
orf3ng      IGTGACSRQQTTVGSGVTAGAGAVIVCDIPDGMTVAGNPAKPLTGKNPKTGTAX
            370        380        390        400        410
```

In addition, ORF3ng (SEQ ID NO: 18) shows significant homology with a hypothetical protein (SEQ ID NO: 1110) from *B.subtilis*:

```
gnl|PID|e238668 (Z71928) hypothetical protein [Bacillus subtilis]
)gi|1945702|gnl|PID|e313004 (Z94043) hypothetical protein [Bacillus subtilis]
)gi|2635938|gnl|PID|e1186113 (Z99121) similar to capsular polysaccharide
biosynthesis [Bacillus subtilis]Length = 202
Score = 235 bits (594), Expect = 3e-61
Identities = 114/195 (58%), Positives = 142/195 (72%)

Query:    5 VKRLFDIIASASGLIVLSPVFLVLIYLIRKNLGSPVFFIRERPGKDGKPFKMVKFRSMRD   64
            +KRLFD+ A+    L   S + L  I ++R  +GSPVFF + RPG  GKPF + KFR+M D
Sbjct:    3 LKRLFDLTAAIFLLCCTSVIILFTIAVVRLKIGSPVFFKQVRPGLHGKPFTLYKFRTMTD   62

Query:   65 ALDSDGIPLPDSERLTDFGKKLRATSLDELPELWNVLKGEMSLVGPRPLLMQYLPLYNKF  124
               DS G  LPD   RLT  G+ +R   S+DELP+L NVLKG++SLVGPRPLLM YLPLY +
Sbjct:   63 ERDSKGNLLPDEVRLTKTGRLIRKLSIDELPQLLNVLKGDLSLVGPRPLLMDYLPLYTEK  122

Query:  125 QNRRHEMKPGITGWAQVNGRNALSWDEKFSCDVWYTDNFSFWLDMKILFLTVKKVLIKEG  184
            Q RRHE+KPGITGWAQ+NGRNA+SW++KF  DVWY DN+SF+LD+KIL LTV+KVL+ EG
Sbjct:  123 QARRHEVKPGITGWAQINGRNAISWEKKFELDVWYVDNWSFFLDLKILCLTVRKVLVSEG  182

Query:  185 ISAQGEATMPPFAGN                                              199
            I     T   F G+
Sbjct:  163 IQQTNHVTAERFTGS                                              197
```

The hypothetical product of yvfc gene shows similarity to EXOY of *R.meliloti*, an exopolysaccharide production protein. Based on this and on the two predicted transmembrane regions in the homologous *N.gonorrhoeae* sequence, it is predicted that these proteins, or their epitopes, could be useful antigens for vaccines or diagnostics, or for raising antibodies.

Example 4

The following partial DNA sequence was identified in *N.meningitidis* (SEQ ID NO: 19):

```
  1  ..AACCATATGG CGATTGTCAT CGACGAATAC GGCGGCACAT CCGGCTTGGT

51    CACCTTTGAA GACATCATCG AGCAAATCGT CGGCGAAATC GAAGACGAGT

101    TTGACGAAGA CGATAGCGCC GACAATATCC ATGCCGTTTC TTCAGACACG

151    TGGCGCATCC ATGCAGCTAC CGAAATCGAA GACATCAACA CCTTCTTCGG

201    CACGGAATAC AGCATCGAAG AAGCCGACAC CATT.GGCGG CCTGGTCATT
```

```
                         -continued
251      CAAGAGTTGG GACATCTGCC CGTGCGCGGC GAAAAAGTCC TTATCGGCGG

301      TTTGCAGTTC ACCGTCGCAC GCGCCGACAA CCGCCGCCTG CATACGCTGA

351      TGGCGACCCG CGTGAAGTAA GC........ .....ACCGC CGTTTCTGCA

401      CAGTTTAG
```

This corresponds to amino acid sequence (SEQ ID NO: 20; ORF5):

```
  1    ..NHMAIVIDEY GGTSGLVTFE DIIEQIVGEI EDEFDEDDSA DNIHAVSSDT

51    WRIHAATEIE DINTFFGTEY SIEEADTIXR PGHSRVGTSA RARRKSPYRR

101    FAVHRRTRRQ PPPAYADGDP REVS....XR RFCTV*
```

Further sequence analysis revealed the complete DNA sequence to be (SEQ ID NO: 21):

```
  1    ATGGACGGCG CACAACCGAA AACGAATTTT TTTGAACGCC TGATTGCCCG

51    ACTCGCCCGC GAACCCGATT CCGCCGAAGA CGTATTAAAC CTGCTTCGGC

101    AGGCGCACGA GCAGGAAGTT TTTGATGCGG ATACGCTTTT AAGATTGGAA

151    AAAGTCCTCG ATTTTTCCGA TTTGGAAGTG CGCGACGCGA TGATTACGCG

201    CAGCCGTATG AACGTTTTAA AGAAAAACGA CAGCATCGAG CGCATCACCG

251    CCTACGTTAT CGATACCGCC CATTCGCGCT TCCCCGTCAT CGGCGAAGAC

301    AAAGACGAAG TTTTGGGCAT TTTGCACGCC AAAGACCTGC TCAAATATAT

351    GTTTAACCCC GAGCAGTTCC ACCTCAAATC CATTCTCCGC CCCGCCGTCT

401    TCGTCCCCGA AGGCAAATCG CTGACCGCCC TTTTAAAAGA GTTCCGCGAA

451    CAGCGCAACC ATATGGCGAT TGTCATCGAC GAATACGGCG GCACATCCGG

501    CTTGGTCACC TTTGAAGACA TCATCGAGCA AATCGTCGGC GAAATCGAAG

551    ACGAGTTTGA CGAAGACGAT AGCGCCGACA ATATCCATGC CGTTTCTTCC

601    GAACGCTGGC GCATCCATGC AGCTACCGAA ATCGAAGACA TCAACACCTT

651    CTTCGGCACG GAATACAGCA GCGAAGAAGC CGACACCATT CGGCCTGGTC

701    ATTCAAGAGT TGGGACATCT GCCCGTGCGC GGCGAAAAAG TCCTTATCGG

751    CGGTTTGCAG TTCACCGTCG CACGCGCCGA CAACCGCCGC CTGCATACGC

801    TGATGGCGAC CCGCGTGAAG TAAGCACCGC CGTTTCTGCA CAGTTTAGGA

851    TGACGGTACG GGCGTTTTCT GTTTCAATCC GCCCCATCCG CCAAACATAA
```

This corresponds to amino acid sequence (SEQ ID NO: 22; ORF5-1):

```
  1    MDGAQPKTNF FERLIARLAR EPDSAEDVLN LLRQAHEQEV FDADTLLRLE

51    KVLDFSDLEV RDAMITRSRM NVLKENDSIE RITAYVIDTA HSRFPVIGED

101    KDEVLGILHA KDLLKYMFNP EQFHLKSILR PAVFVPEGKS LTALLKEFRE

151    QRNHMAIVID EYGGTSGLVT FEDIIEQIVG EIEDEFDEDD SADNIHAVSS

201    ERWRIHAATE IEDINTFFGT EYSSEEADTI RPGHSRVGTS ARARRKSPYR

251    RFAVHRRTRR QPPPAYADGD PREVSTAVSA QFRMTVRAFS VSIRPIRQT*
```

Further work identified the corresponding gene in strain A of N.meningitidis (SEQ ID NO: 23)

```
  1 ATGGACGGCG CACAACCGAA AACAAATTTT TTNNAACGCC TGATTGCCCG

51 ACTCGCCCGC GAACCCGATT CCGCCGAAGA CGTATTGACC CTGTTGCGCC

101 AAGCGCACGA ACAGGAAGTA TTTGATGCGG ATACGCTTTT AAGATTGGAA

151 AAAGTCCTCG ATTTTTCTGA TTTGGAAGTG CGCGACGCGA TGATTACGCG

201 CAGCCGTATG AACGTTTTAA AGAAAACGA CAGCATCGAA CGCATCACCG

251 CCTACGTTAT CGATACCGCC CATTCGCGCT TCCCCGTCAT CGGTGAAGAC

301 AAAGACGAAG TTTTGGGTAT TTTGCACGCC AAAGACCTGC TCAAATATAT

351 GTTCAACCCC GAGCAGTTCC ACCTCAAATC GATATTGCGC CCTGCCGTCT

401 TCGTCCCCGA AGGCAAATCG CTGACCGCCC TTTTAAAAGA GTTCCGCGAA

451 CAGCGCAACC ATATGGCAAT CGTCATCGAC GAATACGGCG GCACGTCGGG

501 TTTGGTAACT TTTGAAGACA TCATCGAGCA AATCGTCGGC GACATCGAAG

551 ATGAGTTTGA CGAAGACGAA AGCGCGGACA ACATCCACGC CGTTTCCGCC

601 GAACGCTGGC GCATCCACGC GGCTACCGAA ATCGAAGACA TCAACGCCTT

651 TTTCGGCACG GAATACAGCA GCGAAGAAGC CGACACCATC GGCGGCCNTG

701 GTCATTCAGG AATTGGNACA CCTGCCCGTG CGCGGCGAAA AAGTCNTTAT

751 CGGCGNNTTG CANTTCACNG TCGCCNGCGC NGACAACCGC CGCCTGCATA

801 CGCTGATGGC GACCCGCGTG AAGTAAGCTC CGCCGTTTCT GTACAGTTTA

851 GGATGACGGT ACGGGCGTTT TCTGTTTCAA TCCGCCCCAT CCGCCANACA

901 TAA
```

This encodes a protein having amino acid sequence (SEQ ID NO: 24; ORF5a):

```
  1 MDGAQPKTNF XXRLIARLAR EPDSAEDVLT LLRQAHEQEV FDADTLLRLE

51 KVLDFSDLEV RDAMITRSRM NVLKENDSIE RITAYVIDTA HSRFPVIGED

101 KDEVLGILHA KDLLKYMFNP EQFHLKSILR PAVFVPEGKS LTALLKEFRE

151 QRNHMAIVID EYGGTSGLVT FEDIIEQIVG DIEDEFDEDE SADNIHAVSA

201 ERWRIHAATE IEDINAFFGT EYSSEEADTI GGXGHSGIGT PARARRKSXY

251 RRXAXHXRXR XQPPPAYADG DPREVSSAVS VQFRMTVRAF SVSIRPIRXT
                                                       50
```

The originally-identified partial strain B sequence (ORF5) (SEQ ID NO: 20) shows 54.7% identity over a 124aa overlap with ORF5a (SEQ ID NO: 24):

```
                                   10         20         30
orf5.pep                  NHMAIVIDEYGGTSGLVTFEDIIEQIVGEI
                          |||||||||||||||||||||||||||||:|
orf5a    FHLKSILRPAVFVPEGKSLTALLKEFREQRNHMAIVIDEYGGTSGLVTFEDIIEQIVGDI
              130       140       150       160       170       180

40         50         60         70         80         90
orf5.pep EDEFDEDDSADNIHAVSSDTWRIHAATEIEDINTFFGTEYSIEEADTIXRPGHSRVGTSA
         ||||||:|||||||||::  |||||||||||:|||||| ||||||   |||  :||  |
orf5a    EDEFDEDESADNIHAVSAERWRIHAATEIEDINAFFGTEYSSEEADTIGGXGHSGIGTPA
              190       200       210       220       230       240
```

```
                       100        110        120        130
orf5.pep   RARRKSPYRRFAVHRRTRRQPPPAYADGDPREVSXXXXXRRFCTV
           ||||||  |||  |  |  |:|  ||||||||||||||||
orf5a      RARRKSXYRRXAXHXRXRXQPPPAYADGDPREVSSAVSVQFRMTVRAFSVSIRPIRXTX
               250        260        270        280        290        300
```

The complete strain B sequence (ORF5-1) (SEQ ID NO: 22) and ORF5a (SEQ ID NO: 24) show 92.7% identity in 300 aa overlap:

```
                       10         20         30         40         50         60
orf5a.pep  MDGAQPKTNFXXRLIARLAREPDSAEDVLTLLRQAHEQEVFDADTLLRLEKVLDFSDLEV
           ||||||||||| |||||||||||||||||||:|||||||||||||||||||||||||||
orf5-1     MDGAQPKTNFFERLIARLAREPDSAEDVLNLLRQAHEQEVFDADTLLRLEKVLDFSDLEV
                       10         20         30         40         50         60

70         80         90        100        110        120
orf5a.pep  RDAMITRSRMNVLKENDSIERITAYVIDTAHSRFPVIGEDKDEVLGILHAKDLLKYMFNP
           ||||||||||||||||||||||||||||||||||||||||||||||||||||||||||||
orf5-1     RDAMITRSRMNVLKENDSIERITAYVIDTAHSRFPVIGEDKDEVLGILHAKDLLKYMFNP
                       70         80         90        100        110        120

130        140        150        160        170        180
orf5a.pep  EQFHLKSILRPAVFVPEGKSLTALLKEFREQRNHMAIVIDEYGGTSGLVTFEDIIEQIVG
           ||||||||||||||||||||||||||||||||||||||||||||||||||||||||||||
orf5-1     EQFHLKSILRPAVFVPEGKSLTALLKEFREQRNHMAIVIDEYGGTSGLVTFEDIIEQIVG
                      130        140        150        160        170        180

190        200        210        220        230        240
orf5a.pep  DIEDEFDEDESADNIHAVSAERWRIHAATEIEDINAFFGTEYSSEEADTIGGXGHSGIGT
           :|||||||||:|||||||||:|||||||||||||||:||||||||||||||   :||
orf5-1     EIEDEFDEDDSADNIHAVSSERWRIHAATEIEDINTFFGTEYSSEEADTIRP-GHSRVGT
                      190        200        210        220        230

250        260        270        280        290        300
orf5a.pep  PARARRKSXYRRXAXHXRXRXQPPPAYADGDPREVSSAVSVQFRMTVRAFSVSIRPIRXT
           ||||||| |||  |  |  |:| ||||||||||||||:|||:|||||||||||||||| |
orf5-1     SARARRKSPYRRFAVHRRTRRQPPPAYADGDPREVSTAVSAQFRMTVRAFSVSIRPIRQT
                   240        250        260        270        280        290
```

Further work identified the a partial DNA sequence in N.gonorrhoeae (SEQ ID NO: 25) which encodes a protein having amino acid sequence (SEQ ID NO: 26; ORF5ng):

```
  1  MDGAQPKTNF FERLIARLAR EPDSAEDVLN LLRQAHEQEV FDADTLTRLE

51  KVLDFAELEV RDAMITRSRM NVLKENDSIE RITAYVIDTA HSRFPVIGED

101  KDEVLGILHA KDLLKYMFNP EQFHLKSVLR PAVFVPEGKS LTALLKEFRE

151  QRNHMAIVID EYGGTSGLVT FEDIIEQIVG DIEDEFDEDE SADDIHSVSA

201  ERWRIHAATE IEDINAFFGT EYGSEEADTI RRLGHSGIGT PARARRKSPY

251  RRFAVHRRPR RQPPPAHADG DPREVSRACP HRRFCTV*
```

Further analysis revealed the complete gonococcal nucleotide sequence (SEQ ID NO: 27) to be:

```
  1  ATGGACGGCG CACAACCGAA AACAAATTTT TTTGAACGCC TGATTGCCCG

51  ACTCGCCCGC GAACCCGATT CCGCCGAAGA CGTATTAAAC CTGCTTCGGC

101  AGGCGCACGA ACAGGAAGTT TTTGATGCCG ACACACTGAC CCGGCTGGAA

151  AAAGTATTGG ACTTTGCCGA GCTGGAAGTG CGCGATGCGA TGATTACGCG
```

```
                         -continued
201 CAGCCGCATG AACGTATTGA AAGAAAACGA CAGCATCGAA CGCATCACCG

251 CCTACGTCAT CGATACCGCC CATTCGCGCT TCCCCGTCAT CGGCGAAGAC

301 AAAGACGAAG TTTTGGGCAT TTTGCACGCC AAAGACCTGC TCAAATATAT

351 GTTCAACCCC GAGCAGTTCC ACCTGAAATC CGTCTTGCGC CCTGCCGTTT

401 TCGTGCCCGA AGGCAAATCT TTGACCGCCC TTTTAAAAGA GTTCCGCGAA

451 CAGCGCAACC ATATGGCAAT CGTCATCGAC GAATACGGCG GCACGTCGGG

501 TTTGGTCACC TTTGAAGACA TCATCGAGCA AATCGTCGGT GACATCGAAG

551 ACGAGTTTGA CGAAGACGAA AGCGccgacg acatCCACTC cgTTTccgCC

601 GAACGCTGGC GCATCCacgc ggctaCCGAA ATCGAAGaca TCAACGCCTT

651 TTTCGGTACG GAatacggca gcgaagaagc cgacaccatc cggcggcTG

701 GTCATTCAGG AATTGGGACA CCTGCCCGTG CGCGGCGAAA AAGTCCTTAt 751 cggcgGTTTG Cagttcaccg tCGCCCGCGC CGACAACCGC CGCCTGCACA 801 CGCTGATGGC GACCCGCGTG AAGTAAGCAG AGCCTGCCcg AccgccgttT 851 CTGCacAGTT TAGGatgACG gtaCGGTCGT TTTCTGTTTC AATCCGCCCC

901 ATCCGCCAAA CATAA
```

This encodes a protein having amino acid sequence (SEQ ID NO: 28; ORF5ng-1):

```
  1 MDGAQPKTNF FERLIARLAR EPDSAEDVLN LLRQAHEQEV FDADTLTRLE

51 KVLDFAELEV RDAMITRSRM NVLKENDSIE RITAYVIDTA HSRFPVIGED

101 KDEVLGILHA KDLLKYMFNP EQFHLKSVLR PAVFVPEGKS LTALLKEFRE

151 QRNHMAIVID EYGGTSGLVT FEDIIEQIVG DIEDEFDEDE SADDIHSVSA

201 ERWRIHAATE IEDINAFFGT EYGSEEADTI RRLGHSGIGT PARARRKSPY

251 RRFAVHRRPR RQPPPAHADG DPREVSRACP TAVSAQFRMT VRSFSVSIRP

301 IRQT*
```

The originally-identified partial strain B sequence (ORF5) (SEQ ID NO: 20) shows 83.1% identity over a 135aa overlap with the partial gonococcal sequence (ORF5ng) (SEQ ID NO: 26):

```
orf5                        NHMAIVIDEYGGTSGLVTFEDIIEQIVGEI  30
                            ||||||||||||||||||||||||||||:|
orf5ng FHLKSVLRPAVFVPEGKSLTALLKEFREQRNHMAIVIDEYGGTSGLVTFEDIIEQIVGDI 182 orf5   EDEFDEDDSADNIHAVSSDTWRIHAATEIEDINTFFGTEYSIEEADTIXRPGHSRVGTSA  90
       |||||||:|||:||:||::  ||||||||||||:||||||: |||||| | ||| :|| |
orf5ng EDEFDEDESADDIHSVSAERWRIHAATEIEDINAFFGTEYGSEEADTIRRLGHSGIGTPA 242 orf5   RARRKSPYRRFAVHRRTRRQPPPAYADGDPREVSX----RRFCTV               131
       ||||||||||||||||| ||||||:||||||||||     ||||||
orf5ng RARRKSPYRRFAVHRRPRRQPPPAHADGDPREVSRACPHRRFCTV                287
```

The complete strain B and gonococcal sequences (ORF5-1 & ORF5ng-1) (SEQ ID NO: 22 & SEQ ID NO: 28) show 92.4% identity in 304 aa overlap:

```
                       10        20        30        40        50        60
orf5ng-1.pep   MDGAQPKTNFFERLIARLAREPDSAEDVLNLLRQAHEQEVFDADTLTRLEKVLDFAELEV
               ||||||||||||||||||||||||||||||||||||||||||||||||||||||::|||
orf5-1         MDGAQPKTNFFERLIARLAREPDSAEDVLNLLRQAHEQEVFDADTLLRLEKVLDFSDLEV
                       10        20        30        40        50        60

70        80        90       100       110       120
orf5ng-1.pep   RDAMITRSRMNVLKENDSIERITAYVIDTAHSRFPVIGEDKDEVLGILHAKDLLKYMFNP
               ||||||||||||||||||||||||||||||||||||||||||||||||||||||||||||
orf5-1         RDAMITRSRMNVLKENDSIERITAYVIDTAHSRFPVIGEDKDEVLGILHAKDLLKYMFNP
                       70        80        90       100       110       120

130       140       150       160       170       180
orf5ng-1.pep   EQFHLKSVLRPAVFVPEGKSLTALLKEFREQRNHMAIVIDEYGGTSGLVTFEDIIEQIVG
               |||||||:||||||||||||||||||||||||||||||||||||||||||||||||||||
orf5-1         EQFHLKSILRPAVFVPEGKSLTALLKEFREQRNHMAIVIDEYGGTSGLVTFEDIIEQIVG
                      130       140       150       160       170       180

190       200       210       220       230       240
orf5ng-1.pep   DIEDEFDEDESADDIHSVSAERWRIHAATEIEDINAFFGTEYGSEEADTIRRLGHSGIGT
               :|||||||||:|||:||:|:|||||||||||||||:||||||:|||||||||   :|:||
orf5-1         EIEDEFDEDDSADNIHAVSSERWRIHAATEIEDINTFFGTEYSSEEADTIRP-GHSRVGT
                      190       200       210       220       230

250       260       270       280       290       300
orf5ng-1.pep   PARARRKSPYRRFAVHRRPRRQPPPAHADGDPREVSRACPTAVSAQFRMTVRSFSVSIRP
               |||||||||||||||| |||||||:||||||||||    |||||||||||||:|||||||
orf5-1         SARARRKSPYRRFAVHRRTRRQPPPAYADGDPREVS----TAVSAQFRMTVRAFSVSIRP
              240       250       260       270       280       290 orf5ng-1.pep   IRQTX
               |||||
orf5-1         IRQTX
              300
```

Computer analysis of these amino acid sequences indicates a putative leader sequence, and identified the following homologies:
Homology with Hemolysin Homolog TlyC (Accession U32716) (SEQ ID NO: 1111) of *H.influenzae*
ORF5 (SEQ ID NO: 20) and TlyC proteins (SEQ ID NO: 1111) show 58% aa identity in 77 aa overlap (BLASTp).

```
ORF5    2 HMAIVIDEYGGTSGLVTFEDIIEQIVGEIEDEFDEDDSADNIHAVSSDTWRIHAATEIED    61
          HMAIV+DE+G  SGLVT EDI+EQIVG+IEDEFDE++ AD I  +S  T+ + A T+I+D
TlyC  166 HMAIVVDEFGAVSGLVTIEDILEQIVGDIEDEFDEEEIAD-IRQLSRHTYAVRALTDIDD   224

ORF5   62 INTFFGTEYSIEEADTI                                              78
          N  F T++  EE DTI
TlyC  225 FNAQFNTDFDDEEVDTI                                             241
```

ORF5ng-1 (SEQ ID NO: 28) also shows significant homology with TlyC (SEQ ID NO: 1111):

```
SCORES    Init1: 301 Initn:  419 Opt:  668
Smith-Waterman score: 668;  45.9% identity in 242 aa overlap 10        20        30        40        50
orf5ng-1.pep           MDGAQPKTNFFERLIARLAR-EPDSAEDVLNLLRQAHEQEVFDADTLTRLEK
                       |  ||: |::|: :  |   : |:::::::|:::::::::|  :|     :|
tlyc_haein     MNDEQQNSNQSENTKKPFFQSLFGRFFQGELKNREELVEVIRDSEQNDLIDQNTREMIEG
                       10        20        30        40        50        60

60        70        80        90       100       109
orf5ng-1.pep   VLDFAELEVRDAMITRSRMNVLKENDSIERITAYVIDTAHSRFPVIGE--DKDEVLGILH
               |:::|||:|||  ||  ||::   ::::::::    :|::|||||||||::  |:|::||||
tlyc_haein     VMEIAELRVRDIMIPRSQIIFIEDQQDLNTCLNTIIESAHSRFPVIADADDRDNIVGILH
                        70        80        90       100       110       120
```

```
                      -continued
              110       120       130       140       150       160
orf5ng-1.pep  AKDLLKYMF-NPEQFHLKSVLRPAVFVPEGKSLTALLKEFREQRNHMAIVIDEYGGTSGL
              ||||||::   :  |  |  |:|:|||:|:|||:|  :    :||:||  :|  ||||||:||:|::|||
tlyc_haein    AKDLLKFLREDAEVFDLSSLLRPVVIVPESKRVDRMLKDFRSERFHMAIVVDEFGAVSGL
                        130       140       150       160       170       180

170       180       190       200       210       220
orf5ng-1.pep  VTFEDIIEQIVGDIEDEFDEDESADDIHSVSAERWRIHAATEIEDINAFFGTEYGSEEAD
              ||:|||:|||||||||||||||:|  ||  |:::|  :  :  ::|   |:|:|:||   |:|::  :||:|
tlyc_haein    VTIEDILEQIVGDIEDEFDEEEIAD-IRQLSRHTYAVRALTDIDDFNAQFNTDFDDEEVD
                        190       200       210       220       230

230       240       250       260       270       280
orf5ng-1.pep  TIRRLGHSGIG-TPARARRKSPYRRFAVHRRPRRQPPPAHADGDPREVSRACPTAVSAQF
              ||    |    :  :|      |  |:
tlyc_haein    TIGGLIMQTFGYLPKRGEEIILKNLQFKVTSADSRRLIQLRVTVPDEHLAEMNNVDEKSE
              240       250       260       270       280       290
```

Homology with a Hypothetical Secreted Protein from *E.coli*:

ORF5a (SEQ ID NO: 24) shows homology to a hypothetical secreted protein (SEQ ID NO: 1112) from *E.coli*:

```
sp|P77392|YBEX_ECOLI HYPOTHETICAL 33.3 KD PROTEIN IN CUTE-ASNB INTERGENIC REGION
)gi|1778577 (U82598) similar to H. influenzae [Escherichia coli])gi|1786879
(AE000170) f292; This 292 aa ORF is 23% identical (9 gaps) to 272 residues of an
approx. 440 aa protein YTFL_HAEIN SW: P44717 [Escherichia coli] Length = 292
Score = 212 bits (533), Expect = 3e-54
Identities = 112/230 (48%), Positives = 149/230 (64%), Gaps = 3/230 (1%)

Query:     2 DGAQPKTNFXXRLIARLAR-EPDSAEDVLTLLRQAHEQEVFDADTLLRLEKVLDFSDLEV    60
             D   K  F   L+++L    EP + +++L L+R + + ++  D  DT     LE V+D +D    V
Sbjct:    10 DTISNKKGFFSLLLSQLFHGEPKNRDELLALIRDSGQNDLIDEDTRDMLEGVMDIADQRV    69

Query:    61 RDAMITRSRMNVLKENDSIERITAYVIDTAHSRFPVIGEDKDEVLGILHAKDLLKYM-FN   119
             RD MI RS+M  LK N +++      +I++AHSRFPVI EDKD + GIL AKDLL +   M +
Sbjct:    70 RDIMIPRSQMITLKRNQTLDECLDVIIESAHSRFPVISEDKDHIEGILMAKDLLPFMRSD   129

Query:   120 PEQFHLKSILRPAVFVPEGKSLTALLKEFREQRNHMAIVIDEYGGTSGLVTFEDIIEQIV   179
              E F +  +LR AV VPE K +  +LKEFR QR HMAIVIDE+GG SGLVT EDI+E  IV
Sbjct:   130 AEAFSMDKVLRQAVVVPESKRVDRMLKEFRSQRYHMAIVIDEFGGVSGLVTIEDILELIV   189

Query:   180 GDIEDEFDEDESADNIHAVSAERWRIHAATEIEDINAFFGTEYSSEEADT             229
             G+IEDE+DE++  D     +S    W + A    IED N  FGT +S EE DT
Sbjct:   190 GEIEDEYDEEDDID-FRQLSRHTWTVRALASIEDFNEAFGTHFSDEEVDT             238
```

Based on this analysis, including the amino acid homology to the TlyC hemolysin-homologue from *H. influenzae* (hemolysins are secreted proteins), it was predicted that the proteins from *N.meningitidis* and *N.gonorrhoeae* are secreted and could thus be useful antigens for vaccines or diagnostics.

ORF5-1 (SEQ ID NO: 22) (30.7 kDa) was cloned in the pGex vector and expressed in *E.coli*, as described above. The products of protein expression and purification were analyzed by SDS-PAGE. FIG. 2A shows the results of affinity purification of the GST-fusion protein. Purified GST-fusion protein was used to immunise mice, whose sera were used for Western blot analysis (FIG. 1B). These experiments confirm that ORF5-1 (SEQ ID NO: 22) is a surface-exposed protein, and that is a useful immunogen.

Example 5

The following partial DNA sequence was identified in *N.meningitidis* (SEQ ID NO: 29):

```
  1 ATGCGCGGCG GCAGGCCGGA TTCCGTTACC GTGCAGATTA TCGAAGGTTC

51 GCGTTTTTCG CATATGAGGA AAGTCATCGA CGCAACGCCC GACATCGGAC

101 ACGACACCAA AGGCTGGAGC AATGAAAAAC TGATGGCGGA AGTTGCGCCC

151 GATGCCTTCA GCGGCAATCC TGAAgGGCAG TTTTTCCCCG ACAGCTACGA

201 AATCGATGCG GGCGGCAGTG ATTTGCAGAT TTACCAAACC GCCTACAAgG

251 GCGATGCAAC GCCGCCTGAA TGAgGGCATG GGAAAGCAGG CAGGACGGGC

301 TGCCTTATAA AAACCCTTAT GAAATGCTGA TTATGGCGAr CCTGGTCGAA
```

```
351 AAGGAAACAG GGCATGAAGC CGAsCsCGAC CATGTcGCTT CCGTCTTCGT

401 CAACCGCCTG AAAATCGGTA TGCGCCTGCA AACCgAssCG TCCGTGATTT

451 ACGGCATGGG TGCGGCATAC AAGGGCAAAA TCCGTAAAGC CGACCTGCGC

501 CGCGACACGC CGTACAACAC CTACACGCGC GGCGGTCTGC CGCCAACCCC

551 GATTGCGCTG CCC..
```

This corresponds to the amino acid sequence (SEQ ID NO: 30; ORF7):

```
  1 MRGGRPDSVT VQIIEGSRFS HMRKVIDATP DIGHDTKGWS NEKLMAEVAP

51 DAFSGNPEGQ FFPDSYEIDA GGSDLQIYQT AYKAMQRRLN EAWESRQDGL

101 PYKNPYEMLI MAXLVEKETG HEAXXDHVAS VFVNRLKIGM RLQTXXSVIY

151 GMGAAYKGKI RKADLRRDTP YNTYTRGGLP PTPIALP..
```

Further sequence analysis revealed the complete DNA sequence (SEQ ID NO: 31):

```
  1 ATGTTGAGAA AATTGTTGAA ATGGTCTGCC GTTTTTTTGA CCGTGTCGGC

51 AGCCGTTTTC GCCGCGCTGC TTTTTGTTCC TAAGGATAAC GGCAGGGCAT

101 ACCGAATCAA AATTGCCAAA AACCAGGGTA TTTCGTCGGT CGGCAGGAAA

151 CTTGCCGAAG ACCGCATCGT GTTCAGCAGG CATGTTTTGA CGGCGGCGGC

201 CTACGTTTTG GGTGTGCACA ACAGGCTGCA TACGGGACGG TACAGATTGC

251 CTTCGGAAGT GTCTGCTTGG GATATCTTGC AGAAAATGCG CGGCGGCAGG

301 CCGGATTCCG TTACCGTGCA GATTATCGAA GGTTCGCGTT TTTCGCATAT

351 GAGGAAAGTC ATCGACGCAA CGCCCGACAT CGGACACGAC ACCAAAGGCT

401 GGAGCAATGA AAAACTGATG GCGGGAGTTG CGCCCGATGC CTTCAGCGGC

451 AATCCTGAAG GCAGTTTTTT CCCCGACAGC TACGAAATCG ATGCGGGCGG

501 CAGTGATTTG CAGATTTACC AAACCGCCTA CAAGGCGATG CAACGCCGCC

551 TGAATGAGGC ATGGGAAAGC AGGCAGGACG GGCTGCCTTA TAAAAACCCT

601 TATGAAATGC TGATTATGGC GAGCCTGGTC GAAAAGGAAA CAGGGCATGA

651 AGCCGACCGC GACCATGTCG CTTCCGTCTT CGTCAACCGC CTGAAAATCG

701 GTATGCGCCT GCAAACCGAC CCGTCCGTGA TTTACGGCAT GGGTGCGGCA

751 TACAAGGGCA AAATCCGTAA AGCCGACCTG CGCCGCGACA CGCCGTACAA

801 CACCTACACG CGCGGCGGTC TGCCGCCAAC CCCGATTGCG CTGCCCGGCA

851 AGGCGGCACT CGATGCCGCC GCCCATCCGT CCGGCGAAAA ATACCTGTAT

901 TTCGTGTCCA AAATGGACGG CACGGGCTTG AGCCAGTTCA GCCATGATTT

951 GACCGAACAC AATGCCGCCG TCCGCAAATA TATTTTGAAA AAATAA
```

This corresponds to the amino acid sequence (SEQ ID NO: 32; ORF7-1):

```
  1  MLRKLLKWSA VFLTVSAAVF AALLFVPKDN GRAYRIKIAK NQGISSVGRK

51  LAEDRIVFSR HVLTAAAYVL GVHNRLHTGT YRLPSEVSAW DILQKMRGGR

101  PDSVTVQIIE GSRFSHMRKV IDATPDIGHD TKGWSNEKLM AEVAPDAFSG

151  NPEGQFFPDS YEIDAGGSDL QIYQTAYKAM QRRLNEAWES RQDGLPYKNP

201  YEMLIMASLV EKETGHEADR DHVASVFVNR LKIGMRLQTD PSVIYGMGAA

251  YKGKIRKADL RRDTPYNTYT RGGLPPTPIA LPGKAALDAA AHPSGEKYLY

301  FVSKMDGTGL SQFSHDLTEH NAAVRKYILK K*
```

Computer analysis of this amino acid sequence gave the following results:
Homology with Hypothetical Protein Encoded by yceg Gene (Accession P44270) (SEQ ID NO: 1113) of H.influenzae
ORF7 (SEQ ID NO: 30) and yceg proteins (SEQ ID NO: 1113) show 44% aa identity in 192 aa overlap:

```
ORF7    1 MRGGRPDSVTVQIIEGSRFSHMRKVIDATPDIGHDTKGWSNEKLMA-----EVAPDAFSG    55
          + G+      V+ IEG  F  RK ++ P +    K  SNE++ A      ++   +
yceg  102 LNSGKEVQFNVKWIEGKTFKDWRKDLENAPHLVQTLKDKSNEEIFALLDLPDIGQNLELK  161

ORF7   56 NPEGQFFPDSYEIDAGGSDLQIYQTAYKAMQRRLNEAWESRQDGLPYKNPYEMLIMAXLV   115
          N EG  +PD+Y      +DL++ + + + M++ LN+AW  R + LP   NPYEMLI+A +V
yceg  162 NVEGWLYPDTYNYTPKSTDLELLKRSAERMKKALNKAWNERDEDLPLANPYEMLILASIV   221

ORF7  116 EKETGHEAXXDHVASVFVNRLKIGMRLQTXXSVIYGMGAAYKGKIRKADLRRDTPYNTYT   175
          EKETG       VASVF+NRLK  M+LQT  +VIYGMG  Y G IRK DL   TPYNTY
yceg  222 EKETGIANERAKVASVFINRLKAKMKLQTDPTVIYGMGENYNGNIRKKDLETKTPYNTYV   281

ORF7  176 RGGLPPTPIALP                                                  187
             GLPPTPIA+P
yceg  282 IDGLPPTPIAMP                                                  293
```

The complete length YCEG protein has sequence:

```
  1  MKKFLIAILL LILILAGVAS FSYYKMTEFV KTPVNVQADE LLTIERGTTS

51  SKLATLFEQE KLIADGKLLP YLLKLKPELN KIKAGTYSLE NVKTVQDLLD

101  LLNSGKEVQF NVKWIEGKTF KDWRKDLENA PHLVQTLKDK SNEEIFALLD

151  LPDIGQNLEL KNVEGWLYPD TYNYTPKSTD LELLKRSAER MKKALNKAWN

201  ERDEDLPLAN PYEMLILASI VEKETGIANE RAKVASVFIN RLKAKMKLQT

251  DPTVIYGMGE NYNGNIRKKD LETKTPYNTY VIDGLPPTPI AMPSESSLQA

301  VANPEKTDFY YFVADGSGGH KFTRNLNEHN KAVQEYLRWY RSQKNAK
```

Homology with a Predicted ORF from N.meningitidis (strain A)
ORF7 (SEQ ID NO: 30) shows 95.2% identity over a 187aa overlap with an ORF (ORF7a) (SEQ ID NO: 34) from strain A of N. meningitidis:

```
                                10         20         30
orf7.pep             MRGGRPDSVTVQIIEGSRFSHMRKVIDATP
                     |||||||||||||||||||||||||||||
orf7a    AAYVLGVHNRLHTGTYRLPSEVSAWDILQKMRGGRPDSVTVQIIEGSRFSHMRKVIDATP
             70         80         90        100        110        120
```

```
                 40          50          60          70          80          90
orf7.pep DIGHDTKGWSNEKLMAEVAPDAFSGNPEGQFFPDSYEIDAGGSDLQIYQTAYKAMQRRLN
         || |||||||||||||||||||| |||||||||||||||||||||||||:||| ||||||||||
orf7a    DIEHDTKGWSNEKLMAEVAVYPDAFSGNPEGQFFPDSYEIDAGGSDLRIYQIAYKAMQRRLN
                130         140         150         160         170         180

100         110         120         130         140         150
orf7.pep EAWESRQDGLPYKNPYEMLIMAXLVEKETGHEAXXDHVASVFVNRLKIGMRLQTXXSVIY
         ||||||||||||||||||||||||:||||||||| ||||||||||||||||||||   ||||
orf7a    EAWESRQDGLPYKNPYEMLIMASLIEKETGHEADRDHVASVFVNRLKIGMRLQTDPSVIY
                190         200         210         220         230         240

160         170         180
orf7.pep GMGAAYKGKIRKADLRRDTPYNTYTRGGLPPTPIALP
         ||||||||||||||||||||||||||||||||||||
orf7a    GMGAAYKGKIRKADLRRDTPYNTYTRGGLPPTPIALPGKAALDAAAHPSGEKYLYFVSKM
                250         260         270         280         290         300 orf7a    DGTGLSQFSHDLTEHNAAVRKYILKKX
                310         320         330
```

The complete length ORF7a nucleotide sequence (SEQ ID NO: 33) is:

```
  1  ATGTTGAGAA AATTGTTGAA ATGGTCTGCC GTTTTTTTGA CCGTATCGGC
 51  AGCCGTTTTC GCCGCGCTGC TTTTCGTCCC TAAAGACAAC GGCAGGGCAT
101  ACAGGATTAA AATTGCCAAA AACCAGGGTA TTTCGTCGGT CGGCAGGAAA
151  CTTGCCGAAG ACCGCATCGT GTTCAGCAGG CATGTTTTGA CGGCGGCGGC
201  CTACGTTTTG GGTGTGCACA ACAGGCTGCA TACGGGGACG TACAGACTGC
251  CTTCGGAAGT GTCTGCTTGG GATATCTTGC AGAAAATGCG CGGCGGCAGG
301  CCGGATTCCG TTACCGTGCA GATTATCGAA GGTTCGCGTT TTTCGCATAT
351  GAGGAAAGTC ATCGACGCAA CGCCCGACAT CGAACACGAC ACCAAAGGCT
401  GGAGCAATGA AAAACTGATG GCGGAAGTTG CCCCTGATGC CTTCAGCGGC
451  AATCCTGAAG GCAGTTTTTT CCCCGACAGC TACGAAATCG ATGCGGGCGG
501  CAGCGATTTA CGGATTTACC AAATCGCCTA CAAGGCGATG CAACGCCGAC
551  TGAATGAGGC ATGGGAAAGC AGGCAGGACG GGCTGCCTTA TAAAAACCCT
601  TATGAAATGC TGATTATGGC GAGCCTGATC GAAAAGGAAA CAGGGCATGA
651  AGCCGACCGC GACCATGTCG CTTCCGTCTT CGTCAACCGC CTGAAAATCG
701  GTATGCGCCT GCAAACCGAC CCGTCCGTGA TTTACGGCAT GGGTGCGGCA
751  TACAAGGGCA AAATCCGTAA AGCCGACCTG CGCCGCGACA CGCCGTACAA
801  CACCTACACG CGCGGCGGTC TGCCGCCAAC CCCGATCGCG CTGCCCGGCA
851  AGGCGGCACT CGATGCCGCC GCCCATCCGT CCGGTGAAAA ATACCTGTAT
901  TTCGTGTCCA AAATGGACGG TACGGGCTTG AGCCAGTTCA GCCATGATTT
951  GACCGAACAC AACGCCGCCG TTCGCAAATA TATTTTGAAA AAATAA
```

This is predicted to encode a protein having amino acid sequence (SEQ ID NO: 34):

```
  1  MLRKLLKWSA VFLTVSAAVF AALLFVPKDN GRAYRIKIAK NQGISSVGRK
 51  LAEDRIVFSR HVLTAAAYVL GVHNRLHTGT YRLPSEVSAW DILQKMRGGR
101  PDSVTVQIIE GSRFSHMRKV IDATPDIEHD TKGWSNEKLM AEVAPDAFSG
```

```
                                   -continued
151   NPEGQFFPDS YEIDAGGSDL RIYQIAYKAM QRRLNEAWES RQDGLPYKNP

201   YEMLIMASLI EKETGHEADR DHVASVFVNR LKIGMRLQTD PSVIYGMGAA

251   YKGKIRKADL RRDTPYNTYT RGGLPPTPIA LPGKAALDAA AHPSGEKYLY

301   FVSKMDGTGL SQFSHDLTEH NAAVRKYILK K*
```

A leader peptide is underlined.

ORF7a (SEQ ID NO: 34) and ORF7-1 (SEQ ID NO: 32) show 98.8% identity in 331 aa overlap:

```
                     10         20         30         40         50         60
orf7a.pep  MLRKLLKWSAVFLTVSAAVFAALLFVPKDNGRAYRIKIAKNQGISSVGRKLAEDRIVFSR
           ||||||||||||||||||||||||||||||||||||||||||||||||||||||||||||
orf7-1     MLRKLLKWSAVFLTVSAAVFAALLFVPKDNGRAYRIKIAKNQGISSVGRKLAEDRIVFSR
                     10         20         30         40         50         60

70         80         90        100        110        120
orf7a.pep  HVLTAAAYVLGVHNRLHTGTYRLPSEVSAWDILQKMRGGRPDSVTVQIIEGSRFSHMRKV
           ||||||||||||||||||||||||||||||||||||||||||||||||||||||||||||
orf7-1     HVLTAAAYVLGVHNRLHTGTYRLPSEVSAWDILQKMRGGRPDSVTVQIIEGSRFSHMRKV
                     70         80         90        100        110        120

130        140        150        160        170        180
ofr7a.pep  IDATPDIEHDTKGWSNEKLMAEVAPDAFSGNPEGQFFPDSYEIDAGGSDLRIYQIAYKAM
           |||||||  |||||||||||||||||||||||||||||||||||||||:|||  |||||
ofr7-1     IDATPDIGHDTKGWSNEKLMAEVAPDAFSGNPEGQFFPDSYEIDAGGSDLQIYQTAYKAM
                    130        140        150        160        170        180

190        200        210        220        230        240
orf7a.pep  QRRLNEAWESRQDGLPYKNPYEMLIMASLIEKETGHEADRDHVASVFVNRLKIGMRLQTD
           |||||||||||||||||||||||||||||:||||||||||||||||||||||||||||||
orf7-1     QRRLNEAWESRQDGLPYKNPYEMLIMASLVEKETGHEADRDHVASVFVNRLKIGMRLQTD
                    190        200        210        220        230        240

250        260        270        280        290        300
orf7a.pep  PSVIYGMGAAYKGKIRKADLRRDTPYNTYTRGGLPPTPIALPGKAALDAAAHPSGEKYLY
           ||||||||||||||||||||||||||||||||||||||||||||||||||||||||||||
orf7-1     PSVIYGMGAAYKGKIRKADLRRDTPYNTYTRGGLPPTPIALPGKAALDAAAHPSGEKYLY
                    250        260        270        280        290        300

310        320        330
orf7a.pep  FVSKMDGTGLSQFSHDLTEHNAAVRKYILKKX
           |||||||||||||||||||||||||||||||
orf7-1     FVSKMDGTGLSQFSHDLTEHNAAVRKYILKKX
                    310        320        330
```

Homology with a Predicted ORF from *N. gonorrhoeae*

ORF7 (SEQ ID NO: 30) shows 94.7% identity over a 187aa overlap with a predicted ORF (ORF7.ng) (SEQ ID NO: 36) from *N. gonorrhoeae*:

```
orf7    MRGGRPDSVTVQIIEGSRFSHMRKVIDATPDIGHDTKGWSNEKLMAEVAPDAFSGNPEGQ   60
        ||||||||||||||||||||||||||||||||||||||||||||||||||||||||||||
orf7ng  MRGGRPDSVTVQIIEGSRFSHMRKVIDATPDIGHDTKGWSNEKLMAEVAPDAFSGNPEGQ   60 orf7    FFPDSYEIDAGGSDLQIYQTAYKAMQRRLNEAWESRQDGLPYKNPYEMLIMAXLVEKETG  120
        |||||||||||||||||||||||||||||||||||||:||||||||||||||||| :|||||
orf7ng  FFPDSYEIDAGGSDLQIYQTAYKAMQRRLNEAWAGRQDGLPYKNPYEMLIMASLIEKETG  120 orf7    HEAXXDHVASVFVNRLKIGMRLQTXXSVIYGMGAAYKGKIRKADLRRDTPYNTYTRGGLP  180
        |||  |||||||||||||||||||  ||||||||||||||||||||||||||||| ||||
orf7ng  HEADRDHVASVFVNRLKIGMRLQTDPSVIYGMGAAYKGKIRKADLRRDTPYNTYTGGGLP  180 orf7    PTPIALP                                                      187
        || ||||
orf7ng  PTRIALPGKAAMDAAAHPSGEKYLYFVSKMDGTGLSQFSHDLTEHNAAVRKYILKK      236
```

An ORF7ng nucleotide sequence (SEQ ID NO: 35) is predicted to encode a protein having amino acid sequence (SEQ ID NO: 36):

```
  1  MRGGRPDSVT VQIIEGSRFS HMRKVIDATP DIGHDTKGWS NEKLMAEVAP

51  DAFSGNPEGQ FFPDSYEIDA GGSDLQIYQT AYKAMQRRLN EAWAGRQDGL

101  PYKNPYEMLI MASLIEKETG HEADRDHVAS VFVNRLKIGM RLQTDPSVIY

151  GMGAAYKGKI RKADLRRDTP YNTYTGGGLP PTRIALPGKA AMDAAAHPSG

201  EKYLYFVSKM DGTGLSQFSH DLTEHNAAVR KYILKK*
```

Further sequence analysis revealed a partial DNA sequence of ORF7ng (SEQ ID NO: 37):

```
  1  ..taccgaatca AGATTGCCAA AAATCAGGGT ATTTCGTCGG TCGGCAGGAA

51  ACTTGCcgaA GACCGCATCG TGTTCAGCAG GCATGTTTTG ACAGCGGCGG

101  CCTACGTTTT GGGTGTGCAC AACAGGCTGC ATACGGGAC gTACAGATTG

151  CCTTCGGAAG TGTCTGCTTG GGATATCTTG CAGAAAATGC GCGGCGGCAG

201  GCCGGATTCC GTTACCGTGC AGATTATCGA AGGTTCGCGT TTTTCGCATA

251  TGAGGAAAGT CATCGACGCA ACGCCCGACA TCGGACACGA CACCAAAGGC

301  TGGAGCAATG AAAAACTGAT GGCGGAAGTT GCGCCCGATG CCTTCAGCGG

351  CAATCCTGAA GGGCAGTTTT TTCCCGACAG CTACGAAATC GATGCGGGCG

401  GCAGCGATTT GCAGATTTAC CAAACCGCCT ACAAGGCGAT GCAACGCCGC

451  CTGAACGAGG CATGGGCAGG CAGGCAGGAC GGGCTGCCTT ATAAAAACCC

501  TTATGAAATG CTGATTATGG CGAGCCTGAT CGAAAAGGAA ACGGGGCATG

551  AGGCCGACCG CGACCATGTC GCTTCCGTCT TCGTCAACCG CCTGAAAATC

601  GGTATGCGCC TGCAAACCGA CCCGTCCGTG ATTTACGGCA TGGGTGCGGC

651  ATACAAGGGC AAAATCCGTA AAGCCGACCT GCGCCGCGAC ACGCCGTACA 701  aCAccTAtac gggcggggc ttgccgccaa cccggattgc gctgcccggC 751  Aaggcggcaa tggatgccgc cgcccacccg tccggcgaAa aatacctgTa 801  tttcgtgtcC AAAATGGACG GCACGGGCTT GAGCCAGTTC AGCCATGATT 851  TGACCGAACA CAACGCCGCc gTcCGCAAAT ATATTTTGAA AAAATAA
```

This corresponds to the amino acid sequence (SEQ ID NO: 38; ORF7ng-1):

```
  1  ..YRIKIAKNQG ISSVGRKLAE DRIVFSRHVL TAAAYVLGVH NRLHTGTYRL

51  PSEVSAWDIL QKMRGGRPDS VTVQIIEGSR FSHMRKVIDA TPDIGHDTKG

101  WSNEKLMAEV APDAFSGNPE GQFFPDSYEI DAGGSDLQIY QTAYKAMQRR

151  LNEAWAGRQD GLPYKNPYEM LIMASLIEKE TGHEADRDHV ASVFVNRLKI

201  GMRLQTDPSV IYGMGAAYKG KIRKADLRRD TPYNTYTGGG LPPTRIALPG

251  KAAMDAAAHP SGEKYLYFVS KMDGTGLSQF SHDLTEHNAA VRKYILKK*
```

ORF7ng-1 (SEQ ID NO: 38) and ORF7-1 (SEQ ID NO: 32) show 98.0% identity in 298 aa overlap:

```
                 10        20        30        40        50        60
orf7-1.pep  KLLKWSAVFLTVSAAVFAALLFVPKDNGRAYRIKIAKNQGISSVGRKLAEDRIVFSRHVL
                                        ||||||||||||||||||||||||||||
orf7ng-1                                YRIKIAKNQGISSVGRKLAEDRIVFSRHVL
                                                10        20        30

70        80        90       100       110       120
orf7-1.pep  TAAAYVLGVHNRLHTGTYRLPSEVSAWDILQKMRGGRPDSVTVQIIEGSRFSHMRKVIDA
            ||||||||||||||||||||||||||||||||||||||||||||||||||||||||||||
orf7ng-1    TAAAYVLGVHNRLHTGTYRLPSEVSAWDILQKMRGGRPDSVTVQIIEGSRFSHMRKVIDA
                    40        50        60        70        80        90

130       140       150       160       170       180
orf7-1.pep  TPDIGHDTKGWSNEKLMAEVAPDAFSGNPEGQFFPDSYEIDAGGSDLQIYQTAYKAMQRR
            ||||||||||||||||||||||||||||||||||||||||||||||||||||||||||||
orf7ng-1    TPDIGHDTKGWSNEKLMAEVAPDAFSGNPEGQFFPDSYEIDAGGSDLQIYQTAYKAMQRR
                   100       110       120       130       140       150

190       200       210       220       230       240
orf7-1.pep  LNEAWESRQDGLPYKNPYEMLIMASLVEKETGHEADRDHVASVFVNRLKIGMRLQTDPSV
            |||||:||||||||||||||||||||||:|||||||||||||||||||||||||||||||
orf7ng-1    LNEAWAGRQDGLPYKNPYEMLIMASLIEKETGHEADRDHVASVFVNRLKIGMRLQTDPSV
                   160       170       180       190       200       210

250       260       270       280       290       300
orf7-1.pep  IYGMGAAYKGKIRKADLRRDTPYNTYTRGGLPPTPIALPGKAALDAAAHPSGEKYLYFVS
            |||||||||||||||||||||||||||||| |||||| |||||||||:||||||||||||
orf7ng-1    IYGMGAAYKGKIRKADLRRDTPYNTYTGGGLPPTRIALPGKAAMDAAAHPSGEKYLYFVS
                   220       230       240       250       260       270

310       320       330
orf7-1.pep  KMDGTGLSQFSHDLTEHNAAVRKYILKKX
            |||||||||||||||||||||||||||||
orf7ng-1    KMDGTGLSQFSHDLTEHNAAVRKYILKKX
                   280       290
```

In addition, ORF7ng-1 (SEQ ID NO: 38) shows significant homology with a hypothetical *E.coli* protein (SEQ ID NO: 1114):

```
sp|P28306|YCEG_ECOLI HYPOTHETICAL 38.2 KD PROTEIN IN PABC-HOLB INTERGENIC REGION
gi|1787339 (AE000210) o340; 100% identical to fragment YCEG_ECOLI SW: P28306 but
has 97 additional C-terminal residues [Escherichia coli]Length = 340
Score = 79 (36.2 bits), Expect = 5.0e-57, Sum P(2) = 5.0e-57
Identities = 20/87 (22%), Positives = 40/87 (45%)

Query:    10  GISSVGRKLAEDRIVFSRHVLTAAAYVLGVHNRLHTGTYRLPSEVSAWDILQKMRGGRPD    69
              G  ++G +L  D+I+    V     +      GTYR    +++  ++L+ +  G+
Sbjct:    49  GRLALGEQLYADKIINRPRVFQWLLRIEPDLSHFKAGTYRFTPQMTVREMLKLLESGKEA   108

Query:    70  SVTVQIIEGSRFSHMRKVIDATPDIGH                                   96
                  ++++EG R S    K +   P I H
Sbjct:   109  QFPLRLVEGMRLSDYLKQLREAPYIKH                                   135

Score = 438 (200.7 bits), Expect = 5.0e-57, Sum P(2) = 5.0e-57
Identities = 84/155 (54%), Positives = 111/155 (71%)

Query:   120  EGQFFPDSYEIDAGGSDLQIYQTAYKAMQRRLNEAWAGRQDGLPYKNPYEMLIMASLIEK   179
              EG F+PD++   A  +D+ +  A+K M +  ++ AW GR DGLPYK   +++ MAS+IEK
Sbjct:   158  EGWFWPDTWMYTANTTDVALLKRAHKKMVKAVDSAWEGRADGLPYKDKNQLVTMASIIEK   217

Query:   180  ETGHEADRDHVASVFVNRLKIGMRLQTDPSVIYGMGAAYKGKIRKADLRRDTPYNTYTGG   239
              ET    ++RD VASVF+NRL+IGMRLQTDP+VIYGMG  Y GK+ +ADL   T YNTYT
Sbjct:   218  ETAVASERDKVASVFINRLRIGMRLQTDPTVIYGMGERYNGKLSRADLETPTAYNTYTIT   277

Query:   240  GLPPTRIALPGKAAMDAAAHPSGEKYLYFVSKMDG                           274
              GLPP  IA PG  ++ AAAHP+   YLYFV+  G
Sbjct:   278  GLPPGAIATPGADSLKAAAHPAKTPYLYFVADGKG                           312
```

Based on this analysis, including the fact that the *H.influenzae* YCEG protein possesses a possible leader sequence, it is predicted that the proteins from *N meningitidis* and *N.gonorrhoeae*, and their epitopes, could be useful antigens for vaccines or diagnostics, or for raising antibodies.

Example 6

The following partial DNA sequence was identified in *N.meningitidis* (SEQ ID NO: 39):

```
  1  CGTTTCAAAA TGTTAACTGT GTTGACGGCA ACCTTGATTG CCGGACAGGT
 51  ATCTGCCGCC GGAGGCGGTG CGGGGGATAT GAAACAGCCG AAGGAAGTCG
101  GAAAGGTTTT CAGAAAGCAG CAGCGTTACA GCGAGGAAGA AATCAAAAAC
151  GAACGCGCAC GGCTTGCGGC AGTGGGCGAG CGGGTTAATC AGATATTTAC
201  GTTGCTGGGA GGGGAAACCG CCTTGCAAAA GGGGCAGGCG GGAACGGCTC
251  TGGCAACCTA TATGCTGATG TTGGAACGCA CAAAATCCCC CGAAGTCGCC
301  GAACGCGCCT TGGAAATGGC CGTGTCGCTG AACGCGTTTG AACAGGCGGA
351  AATGATTTAT CAGAAATGGC GGCAGATTGA GCCTATACCG GGTAAGGCGC
401  AAAAACGGGC GGGGTGGCTG CGGAACGTGC TGAGGGAAAG AGGAAATCAG
451  CATCTGGACG GACGGGAAGA AGTGCTGGCT CAGGCGGACG AAGGACAG
```

This corresponds to the amino acid sequence (SEQ ID NO: 40; ORF9):

```
  1  ..RFKMLTVLTA TLIAGQVSAA GGGAGDMKQP KEVGKVFRKQ QRYSEEEIKN
 51     ERARLAAVGE RVNQIFTLLG GETALQKGQA GTALATYMLM LERTKSPEVA
101     ERALEMAVSL NAFEQAEMIY QKWRQIEPIP GKAQKRAGWL RNVLRERGNQ
151     HLDGREEVLA QADEGQ
```

Further sequence analysis revealed the complete DNA sequence (SEQ ID NO: 41):

```
  1  ATGTTACCTA ACCGTTTCAA AATGTTAACT GTGTTGACGG CAACCTTGAT
 51  TGCCGGACAG GTATCTGCCG CCGGAGGCGG TGCGGGGGAT ATGAAACAGC
101  CGAAGGAAGT CGGAAAGGTT TTCAGAAAGC AGCAGCGTTA CAGCGAGGAA
151  GAAATCAAAA ACGAACGCGC ACGGCTTGCG GCAGTGGGCG AGCGGGTTAA
201  TCAGATATTT ACGTTGCTGG GAGGGGAAAC CGCCTTGCAA AAGGGGCAGG
251  CGGGAACGGC TCTGGCAACC TATATGCTGA TGTTGGAACG CACAAAATCC
301  CCCGAAGTCG CCGAACGCGC CTTGGAAATG GCCGTGTCGC TGAACGCGTT
351  TGAACAGGCG GAAATGATTT ATCAGAAATG GCGGCAGATT GAGCCTATAC
401  CGGGTAAGGC GCAAAAACGG GCGGGGTGGC TGCGGAACGT GCTGAGGGAA
451  AGAGGAAATC AGCATCTGGA CGGACTGGAA GAAGTGCTGG CTCAGGCGGA
501  CGAAGGACAG AACCGCAGGG TGTTTTTATT GTTGGCACAA GCCGCCGTGC
551  AACAGGACGG GTTGGCGCAA AAAGCATCGA AAGCGGTTCG CCGCGCGGCG
601  TTGAAATATG AACATCTGCC CGAAGCGGCG GTTGCCGATG TGGTGTTCAG
651  CGTACAGGGA CGCGAAAAGG AAAAGGCAAT CGGAGCTTTG CAGCGTTTGG
701  CGAAGCTCGA TACGGAAATA TTGCCCCCCA CTTTAATGAC GTTGCGTCTG
751  ACTGCACGCA AATATCCCGA AATACTCGAC GGCTTTTTCG AGCAGACAGA
801  CACCCAAAAC CTTTCGGCCG TCTGGCAGGA AATGGAAATT ATGAATCTGG
```

```
                       -continued
 851   TTTCCCTGCA CAGGCTGGAT GATGCCTATG CGCGTTTGAA CGTGCTGTTG

901   GAACGCAATC CGAATGCAGA CCTGTATATT CAGGCAGCGA TATTGGCGGC

951   AAACCGAAAA GAAGGTGCTT CCGTTATCGA CGGCTACGCC GAAAAGGCAT

1001   ACGGCAGGGG GACGGAGGAA CAGCGGAGCA GGGCGGCGCT AACGGCGGCG

1051   ATGATGTATG CCGACCGCAG GGATTACGCC AAAGTCAGGC AGTGGCTGAA

1101   AAAAGTATCC GCGCCGGAAT ACCTGTTCGA CAAAGGTGTG CTGGCGGCTG

1151   CGGCGGCTGT CGAGTTGGAC GGCGGCAGGG CGGCTTTGCG GCAGATCGGC

1201   AGGGTGCGGA AACTTCCCGA ACAGCAGGGG CGGTATTTTA CGGCAGACAA

1251   TTTGTCCAAA ATACAGATGC TCGCCCTGTC GAAGCTGCCC GATAAACGGG

1301   AGGCTTTGAG GGGGTTGGAC AAGATTATCG AAAAACCGCC TGCCGGCAGT

1351   AATACAGAGT TACAGGCAGA GGCATTGGTA CAGCGGTCAG TTGTTTACGA

1401   TCGGCTTGGC AAGCGGAAAA AAATGATTTC AGATCTTGAA AGGGCGTTCA

1451   GGCTTGCACC CGATAACGCT CAGATTATGA ATAATCTGGG CTACAGCCTG

1501   CTGACCGATT CCAAACGTTT GGACGAAGGT TTCGCCCTGC TTCAGACGGC

1551   ATACCAAATC AACCCGGACG ATACCGCTGT CAACGACAGC ATAGGCTGGG

1601   CGTATTACCT GAAAGGCGAC GCGGAAAGCG CGCTGCCGTA TCTGCGGTAT

1651   TCGTTTGAAA ACGACCCCGA GCCCGAAGTT GCCGCCCATT GGGCGAAGT

1701   GTTGTGGGCA TTGGGCGAAC GCGATCAGGC GGTTGACGTA TGGACGCAGG

1751   CGGCACACCT TACGGGAGAC AAGAAAATAT GGCGGGAAAC GCTCAAACGT

1801   CACGGCATCG CATTGCCCCA ACCTTCCCGA AAACCTCGGA AATAA
```

This corresponds to the amino acid sequence (SEQ ID NO: 42; ORF9-1):

```
  1  MLPNRFKMLT VLTATLIAGQ VSAAGGGAGD MKQPKEVGKV FRKQQRYSEE

51  EIKNERARLA AVGERVNQIF TLLGGETALQ KGQAGTALAT YMLMLERTKS

101  PEVAERALEM AVSLNAFEQA EMIYQKWRQI EPIPGKAQKR AGWLRNVLRE

151  RGNQHLDGLE EVLAQADEGQ NRRVFLLLAQ AAVQQDGLAQ KASKAVRRAA

201  LKYEHLPEAA VADVVFSVQG REKEKAIGAL QRLAKLDTEI LPPTLMTLRL

251  TARKYPEILD GFFEQTDTQN LSAVWQEMEI MNLVSLHRLD DAYARLNVLL

301  ERNPNADLYI QAAILAANRK EGASVIDGYA EKAYGRGTEE QRSRAALTAA

351  MMYADRRDYA KVRQWLKKVS APEYLFDKGV LAAAAAVELD GGRAALRQIG

401  RVRKLPEQQG RYFTADNLSK IQMLALSKLP DKREALRGLD KIIEKPPAGS

451  NTELQAEALV QRSVVYDRLG KRKKMISDLE RAFRLAPDNA QIMNNLGYSL

501  LTDSKRLDEG FALLQTAYQI NPDDTAVNDS IGWAYYLKGD AESALPYLRY

551  SFENDPEPEV AAHLGEVLWA LGERDQAVDV WTQAAHLTGD KKIWRETLKR

601  HGIALPQPSR KPRK*
```

Computer analysis of this amino acid sequence gave the following results:
Homology with a Predicted ORF from *N.meningitidis* (Strain A)

ORF9 (SEQ ID NO: 40) shows 89.8% identity over a 166aa overlap with an ORF (ORF9a) (SEQ ID NO: 44) from strain A of *N. meningitidis*:

```
                      10        20        30        40        50
orf9.pep      RFKMLTVLTATLIAGQVSAAGGGAGDMKQPKEVGKVFRKQQRYSEEEIKNERARLA
              ||:|:||:|:|:|||: ||   ||:| |||||||||||||||||||||||||||
orf9a         MLPARFTILSVLAAALLAGQAYAA--GAADAKPPKEVGKVFRKQQRYSEEEIKNERARLA
                       10        20          30        40        50

60        70        80        90       100       110
orf9.pep      AVGERVNQIFTLLGGETALQKGQAGTALATYMLMLERTKSPEVAERALEMAVSLNAFEQA
              ||||||||||||| |||||||||||||||||||||||||||||||||||||||||||||
orf9a         AVGERVNQIFTLLGXETALQKGQAGTALATYMLMLERTKSPEVAERALEMAVSLNAFEQA
                60        70        80        90       100       110

120       130       140       150       160
orf9.pep      EMIYQKWRQIEPIPGKAQKRAGWLRNVLRERGNQHLDGREEVLAQADEGQ
              |||||||||||||||||||||||||||||||||||||| || |||||| |
orf9a         EMIYQKWRQIEPIPGKAQKRAGWLRNVLRERGNQHLDGLEEXLAQADEXQNRRVFLLLAQ
               120       130       140       150       160       170 orf9a         AAVQQDGLAQKASKAVRRAALRYEHLPEAAVADVVFSVQXREKEKAIGALQRLAKLDTEI
               180       190       200       210       220       230
```

The complete length ORF9a nucleotide sequence (SEQ ID NO: 43) is:

```
   1   ATGTTACCCG CCCGTTTCAC CATTTTATCT GTGCTCGCGG CAGCCCTGCT
  51   TGCCGGGCAG GCGTATGCCG CCGGCGCGGC GGATGCGAAG CCGCCGAAGG
 101   AAGTCGGAAA GGTTTTCAGA AAGCAGCAGC GTTACAGCGA GGAAGAAATC
 151   AAAAACGAAC GCGCACGGCT TGCGGCAGTG GGCGAGCGGG TTAATCAGAT
 201   ATTTACGTTG CTGGGANGGG AAACCGCCTT GCAAAAGGGG CAGGCGGGAA
 251   CGGCTCTGGC AACCTATATG CTGATGTTGG AACGCACAAA ATCCCCCGAA
 301   GTCGCCGAAC GCGCCTTGGA AATGGCCGTG TCNCTGAACG CGTTTGAACA
 351   GGCGGAAATG ATTTATCAGA AATGGCGGCA GATTGAGCCT ATACCGGGTA
 401   AGGCGCAAAA ACGGGCGGGG TGGCTGCGGA ACGTGCTGAG GGAAAGAGGA
 451   AATCAGCATC TAGACGGACT GGAAGAANTG CTGGCTCAGG CGGACGAANG
 501   ACAGAACCGC AGGGTGTTTT TATTGTTGGC ACAAGCCGCC GTGCAACAGG
 551   ACGGGTTGGC GCAAAAAGCA TCGAAAGCGG TTCGCCGCGC GGCGTTGAGA
 601   TATGAACATC TGCCCGAAGC GGCGGTTGCC GATGTGGTGT TCAGCGTACA
 651   GGNACGCGAA AAGGAAAAGG CAATCGGAGC TTTGCAGCGT TTGGCGAAGC
 701   TCGATACGGA AATATTGCCC CCCACTTTAA TGACGTTGCG TCTGACTGCA
 751   CGCAAATATC CGAAATACT CGACGGCTTT TTCGAGCAGA CAGACACCCA
 801   AAACCTTTCG GCCGTCTGGC AGGAAATGGA AATTATGAAT CTGGTTTCCC
 851   TGCACAGGCT GGATGATGCC TATGCGCGTT TGAACGTGCT GTTGGAACGC
 901   AATCCGAATG CAGACCTGTA TATTCAGGCA GCGATATTGG CGGCAAACCG
 951   AAAAGAANGT GCTTCCGTTA TCGACGGCTA CGCCGAAAAG GCATACGGCA
1001   GGGGGACGGG GGAACAGCGG GGCAGGGCGG CAATGACGGC GGCGATGATA
1051   TATGCCGACC GAAGGGATTA CACCAAAGTC AGGCAGTGGT TGAAAAAAGT
1101   GTCCGCGCCG GAATACCTGT TCGACAAAGG TGTGCTGGCG GCTGCGGCGG
```

-continued

```
1151  CTGTCGAGTT GGACNGCGGC AGGGCGGCTT TGCGGCAGAT CGGCAGGGTG

1201  CGGAAACTTC CCGAACAGCA GGGGCGGTAT TTTACGGCAG ACAATTTGTC

1251  CAAAATACAG ATGTTCGCCC TGTCGAAGCT GCCCGACAAA CGGGAGGCTT

1301  TGAGGGGGTT GGACAAGATT ATCGAAAAAC CGCCTGCCGG CAGTAATACA

1351  GAGTTACAGG CAGAGGCATT GGTACAGCGG TCAGTTGTTT ACGATCGGCT

1401  TGGCAAGCGG AAAAAAATGA TTTCAGATCT TGAAAGGGCG TTCAGGCTTG

1451  CACCCGATAA CGCTCAGATT ATGAATAATC TGGGCTACAG CCTGCTTTCC

1501  GATTCCAAAC GTTTGGACGA AGGCTTCGCC CTGCTTCAGA CGGCATACCA

1551  AATCAACCCG GACGATACCG CTGTCAACGA CAGCATAGGC TGGGCGTATT

1601  ACCTGAAANG CGACGCGGAA AGCGCGCTGC CGTATCTGCG GTATTCGTTT

1651  GAAAACGACC CCGAGCCCGA AGTTGCCGCC CATTTGGGCG AAGTGTTGTG

1701  GGCATTGGGC GAACGCGATC AGGCGGTTGA CGTATGGACG CAGGCGGCAC

1751  ACCTTACGGG AGACAAGAAA ATATGGCGGG AAACGCTCAA ACGTCACGGC

1801  ATCGCATTGC CCCAACCTTC CCGAAAACCT CGGAAATAA
```

This encodes a protein having amino acid sequence (SEQ ID NO: 44):

```
  1  MLPARFTILS VLAAALLAGQ AYAAGAADAK PPKEVGKVFR KQQRYSEEEI

51  KNERARLAAV GERVNQIFTL LGXETALQKG QAGTALATYM LMLERTKSPE

101  VAERALEMAV SLNAFEQAEM IYQKWRQIEP IPGKAQKRAG WLRNVLRERG

151  NQHLDGLEEX LAQADEXQNR RVFLLLAQAA VQQDGLAQKA SKAVRRAALR

201  YEHLPEAAVA DVVFSVQXRE KEKAIGALQR LAKLDTEILP PTLMTLRLTA

251  RKYPEILDGF FEQTDTQNLS AVWQEMEIMN LVSLHRLDDA YARLNVLLER

301  NPNADLYIQA AILAANRKEX ASVIDGYAEK AYGRGTGEQR GRAAMTAAMI

351  YADRRDYTKV RQWLKKVSAP EYLFDKGVLA AAAAVELDXG RAALRQIGRV

401  RKLPEQQGRY FTADNLSKIQ MFALSKLPDK REALRGLDKI IEKPPAGSNT

451  ELQAEALVQR SVVYDRLGKR KKMISDLERA FRLAPDNAQI MNNLGYSLLS

501  DSKRLDEGFA LLQTAYQINP DDTAVNDSIG WAYYLKXDAE SALPYLRYSF

551  ENDPEPEVAA HLGEVLWALG ERDQAVDVWT QAAHLTGDKK IWRETLKRHG

601  IALPQPSRKP RK*
```

ORF9a (SEQ ID NO: 44) and ORF9-1 (SEQ ID NO: 42) show 95.3% identity in 614 aa overlap:

```
                10         20         30         40         50
orf9a.pep  MLPARFTILSVLAAALLAGQAYAAG--AADAKPPKEVGKVFRKQQRYSEEEIKNERARLA
           ||| || :|:||:|:|||: |||  |:| | |||||||||||||||||||||||||||
orf9-1     MLPNRFKMLTVLTATLIAGQVSAAGGGAGDMKQPKEVGKVFRKQQRYSEEEIKNERARLA
                10         20         30         40         50         60

60         70         80         90        100        110
orf9a.pep  AVGERVNQIFTLLGXETALQKGQAGTALATYMLMLERTKSPEVAERALEMAVSLNAFEQA
           |||||||||||||| |||||||||||||||||||||||||||||||||||||||||||||
orf9-1     AVGERVNQIFTLLGGETALQKGQAGTALATYMLMLERTKSPEVAERALEMAVSLNAFEQA
                70         80         90        100        110        120
```

```
              120       130       140       150       160       170
orf9a.pep   EMIYQKWRQIEPIPGKAQKRAGWLRNVLRERGNQHLDGLEEXLAQADEXQNRRVFLLLAQ
            ||||||||||||||||||||||||||||||||||||| |||||| |||||||||||||
orf9-1      EMIYQKWRQIEPIPGKAQKRAGWLRNVLRERGNQHLDGLEEVLAQADEGQNRRVFLLLAQ
              130       140       150       160       170       180

180       190       200       210       220       230
orf9a.pep   AAVQQDGLAQKASKAVRRAALRYEHLPEAAVADVVFSVQXREKEKAIGALQRLAKLDTEI
            |||||||||||||||||||||:|||||||||||||||||:|||||||||||||||||||
orf9-1      AAVQQDGLAQKASKAVRRAALKYEHLPEAAVADVVFSVQGREKEKAIGALQRLAKLDTEI
              190       200       210       220       230       240

240       250       260       270       280       290
orf9a.pep   LPPTLMTLRLTARKYPEILDGFFEQTDTQNLSAVWQEMEIMNLVSLHRLDDAYARLNVLL
            ||||||||||||||||||||||||||||||||||||||||||||||||||||||||||||
orf9-1      LPPTLMTLRLTARKYPEILDGFFEQTDTQNLSAVWQEMEIMNLVSLHRLDDAYARLNVLL
              250       260       270       280       290       300

300       310       320       330       340       350
orf9a.pep   ERNPNADLYIQAAILAANRKEXASVIDGYAEKAYGRGTGEQRGRAAMTAAMIYADRRDYT
            |||||||||||||||||||||| |||||||||||||||||| :|||:||||:||||||:
orf9-1      ERNPNADLYIQAAILAANRKEGASVIDGYAEKAYGRGTEEQRSRAALTAAMMYADRRDYA
              310       320       330       340       350       360

360       370       380       390       400       410
orf9a.pep   KVRQWLKKVSAPEYLFDKGVLAAAAAVELDXGRAALRQIGRVRKLPEQQGRYFTADNLSK
            |||||||||||||||||||||||||||||| |||||||||||||||||||||||||||||
orf9-1      KVRQWLKKVSAPEYLFDKGVLAAAAAVELDGGRAALRQIGRVRKLPEQQGRYFTADNLSK
              370       380       390       400       410       420

420       430       440       450       460       470
orf9a.pep   IQMFALSKLPDKREALRGLDKIIEKPPAGSNTELQAEALVQRSVVYDRLGKRKKMISDLE
            |||:||||||||||||||||||||||||||||||||||||||||||||||||||||||
orf9-1      IQMLALSKLPDKREALRGLDKIIEKPPAGSNTELQAEALVQRSVVYDRLGKRKKMISDLE
              430       440       450       460       470       480

480       490       500       510       520       530
orf9a.pep   RAFRLAPDNAQIMNNLGYSLLSDSKRLDEGFALLQTAYQINPDDTAVNDSIGWAYYLKXD
            |||||||||||||||||||||:||||||||||||||||||||||||||||||||||| |
orf9-1      RAFRLAPDNAQIMNNLGYSLLTDSKRLDEGFALLQTAYQINPDDTAVNDSIGWAYYLKGD
              490       500       510       520       530       540

540       550       560       570       580       590
orf9a.pep   AESALPYLRYSFENDPEPEVAAHLGEVLWALGERDQAVDVWTQAAHLTGDKKIWRETLKR
            ||||||||||||||||||||||||||||||||||||||||||||||||||||||||||||
orf9-1      AESALPYLRYSFENDPEPEVAAHLGEVLWALGERDQAVDVWTQAAHLTGDKKIWRETLKR
              550       560       570       580       590       600

600       610
orf9a.pep   HGIALPQPSRKPRKX
            ||||||||||||||
orf9-1      HGIALPQPSRKPRKX
              610
```

Homology with a Predicted ORF from *N. gonorrhoeae*

ORF9 (SEQ ID NO: 40) shows 82.8% identity over a 163aa overlap with a predicted ORF (ORF9.ng) (SEQ ID NO: 46) from *N. gonorrhoeae*:

```
Orf9      RFKMLTVLTATLIAGQVSAAGGGAGDMKQPKEVGKVFRKQQRYSEEEIKNERAR        54
          || :|:||:|:|||: ||  ||:::  ||||||||:||::||||||||||||
orf9ng    MIMLPARFTILSVLAAALLAGQAYAA--GAADVELPKEVGKVLRKHRRYSEEEIKNERAR  58 orf9      LAAVGERVNQIFTLLGGETALQKGQAGTALATYMLMLERTKSPEVAERALEMAVSLNAFE  114
          ||||||||||::|||||||||||||||||||||||||||||||||||||||||||||||
orf9ng    LAAVGERVNRVFTLLGGETALQKGQAGTALATYMLMLERTKSPEVAERALEMAVSLNAFE  118 orf9      QAEMIYQKWRQIEPIPGKAQKRAGWLRNVLRERGNQHLDGREEVLAQADEGQ         166
          ||||||||||||||||||:||| |||||||||:|  ||| |||  ||  ||:|
orf9ng    QAEMIYQKWRQIEPIPGEAQKPAGWLRNVLKEGGNPHLDRLEEVPAQSDYVHQPMIFLLL  178
```

The ORF9ng nucleotide sequence (SEQ ID NO: 45) was predicted to encode a protein having including acid sequence (SEQ ID NO: 46):

```
  1 MIMLPARFTI LSVLAAALLA GQAYAAGAAD VELPKEVGKV LRKHRRYSEE

51 EIKNERARLA AVGERVNRVF TLLGGETALQ KGQAGTALAT YMLMLERTKS

101 PEVAERALEM AVSLNAFEQA EMIYQKWRQI EPIPGEAQKP AGWLRNVLKE

151 GGNPHLDRLE EVPAQSDYVH QPMIFLLLVQ AAVQHGGVAQ KPSKAVRPAA

201 YNYEVLPETA GADAVFCVQG PQYEKAIQSF PPCGRNPQTE NIAPPFNELF

251 RPTARPISPK LLQRFFRTEP NLAKPFRPPG PEMETYQTGF PRPLTRNNPT
```

Amino acids 1–28 are a putative leader sequence, and 173–189 are predicted to be a transmembrane domain.

Further sequence analysis revealed the complete length ORF9ng DNA sequence (SEQ ID NO: 47):

```
   1 ATGTTACCCG CCCGTTTCAC TATTTTATCT GTCCTCGCAG CAGCCCTGCT

51 TGCCGGACAG GCGTATGCTG CCGGCGCGGC GGATGTGGAG CTGCCGAAGG

101 AAGTCGGAAA GGTTTTAAGG AAACATCGGC GTTACAGCGA GGAAGAAATC

151 AAAAACGAAC GCGCACGGCT TGCGGCAGTG GGCGAACGGG TCAACAGGGT

201 GTTTACGCTG TTGGGCGGTG AAACGGCTTT GCAGAAAGGG CAGGCGGGAA

251 CGGCTCTGGC AACCTATATG CTGATGTTGG AACGCACAAA ATCCCCCGAA

301 GTCGCCGAAC GCGCCTTGGA AATGGCCGTG TCGCTGAACG CGTTTGAACA

351 GGCGGAAATG ATTTATCAGA AATGgcggca gatcgagcct ataCcgggtg 401 aggcgcaaaa accgGcgggG tggctgcgga acgtattgaa ggaagggGGa 451 aaTCAGCATC TGGAcgggtt gaaagaggTG CtggcgcaAT cggacgatGT 501 GCAAAAAcgc aggaTATTTT TGCTGCTGGT GCAAGCCGCC GTGCagcagg 551 gTGGGGTGGC TCAAAAAGCA TCGAAAGCGG TTCGCcgtgc GGcgttgaAG 601 TATGAACATC TGCCcgaagc ggcggTTGCC GATGcggTGT TCGGCGTACA 651 GGGACGCGAA AAGGAAAagg caaTCGAAGC TTTGCAGCGT TTGGCGAAGC

701 TCGATACGGA AATATTGCCC CCCACTTTAA TGACGTTGCG TCTGACTGCA

751 CGCAAATATC CCGAAATACT CGACGGCTTT TTCGAGCAGA CAGACACCCA

801 AAACCTTTCG GCCGTCTGGC AGGAAATGGA AATTATGAAT CTGGTTTCCC

851 TGCGTAAGCC GGATGATGCC TATGCGCGTT TGAACGTGCT GTTGGAACAC

901 AACCCGAATG CAAACCTGTA TATTCAGGCG GCGATATTGG CGGCAAACCG

951 AAAAGAAGGT GCGTCCGTTA TCGACGGCTA CGCCGAAAAG GCATACGGCA

1001 GGGGGACGGG GGAACAGCGG GGCagggcgg cAATgacggc GGCGATGATA

1051 TATGCCGACC GCAGGGATTA CGCCAAAGTC AGGCAGTGGT TGAAAAAAGT

1101 GTCCGCGCCG GAATACCTGT TCGACAAAGG CGTGCTGGCG GCTGCGGCGG

1151 CTGCCGAATT GGACGGAGGC CGGGCGGCTT TGCGGCAGAT CGGCAGGGTG

1201 CGGAAACTTC CCGAACAGCA GGGGCGGTAT TTTACGGCAG ACAATTTGTC

1251 CAAAATACAG ATGCTCGCCC TGTCGAAGCT GCCCGACAAA CGGGAAGCCC

1301 TGATCGGGCT GAACAACATC ATCGCCAAAC TTTCGGCGGC GGGAAGCACG
```

-continued

```
1351 GAACCTTTGG CGGAAGCATT GGCACAGCGT TCCATTATTT ACGaacAGTT 1401 cggCAAACGG GGAAAAATGA TTGCCGACCT tgaAACcgcg CTCAAACTTA

1451 CGCCCGATAA TGCACAAATT ATGAATAATC TGGGCTACAG CCTGCTTTCC

1501 GATTCCAAAC GTTTGGACGA GGGTTTCGCC CTGCTTCAGA CGGCATACCA

1551 AATCAACCCG GACGATACCG CCGTTAACGA CAGCATAGGC TGGGCGTATT

1601 ACCTGAAAGG CGACgcggaA AGCGCGCTGC CGTATCTGcg gtattcgttt 1651 gAAAACGACC CCGAGCCCGA AGTTGCCGCC CATTTGGGCG AAGTGTTGTG

1701 GGCATTGGGC GAACGCGATC AGGCGGTTGA CGTATGGACG CAGGCGGCAC

1751 ACCTTAGGGG AGACAAGAAA ATATGGCGGG AGACGCTCAA ACGCTACGGA

1801 ATCGCCTTGC CCGAGCCTTC CCGAAAACCC CGGAAATAA
```

This encodes a protein having amino acid sequence (SEQ ID NO: 48):

```
  1  MLPARFTILS VLAAALLAGQ AYAAGAADVE LPKEVGKVLR KHRRYSEEEI

51  KNERARLAAV GERVNRVFTL LGGETALQKG QAGTALATYM LMLERTKSPE

101  VAERALEMAV SLNAFEQAEM IYQKWRQIEP IPGEAQKPAG WLRNVLKEGG

151  NQHLDGLKEV LAQSDDVQKR RIFLLLVQAA VQQGGVAQKA SKAVRRAALK

201  YEHLPEAAVA DAVFGVQGRE KEKAIEALQR LAKLDTEILP PTLMTLRLTA

251  RKYPEILDGF FEQTDTQNLS AVWQEMEIMN LVSLRKPDDA YARLNVLLEH

301  NPNANLYIQA AILAANRKEG ASVIDGYAEK AYGRGTGEQR GRAAMTAAMI

351  YADRRDYAKV RQWLKKVSAP EYLFDKGVLA AAAAAELDGG RAALRQIGRV

401  RKLPEQQGRY FTADNLSKIQ MLALSKLPDK REALIGLNNI IAKLSAAGST

451  EPLAEALAQR SIIYEQFGKR GKMIADLETA LKLTPDNAQI MNNLGYSLLS

501  DSKRLDEGFA LLQTAYQINP DDTAVNDSIG WAYYLKGDAE SALPYLRYSF

551  ENDPEPEVAA HLGEVLWALG ERDQAVDVWT QAAHLRGDKK IWRETLKRYG

601  IALPEPSRKP RK*
```

ORF9ng (SEQ ID NO: 48) and ORF9-1 (SEQ ID NO: 42) show 88.1% identity in 614 aa overlap:

```
                 10         20         30         40         50         60
orf9-1.pep  MLPNRFKMLTVLTATLIAGQVSAAGGGAGDMKQPKEVGKVFRKQQRYSEEEIKNERARLA
            |||  || :|:||:|:|:|||:  |||   |:|:: |||||||:||::||||||||||||
orf9ng-1    MLPARFTILSVLAAALLAGQAYAAG--AADVELPKEVGKVLRKHRRYSEEEIKNERARLA
                 10         20           30         40         50

70         80         90        100        110        120
orf9-1.pep  AVGERVNQIFTLLGGETALQKGQAGTALATYMLMLERTKSPEVAERALEMAVSLNAFEQA
            ||||||| ::|||||||||||||||||||||||||||||||||||||||||||||||||||
orf9ng-1    AVGERVNRVFTLLGGETALQKGQAGTALATYMLMLERTKSPEVAERALEMAVSLNAFEQA
                 60         70         80         90        100        110

130        140        150        160        170        180
orf9-1.pep  EMIYQKWRQIEPIPGKAQKRAGWLRNVLRERGNQHLDGLEEVLAQADEGQNRRVFLLLAQ
            ||||||||||||||||:||| ||||||||:| ||||||||:|||||:|: |:||:|||||
orf9ng-1    EMIYQKWRQIEPIPGEAQKPAGWLRNVLKEGGNQHLDGLKEVLAQSDDVQKRRIFLLLVQ
                120        130        140        150        160        170
```

```
              190       200       210       220       230       240
orf9-1.pep  AAVQQDGLAQKASKAVRRAALKYEHLPEAAVADVVFSVQGREKEKAIGALQRLAKLDTEI
            ||||  |:||||||||||||||||||||||||||:||:|||||||||| ||||||||||||
orf9ng-1    AAVQQGGVAQKASKAVRRAALKYEHLPEAAVADAVFGVQGREKEKAIEALQRLAKLDTEI
          180       190       200       210       220       230

250       260       270       280       290       300
orf9-1.pep  LPPTLMTLRLTARKYPEILDGFFEQTDTQNLSAVWQEMEIMNLVSLHRLDDAYARLNVLL
            |||||||||||||||||||||||||||||||||||||||||||||||:: ||||||||||
orf9ng-1    LPPTLMTLRLTARKYPEILDGFFEQTDTQNLSAVWQEMEIMNLVSLRKPDDAYARLNVLL
          240       250       260       270       280       290

310       320       330       340       350       360
orf9-1.pep  ERNPNADLYIQAAILAANRKEGASVIDGYAEKAYGRTEEQRSRAALTAAMMYADRRDYA
            |:||||:|||||||||||||||||||||||||||||| |||:|||||:|||:|||||||
orf9ng-1    EHNPNANLYIQAAILAANRKEGASVIDGYAEKAYGRTGEQRGRAAMTAAMIYADRRDYA
          300       310       320       330       340       350

370       380       390       400       410       420
orf9-1.pep  KVRQWLKKVSAPEYLFDKGVLAAAAAVELDGGRAALRQIGRVRKLPEQQGRYFTADNLSK
            |||||||||||||||||||||||||||:||||||||||||||||||||||||||||||||
orf9ng-1    KVRQWLKKVSAPEYLFDKGVLAAAAAAELDGGRAALRQIGRVRKLPEQQGRYFTADNLSK
          360       370       380       390       400       410

430       440       450       460       470       480
orf9-1.pep  IQMLALSKLPDKREALRGLDKIIEKPPAGSNTELQAEALVQRSVVYDRLGKRKKMISDLE
            |||||||||||||||  ||::|| |    |:::|| ||||:|||::|:::||| ||:|||
orf9ng-1    IQMLALSKLPDKREALIGLNNIIAKLSAAGSTEPLAEALAQRSIIYEQFGKRGKMIADLE
          420       430       440       450       460       470

490       500       510       520       530       540
orf9-1.pep  RAFRLAPDNAQIMNNLGYSLLTDSKRLDEGFALLQTAYQINPDDTAVNDSIGWAYYLKGD
            |::|:|||||||||||||||:|||||||||||||||||||||||||||||||||||||||
orf9ng-1    TALKLTPDNAQIMNNLGYSLLSDSKRLDEGFALLQTAYQINPDDTAVNDSIGWAYYLKGD
          480       490       500       510       520       530

550       560       570       580       590       600
orf9-1.pep  AESALPYLRYSFENDPEPEVAAHLGEVLWALGERDQAVDVWTQAAHLTGDKKIWRETLKR
            |||||||||||||||||||||||||||||||||||||||||||||| |||||||||||||
orf9ng-1    AESALPYLRYSFENDPEPEVAAHLGEVLWALGERDQAVDVWTQAAHLRGDKKIWRETLKR
          540       550       560       570       580       590

610
orf9-1.pep  HGIALPQPSRKPRKX
            :|||||:||||||||
orf9ng-1    YGIALPEPSRKPRKX
          600       610
```

In addition, ORF9ng (SEQ ID NO: 48) shows significant homology with a hypothetical protein (SEQ ID NO: 1115) from *P.aeruginosa*:

```
sp|P42810|YHE3_PSEAE HYPOTHETICAL 64.8 KD PROTEIN IN HEMM-HEMA INTERGENIC REGION
(ORF3)
)gi|1072999|pir||S49376 hypothetical protein 3 - Pseudomonas aeruginosa )gi|557259
(X82071) orf3 [Pseudomonas aeruginosa] Length = 576
 Score = 128 bits (318), Expect = 1e-28
 Identities = 138/587 (23%) Positives = 228/587 (38%), Gaps = 125/587 (21%)

Query:   67  VFTLLGGETALQKGQAGTALATYMLMLERTKSPEVAERALEMAVSLNAFEQAEMIYQKWR   126
             +++LL  E A Q+ +   AL+ Y++  ++T+ P V+ERA  +A  L A ++A       W
Sbjct:   53  LYSLLVAELAGQRNRFDIALSNYVVQAQKTRDPGVSERAFRIAEYLGADQEALDTSLLWA   112

Query:  127  QIEPIPGEAQKPAG--------------WLRNVLKEGGNQHLDGLKEVLAQSDDVQKRRI   172
             +   P   +AQ+ A              ++  VL  G+ H D L   A++D    +  +
Sbjct:  113  RSAPDNLDAQRAAAIQLARAGRYEESMVYMEKVLNGQGDTHFDFLALSAAETDPDTRAGL   172

Query:  173  FXXXXXXXXXXXXXXXXKASKAVRRAALKYEHLPEAAVADAVFGVQGREKEKAIEALQRLA   232
             F               ++        KY + +   A+  Q   ++A+ L+ +
Sbjct:  173  L------------------QSFDHLLKKYPNNGQLLFGKALLQQDGRPDEALTLLEDNS   214

Query:  233  KLDTEILPPTLMTLRLTARK-----YPEILDGFFEQTDTQNLSAVWQEMEIMNLVSLRKP   287
              E+ P  L+  L+ K      P  G  E D +     +     LV    +
Sbjct:  215  ASRHEVAPLLLRSLLQSMKRSDEALPLLKAGIKEHPDDKRVRLAYARL----LVEQNRL   270
```

```
Query:  288  DDAYARLNVLLEHNPN--------------------ANLYIQAAI--------------  312
             DDA A    L++  P+                    A +Y++  +
Sbjct:  271  DDAKAEFAGLVQQFPDDDDDLRFSLALVCLEAQAWDEARIYLEELVERDSHVDAAHFNLG  330

Query:  313  -LAANRKEGASVIDGYAEKAYGRGTGEQRGRAAMTAAMIYADRRDYAKVRQWLKKVSAPE  371
              LA  +K+ A  +D YA+   G G      +   T  ++ARD A   R    +   P+
Sbjct:  331  RLAEEQKDTARALDEYAQ--VGPGNDFLPAQLRQTDVLLKAGRVDEAAQRLDKARSEQPD  388

Query:  372  YLFDKXXXXXXXXXXXXXXXXXXXXXXRQIGRVRKLPEQQGRYFTADNLSKIQMLALSKLPDKR  431
             Y                                              A   L   I+  ALS   +
Sbjct:  389  Y----------------------------------------AIQLYLIEAEALSNNDQQE  408

Query:  432  EALIGLNNIIAKLSAAGSTEPLAEALAQRSIIYEQFGKRGKMIADLETALKLTPDNAQIM  491
             +A  +   + +        E L   L  RS++ E+      +M  DL   +   PDNA  +
Sbjct:  409  KAWQAIQEGLKQYP-----EDL-NLLYTRSMLAEKRNDLAQMEKDLRFVIAREPDNAMAL  462

Query:  492  NNLGYSLLSDSKRLDEGFALLQTAYQINPDDTAVNDSIGWAYYLKGDAESALPYLRYSFE  551
             N LGY+L   + R  E    L+  A+++NPDD A+ DS+GW  Y +G    A  YLR + +
Sbjct:  463  NALGYTLADRTTRYGEARELILKAHKLNPDDPAILDSMGWINYRQGKLADAERYLRQALQ  522

Query:  552  NDPEPEVAAHLGEVLWALGERDQAVDVWTQAAHLRGDKKIWRETLKR  598
                P+  EVAAHLGEVLWA G +  A   +W +      + D   + R T+KR
Sbjct:  523  RYPDHEVAAHLGEVLWAQGRQGDARAIWREYLDKQPDSDVLRRTIKR  569
``` gi|2983399 (AE000710) hypothetical protein (SEQ ID NO: 1116) [*Aquifex aeolicus*]
Length = 545
Score = 81.5 bits (198), Expect = 1e-14
Identities = 61 198 (30%), Positives = 98 198 (48%), Gaps = 19/198 (9%)

```
Query:  408  GRYFTADNL-SKIQMLALSKLPDKREALIGLNNIIAKLSAAGSTEPLAEALAQ-------  459
             G Y  A  L  K ++LA    PDK+E L   +   +K         + + L +
Sbjct:  335  GNYEDAKRLIEKAKVLA----PDKKEILFLEADYYSKTKQYDKALEILKKLEKDYPNDSR  390

Query:  460  ----RSIIYEQFGKRGKMIADLETALKLTPDNAQIMNNLGYSLLS--DSKRLDEGFALLQ  513
                 +I+Y+  G           L  A++L P+N    N LGYSLL       +R++E      L++
Sbjct:  391  VYFMEAIVYDNLGDIKNAEKALRKAIELDPENPDYYNYLGYSLLLWYGKERVEEAEELIK  450

Query:  514  TAYQINPDDTAVNDSIGWAYYLKGDAESALPYLRYSF-ENDPEPEVAAHLGEVLWALGER  572
              A +  +P++ A   DS+GW YYLKGD E A+ YL   +    E    +P V H+G+VL    +G +
Sbjct:  451  KALEKDPENPAYIDSMGWVYYLKGDYERAMQYLLKALREAYDDPVVNEHVGDVLLKMGYK  510

Query:  573  DQAVDVWTQAAHLRGDKK  590
             ++A + +  +A  L    + K
Sbjct:  511  EEARNYYERALKLLEEGK  528
```

Based on this analysis, it is predicted that the proteins from *N.meningitidis* and *N.gonorrhoeae*, and their epitopes, could be useful antigens for vaccines or diagnostics, or for raising antibodies.

Example 7

The following partial DNA sequence was identified in *N.meningitidis* (SEQ ID NO: 49):

```
  1  AACCTCTACG CCGGCCCGCA GACCACATCC GTCATCGCAA ACATCGCCGA
 51  CAACCTGCAA CTGGCCAAAG ACTACGGCAA AGTACACTGG TTCGCCTCCC
101  CGCTCTTCTG GCTCCTGAAC CAACTGCACA ACATCATCGG CAACTGGGGC
151  TGGGCGATTA TCGTTTTAAC CATCATCGTC AAAGCCGTAC TGTATCCATT
201  GACCAACGCC TCTTACCGCT CTATGGCGAA AATGCGTGCC GCCGCACCCA
251  AACTGCAAGC CATCAAAGAG AAATACGGCG ACGACCGTAT GGCGCAACAA
301  CAGGCGATGA TGCAGCTTTA CACAGACGAG AAAATCAACC CGaCTGGGCG
351  GCTGCCTGCC TATGCTGTTG CAAATCCCCG TCTTCATCGG ATTGTATTGG
401  GCATTGTTCG CCTCCGTAGA ATTGCGCCAG GCACCTTGGC TGGGTTGGAT
451  TACCGACCTC AGCCGCGCCG ACCCCTACTA CATCCTGCCC ATCATTATGG
501  CGGCAACGAT GTTCGCCCAA ACTTATCTGA ACCCGCCGCC GAcCGACCCG
551  ATGCAgGCGA AAATGATGAA AATCATGCCG TTGGTTTTCT CsGwCrTGTT
```

```
601  CTTCTTCTTC CCTGCCGGks TGGTATTGTA CTGGGTAGTC AACAACCTCC

651  TGACCATCGC CCAGCAATGG CACATCAACC GCAGCATCGA AAAACAACGC

701  GCCCAAGGCG AAGTCGTTTC CTAA
```

This corresponds to the amino acid sequence (SEQ ID NO: 50; ORF11):

```
  1  ..NLYAGPQTTS VIANIADNLQ LAKDYGKVHW FASPLFWLLN QLHNIIGNWG

51    WAIIVLTIIV KAVLYPLTNA SYRSMAKMRA AAPKLQAIKE KYGDDRMAQQ

101    QAMMQLYTDE KINPLGGCLP MLLQIPVFIG LYWALFASVE LRQAPWLGWI

151    TDLSRADPYY ILPIIMAATM FAQTYLNPPP TDPMQAKMMK IMPLVFSXXF

201    FFFPAGXVLY WVVNNLLTIA QQWHINRSIE KQRAQGEVVS *
```

Further sequence analysis revealed the complete DNA sequence (SEQ ID NO: 51):

```
   1  ATGGATTTTA AAAGACTCAC GGCGTTTTTC GCCATCGCGC TGGTGATTAT

51  GATCGGCTGG GAAAAGATGT TCCCCACTCC GAAGCCAGTC CCCGCGCCCC

101  AACAGGCAGC ACAACAACAG GCCGTAACCG CTTCCGCCGA AGCCGCGCTC

151  GCGCCCGCAA CGCCGATTAC CGTAACGACC GACACGGTTC AAGCCGTCAT

201  TGATGAAAAA AGCGGCGACC TGCGCCGGCT GACCCTGCTC AAATACAAAG

251  CAACCGGCGA CGAAAATAAA CCGTTCATCC TGTTTGGCGA CGGCAAAGAA

301  TACACCTACG TCGCCCAATC CGAACTTTTG GACGCGCAGG GCAACAACAT

351  TCTAAAAGGC ATCGGCTTTA GCGCACCGAA AAAACAGTAC AGCTTGGAAG

401  GCGACAAAGT TGAAGTCCGC CTGAGCGCGC TGAAACACG CGGTCTGAAA

451  ATCGACAAAG TTTATACTTT CACCAAAGGC AGCTATCTGG TCAACGTCCG

501  CTTCGACATC GCCAACGGCA GCGGTCAAAC CGCCAACCTG AGCGCGGACT

551  ACCGCATCGT CCGCGACCAC AGCGAACCCG AGGGTCAAGG TTACTTTACC

601  CACTCTTACG TCGGCCCTGT TGTTTATACC CCTGAAGGCA ACTTCCAAAA

651  AGTCAGCTTT TCCGACTTGG ACGACGATGC CAAATCCGGC AAATCCGAGG

701  CCGAATACAT CCGCAAAACC CCGACCGGCT GGCTCGGCAT GATTGAACAC

751  CACTTCATGT CCACCTGGAT TCTCCAACCT AAAGGCAGAC AAAGCGTTTG

801  CGCCGCAGGC GAGTGCAACA TCGACATCAA ACGCCGCAAC GACAAGCTGT

851  ACAGCACCAG CGTCAGCGTG CCTTTAGCCG CCATCCAAAA CGGCGCGAAA

901  GCCGAAGCCT CCATCAACCT CTACGCCGGC CCGCAGACCA CATCCGTCAT

951  CGCAAACATC GCCGACAACC TGCAACTGGC CAAAGACTAC GGCAAAGTAC

1001  ACTGGTTCGC CTCCCCGCTC TTCTGGCTCC TGAACCAACT GCACAACATC

1051  ATCGGCAACT GGGGCTGGGC GATTATCGTT TTAACCATCA TCGTCAAAGC

1101  CGTACTGTAT CCATTGACCA ACGCCTCTTA CCGCTCTATG GCGAAAATGC

1151  GTGCCGCCGC ACCCAAACTG CAAGCCATCA AGAGAAAATA CGGCGACGAC

1201  CGTATGGCGC AACAACAGGC GATGATGCAG CTTTACACAG ACGAGAAAAT
```

```
-continued
1251    CAACCCGCTG GGCGGCTGCC TGCCTATGCT GTTGCAAATC CCCGTCTTCA

1301    TCGGATTGTA TTGGGCATTG TTCGCCTCCG TAGAATTGCG CCAGGCACCT

1351    TGGCTGGGTT GGATTACCGA CCTCAGCCGC GCCGACCCCT ACTACATCCT

1401    GCCCATCATT ATGGCGGCAA CGATGTTCGC CCAAACTTAT CTGAACCCGC

1451    CGCCGACCGA CCCGATGCAG GCGAAAATGA TGAAAATCAT GCCGTTGGTT

1501    TTCTCCGTCA TGTTCTTCTT CTTCCCTGCC GGTCTGGTAT TGTACTGGGT

1551    AGTCAACAAC CTCCTGACCA TCGCCCAGCA ATGGCACATC AACCGCAGCA

1601    TCGAAAAACA ACGCGCCCAA GGCGAAGTCG TTTCCTAA
```

This corresponds to the amino acid sequence (SEQ ID NO: 52; ORF11-1):

```
  1     MDFKRLTAFF AIALVIMIGW EKMFPTPKPV PAPQQAAQQQ AVTASAEAAL

51     APATPITVTT DTVQAVIDEK SGDLRRLTLL KYKATGDENK PFILFGDGKE

101     YTYVAQSELL DAQGNNILKG IGFSAPKKQY SLEGDKVEVR LSAPETRGLK

151     IDKVYTFTKG SYLVNVRFDI ANGSGQTANL SADYRIVRDH SEPEGQGYFT

201     HSYVGPVVYT PEGNFQKVSF SDLDDDAKSG KSEAEYIRKT PTGWLGMIEH

251     HFMSTWILQP KGRQSVCAAG ECNIDIKRRN DKLYSTSVSV PLAAIQNGAK

301     AEASINLYAG PQTTSVIANI ADNLQLAKDY GKVHWFASPL FWLLNQLHNI

351     IGNWGWAIIV LTIIVKAVLY PLTNASYRSM AKMRAAAPKL QAIKEKYGDD

401     RMAQQQAMMQ LYTDEKINPL GGCLPMLLQI PVFIGLYWAL FASVELRQAP

451     WLGWITDLSR ADPYYILPII MAATMFAQTY LNPPPTDPMQ AKMMKIMPLV

501     FSVMFFFFPA GLVLYWVVNN LLTIAQQWHI NRSIEKQRAQ GEVVS*
```

Computer analysis of this amino acid sequence gave the following results:
Homology with a 60 kDa Inner-membrane Protein (Accession P25754) (SEQ ID NO: 1117) of *Pseudomonas putida*

ORF11 (SEQ ID NO: 50) and the 60 kDa protein (SEQ ID NO: 1117) show 58% aa identity in 229 aa overlap (BLASTp).

```
ORF11    2 LYAGPQTTSVIANIADNLQLAKDYGKVHWFASPLFWLLNQLHNIIGNWGWAIIVLTIIVK   61
           LYAGP+   S +   ++   L+L  DYG + + A P+FWLL  +H+++GNWGW+IIVLT+++K
60K    324 LYAGPKIQSKLKELSPGLELTVDYGFLWFIAQPIFWLLQHIHSLLGNWGWSIIVLTMLIK  383

ORF11   62 AVLYPLTNASYRSMAKMRAAAPKLQAIKEKYGDDRXXXXXXXXXXLYTDEKINPLGGCLPM  121
           + +PL+ ASYRSMA+MRA APKL A+KE++GDDR          LY EKINPLGGCLP+
60K    384 GLFFPLSAASYRSMARMRAVAPKLAALKERFGDDRQKMSQAMMELYKKEKINPLGGCLPI  443

ORF11  122 LLQIPVFIGLYWALFASVELRQAPWLGWITDLSRADPYYILPIIMAATMFAQTYLNPPPT  181
           L+Q+PVF+ LYW L  SVE+RQAPW+ WITDLS  DP++ILPIIM ATMF Q  LNP P
60K    444 LVQMPVFLALYWVLLESVEMRQAPWILWITDLSIKDPFFILPIIMGATMFIQQRLNPTPP  503

ORF11  182 DPMQAKMMKIMPLVXXXXXXXXXPAGXVLYWVVNNLLTIAQQWHINRSIE           230
           DPMQAK+MK+MP++         PAG VLYWVVNN L+I QQW+I R IE
60K    504 DPMQAKVMKMMPIIFTFFFLWFPAGLVLYWVVNNCLSISQQWYITRRIE           552
```

Homology with a Predicted ORF from *N.meningitidis* (Strain A)

ORF11 (SEQ ID NO: 50) shows 97.9% identity over a 240aa overlap with an ORF (ORF11a) (SEQ ID NO: 54) from strain A of *N. meningitidis*:

```
                                    10        20        30
orf11.pep                   NLYAGPQTTSVIANIADNLQLAKDYGKVHW
                            ||||||||||||||||||||| ||||||||
orf11a    IKRRNDKLYSTSVSVPLAAIQNGAKSXASINLYAGPQTTSVIANIADNLQLXKDYGKVHW
              280       290       300       310       320       330

40        50        60        70        80        90
orf11.pep FASPLFWLLNQLHNIIGNWGWAIIVLTIIVKAVLYPLTNASYRSMAKMRAAAPKLQAIKE
          ||||||||||||||||||||||||||||||||||||||||||||||||||||||||||||
orf11a    FASPLFWLLNQLHNIIGNWGWAIIVLTIIVKAVLYPLTNASYRSMAKMRAAAPKLQAIKE
              340       350       360       370       380       390

100       110       120       130       140       150
orf11.pep KYGDDRMAQQQAMMQLYTDEKINPLGGCLPMLLQIPVFIGLYWALFASVELRQAPWLGWI
          ||||||||||||||||||||||||||||||||||||||||||||||||||||||||||||
orf11a    KYGDDRMAQQQAMMQLYTDEKINPLGGCLPMLLQIPVFIGLYWALFASVELRQAPWLGWI
              400       410       420       430       440       450

160       170       180       190       200       210
orf11.pep TDLSRADPYYTLPIIMAATMFAQTYLNPPPTDPMQAKMMKIMPLVFSXXFFFFPAGXVLY
          ||||||||||||||||||||||||||||||||||||||||||||| ||||| |||| |||
orf11a    TDLSRADPYYTLPIIMAATMFAQTYLNPPPTDPMQAKMMKIMPLVXSXXFFXFPAGLVLY
              460       470       480       490       500       510

220       230       240
orf11.pep WVVNNLLTIAQQWHINRSIEKQRAQGEVVSX
          || :||||||||||||||||||||||||||||
orf11a    WVINNLLTIAQQWHINRSIEKQRAQGEVVSX
              520       530       540
```

The complete length ORF11a nucleotide sequence (SEQ ID NO: 53) is:

```
  1  ANGGATTTTA AAAGACTCAC NGNGTTTTTC GCCATCGCAC TGGTGATTAT
 51  GATCGGATNG NAAANGATGT TCCCCACTCC GAAGCCCGTC CCCGCGCCCC
101  AACAGACGGC ACAACAACAG GCCGTAANCG CTTCCGCCGA AGCCGCGCTC
151  GCGCCCGNAN CGCCGATTAC CGTAACGACC GACACGGTTC AAGCCGTCAT
201  TGATGAAAAA AGCGGCGACC TGCGCCGGCT GACCCTGCTC AAATACAAAG
251  CAACCGGCGA CNAAAATAAA CCGTTCATCC TGTTTGGCGA CGGCAAANAA
301  TACACCTACN TCGCCCANTC CGAACTTTTG GACGCGCAGG GCAACAACAT
351  TCTAAAAGGC ATCGGCTTTA GCGCACCGAA AAAACAGTAC AGCTTGGAAG
401  GCGACAAAGT TGAAGTCCGC CTGAGCGCAC CTGAAACACG CGGTCTGAAA
451  ATCGACAAAG TTTATACTTT CACCAAAGGC AGCTATCGGG TCAACGTCCG
501  CTTCGACATC GCCAACGGCA GCGGTCAAAC CGCCAACCTG AGCGCGGACT
551  ACCGCATCGT CCGCGACCAC AGCGAACCCG AGGGTCAAGG CTACTTTACC
601  CACTCTTACG TCGGCCCTGT TGTTTATACC CCTGAAGGCA ACTTCCAAAA
651  AGTCAGCTTC TCCGACTTGG ACGACGATGC CAANTCCGGN AAATCCGAGG
701  CCGAATACAT CCGCAAAACC CNGACCGGCT GGCTCGGCAT GATTGAACAC
751  CACTTCATGT CCACCTGGAT CCTCCAACCC AAAGGCGGAC AAAGCGTTTG
801  CGCCGCTGGC GACTGCNGTA TNGACATCAA ACGCCGCAAC GACAAGCTGT
851  ACAGCACCAG CGTCAGCGTG CCTTTAGCCG CTATCCAAAA CGGTGCGAAA
```

```
-continued
 901   TCCNAAGCCT CCATCAACCT CTACGCCGGC CCACAGACCA CATCNGTTAT

951   CGCAAACATC GCCGACAACC TGCAACTGGN CAAAGACTAC GGCAAAGTAC

1001   ACTGGTTCGC CTCCCCCCTC TTTTGGCTTT TGAACCAACT GCACAACATC

1051   ATCGGCAACT GGGGCTGGGC GATTATCGTT TTAACCATCA TCGTCAAAGC

1101   CGTACTGTAT CCATTGACCA ACGCCTCTTA CCGTTCGATG GCGAAAATGC

1151   GTGCCGCCGC GCCCAAACTG CAAGCCATCA AAGAGAAATA CGGCGACGAC

1201   CGTATGGCGC AGCAACAAGC CATGATGCAG CTTTACACAG ACGAGAAAAT

1251   CAACCCGCTG GGCGGCTGCC TGCCTATGCT GTTGCAAATC CCCGTCTTCA

1301   TCGGATTGTA TTGGGCATTG TTCGCCTCCG TAGAATTGCG CCAGGCACCT

1351   TGGCTGGGTT GGATTACCGA CCTCAGCCGC GCCGACCCNT ACTACATCCT

1401   GCCCATCATT ATGGCGGCAA CGATGTTCGC CCAAACCTAT CTGAACCCGC

1451   CGCCGACCGA CCCGATGCAG GCGAAAATGA TGAAAATCAT GCCTTTGGTT

1501   NTNTCNNNNA NGTTCTTCNN CTTCCCTGCC GGTCTGGTAT TGTACTGGGT

1551   GATCAACAAC CTCCTGACCA TCGCCCAGCA ATGGCACATC AACCGCAGCA

1601   TCGAAAAACA ACGCGCCCAA GGCGAAGTCG TTTCCTAA
```

This encodes a protein having amino acid sequence (SEQ ID NO: 54):

```
  1   XDFKRLTXFF AIALVIMIGX XXMFPTPKPV PAPQQTAQQQ AVXASAEAAL

51   APXXPITVTT DTVQAVIDEK SGDLRRLTLL KYKATGDXNK PFILFGDGKX

101   YTYXAXSELL DAQGNNILKG IGFSAPKKQY SLEGDKVEVR LSAPBTRGLK

151   IDKVYTFTKG SYLVNVRFDI ANGSGQTANL SADYRIVRDH SEPEGQGYFT

201   HSYVGPVVYT PEGNFQKVSF SDLDDDAXSG KSEAEYIRKT XTGWLGMIEH

251   HFMSTWILQP KGGQSVCAAG DCXXDIKRRN DKLYSTSVSV PLAAIQNGAK

301   SXASINLYAG PQTTSVIANI ADNLQLXKDY GKVHWFASPL FWLLNQLHNI

351   IGNWGWAIIV LTIIVKAVLY PLTNASYRSM AKMRAAAPKL QAIKEKYGDD

401   RMAQQQAMMQ LYTDEKINPL GGCLPMLLQI PVFTGLYWAL FASVELRQAP

451   WLGWITDLSR ADPYYILPII MAATMFAQTY LNPPPTDPMQ AKMMKIMPLV

501   XSXXFFXFPA GLVLYWVINN LLTTAQQWHI NRSIEKQRAQ GEVVS*
```

ORF11a (SEQ ID NO: 54) and ORF11-1 (SEQ ID NO: 52) show 95.2% identity in 544 aa overlap:

```
                    10         20         30         40         50         60
orf11a.pep  XDFKRLTXFFAIALVIMIGXXXMFPTPKPVPAPQQTAQQQAVXASAEAALAPXXPITVTT
            ||||||  ||||||||||||   ||||||||||||||||:||||||:||||||||  ||||||
orf11-1     MDFKRLTAFFAIALVIMIGWEKMFPTPKPVPAPQQAAQQQAVTASAEAALAPATPITVTT
                    10         20         30         40         50         60

70         80         90        100        110        120
orf11a.pep  DTVQAVIDEKSGDLRRLTLLKYKATGDXNKPFILFGDGKXYTYXAXSELLDAQGNNILKG
            ||||||||||||||||||||||||||||| |||||||||||  | | ||||||||||||||
orf11-1     DTVQAVIDEKSGDLRRLTLLKYKATGDENKPFILFGDGKEYTYVAQSELLDAQGNNILKG
                    70         80         90        100        110        120
```

```
                      -continued
              130       140       150       160       170       180
orf11a.pep    IGFSAPKKQYSLEGDKVEVRLSAPETRGLKIDKVYTFTKGSYLVVVRFDIANGSGQTANL
              ||||||||||||||||||||||||||||||||||||||||||||||||||||||||||||
orf11-1       IGFSAPKKQYSLEGDKVEVRLSAPETRGLKIDKVYTFTKGSYLVVVRFDIANGSGQTANL
              130       140       150       160       170       180

190       200       210       220       230       240
orf11a.pep    SADYRIVRDHSEPEGQGYFTHSYVGPVVYTPEGNFQKVSFSDLDDDAXSGKSEAEYIRKT
              |||||| ||||||||||||||||||||||||||||||||||||| |||||||||||||||
orf11-1       SADYRTVRDHSEPEGQGYFTHSYVGPVVYTPEGNFQKVSFSDLDDDAKSGKSEAEYIRKT
              190       200       210       220       230       240

250       260       270       280       290       300
orf11a.pep    XTGWLGMIEHHFMSTWILQPKGGQSVCAAGDCXXDIKRRNDKLYSTSVSVPLAAIQNGAK
               ||||||||||||||||||||||| ||||||:| |||||||||||||||||||||||||||
orf11-1       PTGWLGMIEHHFMSTWILQPKGRQSVCAAGECNIDIKRRNDKLYSTSVSVPLAAIQNGAK
              250       260       270       280       290       300

310       320       330       340       350       360
orf11a.pep    SXASINLYAGPQTTSVIANIADNLQLXKDYGKVHWFASPLFWLLNQLHNIIGNWGWAIIV
              : ||||||||||||||||||||||| |||||||||||||||||||||||||||||||||
orf11-1       AEASINLYAGPQTTSVIANIADNLQLAKDYGKVHWFASPLFWLLNQLHNIIGNWGWAIIV
              310       320       330       340       350       360

370       380       390       400       410       420
orf11a.pep    LTIIVKAVLYPLTNASYRSMAKMRAAAPKLQAIKEKYGDDRMAQQQAMMQLYTDEKINPL
              ||||||||||||||||||||||||||||||||||||||||||||||||||||||||||||
orf11-1       LTIIVKAVLYPLTNASYRSMAKMRAAAPKLQAIKEKYGDDRMAQQQAMMQLYTDEKINPL
              370       380       390       400       410       420

430       440       450       460       470       480
orf11a.pep    GGCLPMLLQIPVFIGLYWALFASVELRQAPWLGWITDLSRADPYYILPIIMAATMFAQTY
              ||||||||||||||||||||||||||||||||||||||||||||||||||||||||||||
orf11-1       GGCLPMLLQIPVFIGLYWALFASVELRQAPWLGWITDLSRADPYYILPIIMAATMFAQTY
              430       440       450       460       470       480

490       500       510       520       530       540
orf11a.pep    LNPPPTDPMQAFMMKIMPLVXSXXFFXFPAGLVLYWVINNLLTIAQQWHINRSIEKQRAQ
              ||||||||||||| ||||||||| || |||||||||||:|||||||||||||||||||||
orf11-1       LNPPPTDPMQAKMMKIMPLVFSVMFFFFPAGLVLYWVVNNLLTIAQQWHINRSIEKQRAQ
              490       500       510       520       530       540 orf11a.pep    GEVVSX
              ||||||
orf11-1       GEVVSX
```

Homology with a Predicted ORF from *N. gonorrhoeae*

ORF11 (SEQ ID NO: 50) shows 96.3% identity over a 240aa overlap with a predicted ORF (ORF11.ng) (SEQ ID NO: 56) from *N. gonorrhoeae*:

```
Orf11     NLYAGPQTTSVIANIADNLQLAKDYGKVHWFASPLFWLLNQLHNIIGNWGWAIIVLT    57
          |||||||||||||||||||||||||||||||||||||||||||||||||||||||:|||
orf11ng   MAVNLYAGPQTTSVIANIADNLQLAKDYGKVHWFASPLFWLLNQLHNIIGNWGWAIVVLT  60 orf11     IIVKAVLYPLTNASYRSMAKMRAAAPKLQAIKEKYGDDRMAQQQAMMQLYTDEKINPLGG 117
          ||||||||||||||||||||||||||||||:||||||||||||||||||:||:||||||
orf11ng   IIVKAVLYPLTNASYRSMAKMRAAAPELQTIKEKYGDDRMAQQQAMMQLFEDEEINPLGG 120 orf11     CLPMLLQIPVFIGLYWALFASVELRQAPWLGWITDLSRADPYYILPIIMAATMFAQTYLN 177
          ||||||||||||||||||||||||||||||||||||||||||||||||||||||||||||
orf11ng   CLPMLLQIPVFIGLYWALFASVELRQAPWLGWITDLSRADPYYILPIIMAATMFAQTYLN 180 orf11     PPPTDPMQAKMMKIMPLVFSXXFFFFFPAGXVLYWVVNNLLTIAQQWHINRSIEKQRAQGE 237
          ||||||||||||||||||||||   |||||| ||||||||||||||||||||||||||||
orf11ng   PPPTDPMQAKMMKIMPLVFSVMFFFFPAGLVLYWVVNNLLTIAQQWHINRSIEKQRAQGE 240 orf11     VVS                                                          240
          |||
orf11ng   VVS                                                          243
```

An ORF11ng nucleotide sequence (SEQ ID NO: 55) was predicted to encode a protein having amino acid sequence (SEQ ID NO: 56):

```
  1 MAVNLYAGPQ TTSVIANIAD NLQLAKDYGK VHWFASPLFW LLNQLHNIIG
 51 NWGWAIVVLT IIVKAVLYPL TNASYRSMAK MRAAAPELQT IKEKYGDDRM
101 AQQQAMMQLF EDEEINPLGG CLPMLLQIPV FIGLYWALFA SVELRQAPWL
151 GWITDLSRAD PYYILPIIMA ATMFAQTYLN PPPTDPMQAK MMKIMPLVFS
201 VMFFFFPAGL VLYWVVNNLL TIAQQWHINR SIEKQRAQGE VVS*
```

Further sequence analysis revealed the complete gonococcal DNA sequence (SEQ ID NO: 57) to be:

```
   1 ATGGATTTTA AAAGACTCAC GGCGTTTTTC GCCATCGCGC TGGTGATTAT
  51 GATCGGCTGG CAAAAAATGT TCCCCACCCC GAAACCCGTC CCCGCGCCCC
 101 AACAGGCGGC ACAAAAACAG GCAGCAACCG CTTCCGCCGA AGCCGCGCTC
 151 GCGCCCGCAA CGCCGATTAC CGTAACGACC GACACGGTTC AAGCCGTTAT
 201 TGATGAAAAA AGTGGCGACC TGCGCCGGCT GACCCTGCTC AAATACAAAG
 251 CAACCGGCGA CGAAAACAAA CCGTTCGTCC TGTTTGGCGA CGGCAAAGAA
 301 TACACCTACG TCGCCCAATC CGAACTTTTG GACGCGCAGG GCAACAACAT
 351 TCTGAAAGGC ATCGGCCTTA GCGCACCGAA AAAACAGTAC ACCCTCAACG
 401 GCGACACAGT CGAAGTCCGC CTGAGCGCGC CCGAAACCAA CGGACTGAAA
 451 ATCGACAAAG TCTATACCTT TACCAAAGAC AGCTATCTGG TCAACGTCCG
 501 CTTCGACATC GCCAACGGCA GCGGTCAAAC CGCCAACCTG AGCGCGGACT
 551 ACCGCATCGT CCGCGACCAC AGCGAACCCG AGGGTCAAGG CTACTTTACC
 601 CACTCTTACG TCGGCCCTGT TGTTTATACC CCTGAAGGCA ACTTCCAAAA
 651 AGTCAGCTTC TCCgacTTgg acgACGATGC gaaaTccggc aaATccgagg
 701 ccgaatacaT CCGCAAAACC ccgaccggtt ggctcggcat gattgaacac
 751 cacttcatgt ccacctggat cctccAAcct aaaggcggcc aaaacgtttg
 801 cgcccaggga gactgccgta tcgacattaa aCgccgcaac gacaagctgt
 951 acagcgcaag cgtcagcgtg cctttaaccg ctatcccaac ccgggggcca
 901 aaaccgaaaa tggcggTCAA CCTGTATGCC GGTCCGCAAA CCACATCCGT
 951 TATCGCAAAC ATCGCcgacA ACCTGCAACT GGCAAAAGAC TACGGTAAAG
1001 TACACTGGTT CGCATCGCCG CTCTTCTGGC TCCTGAACCA ACTGCACAAC
1051 ATTATCGGCA ACTGGGGCTG GCAATCGTC GTTTTGACCA TCATCGTCAA
1101 AGCCGTACTG TATCCATTGA CCAACGcctc ctACCGTTCG ATGGCGAAAA
1151 TGCGTGccgc cgcacCcaaA CTGCAGACCA TCAAAGAAAA ATAcgGCGAC
1201 GACCGTATGG CGCAACAGCA AGCGATGATG CAGCTTTACA AAgacgAGAA
1251 AATCAACCCG CTGGGCGGCT GTctgcctat gctgttgCAA ATCCCCGTCT
1301 TCATCGGCTT GTACTGGGCA TTGTTCGCCT CCGTAGAATT GCGCCAGGCA
1351 CCTTGGCTGG GCTGGATTAC CGACCTCAGC CGCGCCGACC CCTACTACAT
1401 CCTGCCCATC ATTATGGCGG CAACGATGTT CGCCCAAACC TATCTGAACC
1451 CGCCGCCGAC CGACCCGATG CAGGCGAAAA TGATGAAAAT CATGCCGTTG
```

```
1501    GTTTTCTCCG TCATGTTCTT CTTCTTCCCT GCCGGTTTGG TTCTCTACTG

1551    GGTGGTCAAC AACCTCCTGA CCATCGCCCA GCAGTGGCAC ATCAACCGCA

1601    GCATCGAAAA ACAACGCGCC CAAGGCGAAG TCGTTTCCTA A
```

This encodes a protein having amino acid sequence (SEQ ID NO: 58; ORF11ng-1):

```
  1   MDFKRLTAFF AIALVIMIGW EKMFPTPKPV PAPQQAAQKQ AATASAEAAL

51   APATPITVTT DTVQAVIDEK SGDLRRLTLL KYKATGDENK PFVLFGDGKE

101   YTYVAQSELL DAQGNNILKG IGFSAPKKQY TLNGDTVEVR LSAPETNGLK

151   IDKVYTFTKD SYLVNYRFDI ANGSGQTANL SADYRIVRDH SEPEGQGYFT

201   HSYVGPVVYT PEGNFQKVSF SDLDDDAKSG KSEAEYIRKT PTGWLGMIEH

251   HFMSTWILQP KGGQNVCAQG DCRIDIKRRN DKLYSASVSV PLTAIPTRGP

301   KPKMAVNLYA GPQTTSVIAN IADNLQLAKD YGKVHWFASP LFWLLNQLHN

351   IIGNWGWAIV VLTIIVKAVL YPLTNASYRS MAKMRAAAPK LQTIKEKYGD

401   DRMAQQQAMM QLYKDEKINP LGGCLPMLLQ IPVFIGLYWA LFASVELRQA

451   PWLGWITDLS RADPYYILPI IMAATMPAQT YLNPPPTDPM QAKNMKIMPL

501   VFSVMFFFFP AGLVLYWVVN NLLTIAQQWH INRSIEKQRA QGEVVS*
```

ORF11ng-1 (SEQ ID NO: 58) and ORF11-1 (SEQ ID NO: 52) shown 95.1% identity in 546 aa overlap:

```
                      10         20         30         40         50         60
orf11ng-1.pep  MDFKRLTAFFAIALVIMIGWEKMFPTPKPVPAPQQAAQKQAATASAEAALAPATPITVTT
               ||||||||||||||||||||||||||||||||||||||:||:||||||||||||||||||
orf11-1        MDFKRLTAFFAIALVIMIGWEKMFPTPKPVPAPQQAAQQQAVTASAEALLAPATPITVTT
                      10         20         30         40         50         60

70         80         90        100        110        120
orf11ng-1.pep  DTVQAVIDEKSGDLRRLTLLKYKATGDENKPFVLFGDGKEYTYVAQSELLDAQGNNILKG
               ||||||||||||||||||||||||||||||||:|||||||||||||||||||||||||||
orf11-1        DTVQAVIDEKSGDLRRLTLLKYKATGDENKPFILFGDGKEYTYVAQSELLDAQGNNILKG
                      70         80         90        100        110        120

130        140        150        160        170        180
orf11ng-1.pep  IGFSAPKKQYTLNGDTVEVRLSAPETNGLKIDKVYTFTKDSYLVNYRFDIANGSGQTANL
               ||||||||||:|:||  |||||||||||:||||||||||:||||||||||||||||||||
orf11-1        IGFSAPKKQYSLEGDKVEVRLSAPETRGLKIDKVYTFTKGSYLVNYRFDIANGSGQTANL
                      130        140        150        160        170        180

190        200        210        220        230        240
orf11ng-1.pep  SADYRIVRDHSEPEGQGYFTHSYVGPVVYTPEGNFQKVSFSDLDDDAKSGKSEAEYIRKT
               ||||||||||||||||||||||||||||||||||||||||||||||||||||||||||||
orf11-1        SADYRIVRDHSEPEGQGYFTHSYVGPVVYTPEGNFQKVSFSDLDDDAKSGKSEAEYIRKT
                      190        200        210        220        230        240

250        260        270        280        290        300
orf11ng-1.pep  PTGWLGMIEHHFMSTWILQPKGGQNVCAQGDCRIDIKRRNDKLYSASVSVPLTAIPTRGP
               |||||||||||||||||||||:|||  |:|  ||||||||||||:||||||:||   : |
orf11-1        PTGWLGMIEHHFMSTWILQPKGRQSVCAAGECNIDIKRRNDKLYSTSVSVPLAAIQN-GA
                      250        260        270        280        290

310        320        330        340        350        360
orf11ng-1.pep  KPKMAVNLYAGPQTTSVIANIADNLQLAKDYGKVHWFASPLFWLLNQLHNIIGNWGWAIV
               | : ::|||||||||||||||||||||||||||||||||||||||||||||||||||||:
orf11-1        KAEASINLYAGPQTTSVIANIADNLQLAKDYGKVHWFASPLFWLLNQLHNIIGNWGWAII
                      300        310        320        330        340        350
```

-continued

```
                 370       380       390       400       410       420
orf11ng-1.pep    VLTIIVKAVLYPLTNASYRSMAKMRAAAPKLQTIKEKYGDDRMAQQQAMMQLYKDEKINP
                 ||||||||||||||||||||||||||||||||:|||||||||||||||||| ||||||
orf11-1          VLTIIVKAVLYPLTNASYRSMAKMRAAAPKLQAIKEKYGDDRMAQQQAMMQLYTDEKINP
                 360       370       380       390       400       410

430       440       450       460       470       480
orf11ng-1.pep    LGGCLPMLLQIPVFIGLYWALFASVELRQAPWLGWITDLSRADPYYILPIIMAATMFAQT
                 ||||||||||||||||||||||||||||||||||||||||||| ||||||||||||||||
orf11-1          LGGCLPMLLQIPVFIGLYWALFASVELRQAPWLGWITDLSRADPYYILPIIMAATMFAQT
                 420       430       440       450       460       470

490       500       510       520       530       540
orf11ng-1.pep    YLNPPPTDPMQAKMMKIMPLVFSVMFFFFPAGLVLYNVVNNLLTIAQQWHINRSIEKQRA
                 |||||||||||||||||||||||||||| ||||||||| |||||||||||||||||||||
orf11-1          YLNPPPTDPMQAKMMKIMPLVFSVMPFFFPAGLVLYWVVNNLLTIAQQWHINRSIEKQRA
                 480       490       500       510       520       530 orf11ng-1.pep    QGEVVSX
                 |||||||
orf11-1          QGEVVSX
                 540
```

In addition, ORF11ng-1 (SEQ ID NO: 58) shows significant homology with an inner-membrane protein from the database (accession number p25754) (SEQ ID NO: 1117):

```
ID   60IM_PSEPU      STANDARD;      PRT;   560 AA.
AC   P25754;
DT   01-MAY-1992 (REL. 22, CREATED)
DT   01-MAY-1992 (REL. 22, LAST SEQUENCE UPDATE)
DT   01-NOV-1995 (REL. 32, LAST ANNOTATION UPDATE)
DE   60 KD INNER-MEMBRANE PROTEIN. . . .

SCORES       Init1: 1074 Initn: 1293 Opt: 1103
Smith-Waterman score: 1406;   41.5% identity in 574 aa overlap 10        20                  30        40
orf11ng-1.pep    MDFKR---LTAFFAIALVIMIGW-----EKMFPT------------PKPVPAPQQAAQKQ
                 ||:||   ::|: :::  |:::  |      :  :||      |   ||  |||::  :
p25754           MDIKRTILIAALAVVSYVMVLKWNDDYGQAALPTQNTAASTVAPGLPDGVPAGNNGASAD
                         10        20        30        40        50        60

50        60        70        80        90
orf11ng-1.pep    AATASAEAALAPATPIT-------VTTDTVQAVIDEKSGDLRRLTLLKYKATGDE-NKPF
                 : :|:||:: | :|::        | ||::: :||  :||: :|:|  ||  |: | ||
p25754           VPSANAESSPAELAPVALSKDLIRVKTDVLELAIDPVGGDIVQLNLPKYPRRQDHPNIPF
                         70        80        90       100       110       120

100       110       120       130       140
orf11ng-1.pep    VLFGDKEYTYVAQSELLDAQGNNILKGIG---FSAPKKQYTL-NGD---TVEVRLSAPE
                 || :|  | :|:||| |  ::| :  ::|   ::| :|:|  | :|:   :|::::|
p25754           QLFDNGGERVYLAQSGLTGTDGPDA-RASGRPLYAAEQKSYQLADGQEQLVVDLKFS---
                         130       140       150       160       170

150       160       170       180       190       200
orf11ng-1.pep    TNGLKIDKVYTFTKDSYLVNVRFDIANGSGQTANLSADYRIVRDHS-EPEGQGYF-THSY
                 |||::  |  |::|  |  |||: |  ::   :  :    :     :|  |  |   :|
p25754           DNGVNYIKRFSFKRGEYDLNVSYLIDNQSGQAWNGNMFAQLKRDASGDPSSSTATGTATY
                         180       190       200       210       220       230

210       220       230       240       250       260
orf11ng-1.pep    VGPVVYTPEGNFQKVSFSDLDDDAKSGKSEAEYIRKTPTGWLGMIEHHFMSTWILQPKGG
                 :|  :::|    ::|||::|:|   |:: :|   :: ||:: ::|:::|:::||    |:
p25754           LGAALWTASEPYKKVSMKDID---KGSLKE-----NVSGGWVAWLQHYFVTAWI-PAKSD
                         240       250       260       270       280

270       280       290       300       310       320
orf11ng-1.pep    QNVCAQGDCRIDIKRRNDKLYSASVSVPLTAIPTRGPKPKMAVNLYAGPQTTSVIANIAD
                 :||      :: :: ::   |   : : |: ::|    |  ::  |||||:   | :::
p25754           NNV-------VQTRKDSQGNYIIGYTGPVISVPA-GGKVETSALLYAGPKIQSKLKELSP
                         290       300       310       320       330
```

```
                          -continued
                330       340       350       360       370       380
orf11ng-1.pep   NLQLAKDYGKVHWF-ASPLFWLLNQLHNIIGNWGWAIVVLTIIVKAVLYPLTNASYRSMA
                :|:|:  |||  :  ||  |:|:||||:::|:::||||||:|:|||:::|::::||: ||||||
p25754          GLELTVDYGFL-WFIAQPIFWLLQHIHSLLGNWGWSIIVLTMLIKGLFFPLSAASYRSMA
                340       350       360       370       380       390

390       400       410       420       430       440
orf11ng-1.pep   KMRAAAPKLQTIKEKYGDDRMAQQQAMMQLYKDEKINPLGGCLPMLLQIPVFIGLYWALF
                :||||:||||  ::||::||||:  ::||||:|||  ||||||||||:|:||::|||:|:
p25754          RMRAVAPKLAALKERFGDDRQKMSQAMMELYKKEKINPLGGCLPILVQMPVFLALYWVLL
                400       410       420       430       440       450

450       460       470       480       490       500
orf11ng-1.pep   ASVELRQAPWLGWITDLSRADPYYILPIIMAATMFAQTYLNPPPTDPMQAKMMKIMPLVF
                |||:||||:  ||||||  ||::||||||:||||  |||  |||||||:||:||::|
p25754          ESVEMRQAPWILWITDLSIKDPFFILPLLMGATMFIQQRLNPTPPDPMQAKVMKMMPIIF
                460       470       480       490       500       510

510       520       530       540
orf11ng-1.pep   SVMFFFFPAGLVLYWVVNNLLTIAQQWHINRSIEKQRAQGEVVSX
                :  :|::||||||||||||||||  |:|:|||:|:| ||
p25754          TFFFLWFPAGLVLYWVVNNCLSISQQWYITRRIRAATKKAAA
                520       530       540       550       560
```

Based on this analysis, including the homology to an inner-membrane protein from *P. putida* and the predicted transmembrane domains (seen in both the meningococcal and gonococcal proteins), it is predicted that the proteins from *N.meningitidis* and *N.gonorrhoeae*, and their epitopes, could be useful antigens for vaccines or diagnostics, or for raising antibodies.

Example 8

The following partial DNA sequence was identified in *N.meningitidis* (SEQ ID NO: 59):

```
  1   ..GCCGTCTTAA TCATCGAATT ATTGACGGGA ACGGTTTATC TTTTGGTTGT
 51     NAGCGCGGCT TTGGCGGGTT CGGGCATTGC TTACGGGCTG ACCGGCAGTA
101     CGCCTGCCGC CGTCTTGACC GNCGCTCTGC TTTCCGCGCT GGGTATTTNG
151     TTCGTACACG CCAAAACCGC CGTTAGAAAA GTTGAAACGG ATTCATATCA
201     GGATTTGGAT GCCGGACAAT ATGTCGAAAT CCTCCGNCAC ACAGGCGGCA
251     ACCGTTACGA AGTT.TTTAT CGCGGTACG. ACTGGCAGGC TCAAAATACG
301     GGGCAAGAAG AGCTTGAACC AGGAACTCGC GCCCTCATTG TCCGCAAGGA
351     AGGCAACCTT CTTATTATCA CACACCCTTA A
       45
```

This corresponds to the amino acid sequence (SEQ ID NO: 60; ORF13):

```
  1   ..AVLIIELLTG TVYLLVVSAA LAGSGIAYGL TGSTPAAVLT XALLSALGIX
 51     FAEAKTAVRK VETDSYQDLD AGQYVEILRH TGGNRYEVXY RGTXWQAQNT
101     GQEELEPGTR ALIVRKEGNL LIITHP*
       55
```

Further sequence analysis elaborated the DNA sequence slightly (SEQ ID NO: 61):

```
  1   ..GCCGTCTTAA TCATCGAATT ATTGACGGGA ACGGTTTATC TTTTGGTTGT
 51     nAGCGCGGCT TTGGCGGGTT CGGGCATTGC TTACGGGCTG ACCGGCAGTA
101     CGCCTGCCGC CGTCTTGACC GnCGCTCTGC TTTCCGCGCT GGGTATTTnG
151     TTCGTACACG CCAAAACCGC CGTTAGAAAA GTTGAAACGG ATTCATATCA
```

-continued

```
201    GGATTTGGAT GCCGGACAAT ATGTCGAAAT CCTCCGACAC ACAGGCGGCA

251    ACCGTTACGA AGTTTTtTAT CGCGGTACGc ACTGGCAGGC TCAAAATACG

301    GGGCAAGAAG AGCTTGAACC AGGAACTCGC GCCCTCATTG TCCGCAAGGA

351    AGGCAACCTT CTTATTATCA CACACCCTTA A
```

This corresponds to the amino acid sequence (SEQ ID NO: 62; ORF13-1):

```
  1  ..AVLIIELLTG TVYLLVVSAA LAGSGIAYGL TGSTPAAVLT XALLSALGIX

51    FVHAKTAVRK VETDSYQDLD AGQYVEILRH TGGNRYEVFY RGTHWQAQNT

101    GQEELEPGTR ALIVRKEGNL LIITHP*
```

Computer analysis of this amino acid sequence gave the following results:
Homology with a Predicted ORF from *N.meningitidis* (Strain A)

ORF13 (SEQ ID NO: 60) shows 92.9% identity over a 126aa overlap with an ORF (ORF13a) (SEQ ID NO: 64) from strain A of *N. meningitidis*:

```
                            10         20         30         40         50
orf13.pep          AVLIIELLTGTVYLLVVSAALAGSGIAYGLTGSTPAAVLTXALLSALGIXF
                   ||||||||||||||||||||||||||||||||||||||| ||||||||| |
orf13a     MTVWFVAAVAVLIIELLTGTVYLLVVSAALAGSGIAYGLTGSTPAAVLTAALLSALGIWF
                   10         20         30         40         50         60

60         70         80         90        100        110
orf13.pep  VHAKTAVRKVETDSYQDLDAGQYVEILRHTGGNRYEVXYRGTXWQAQNTGQEELEPGTRA
           |||||||  ||||||||||||||||:|||||:||||||  |||||||||||||||||||
orf13a     VHAKTAVGKVETDSYQDLDAGQYAEILRHAGGNRYEVFYRGTHWQAQNTGQEELEPGTRA
                    70         80         90        100        110        120

120
orf13.pep  LIVRKEGNLLIITHPX
           ||||||||||||::||
orf13a     LIVRKEGNLLIIAKPX
                   130
```

The complete length ORF13a Nucleotide Sequence (SEQ ID NO: 63) is:

```
  1    ATGACTGTAT GGTTTGTTGC CGCTGTTGCC GTCTTAATCA TCGAATTATT

51    GACGGGAACG GTTTATCTTT TGGTTGTCAG CGCGGCTTTG GCGGGTTCGG

101    GCATTGCTTA CGGGCTGACC GGCAGCACGC CTGCCGCCGT CTTGACCGCC

151    GCTCTGCTTT CCGCGCTGGG TATTTGGTTC GTACACGCCA AAACCGCCGT

201    GGGAAAAGTT GAAACGGATT CATATCAGGA TTTGGATGCC GGGCAATATG

251    CCGAAATCCT CCGGCACGCA GGCGGCAACC GTTACGAAGT TTTTTATCGC

301    GGTACGCACT GGCAGGCTCA AAATACGGGG CAAGAAGAGC TTGAACCAGG

351    AACGCGCGCC CTAATCGTCC GCAAGGAAGG CAACCTTCTT ATCATCGCAA

401    AACCTTAA
```

This encodes a protein having amino acid sequence (SEQ ID NO: 64):

```
  1 MTVWFVAAVA VLIIELLTGT VYLLVVSAAL AGSGIAYGLT GSTPAAVLTA

51 ALLSALGIWF VHAKTAVGKV ETDSYQDLDA GQYAEILRHA GGNRYEVFYR

101 GTHWQAQNTG QEELEPGTRA LIVRKEGNLL IIAKP*
```

ORF13a (SEQ ID NO: 64) and ORF13-1 (SEQ ID NO: 62) show 94.4% identity in 126 aa overlap

```
                    10        20        30        40        50        60
orf13a.pep  MTVWFVAAVAVLIIELLTGTVYLLVVSAALAGSGIAYGLTGSTPAAVLTAALLSALGIWF
                     ||||||||||||||||||||||||||||||||||||||| ||||||||| |
orf13-1               AVLIIELLTGTVYLLVVSAALAGSGIAYGLTGSTPAAVLTXALLSALGIXF
                              10        20        30        40        50

70        80        90       100       110       120
orf13a.pep  VHAKTAVGKVETDSYQDLDAGQYAEILRHAGGNRYEVFYRGTHWQAQNTGQEELEPGTRA
            |||||||| ||||||||||||||:||||:|||||||||||||||||||||||||||||||
orf13-1     VHAKTAVRKVETDSYQDLDAGQYVEILRHTGGNRYEVFYRGTHWQAQNTGQEELEPGTRA
                    60        70        80        90       100       110

130
orf13a.pep  LIVRKEGNLLIIAKPX
            ||||||||||||::||
orf13-1     LIVRKEGNLLIITHPX
                   120
```

Homology with a Predicted ORF from *N.gonorrhoeae*

ORF13 (SEQ ID NO: 60) shows 89.7% identity over a 126aa overlap with a predicted ORF (ORF13.ng) (SEQ ID NO: 66) from *N. gonorrhoeae*:

```
orf13             AVLIIELLTGTVYLLVVSAALAGSGIAYGLTGSTPAAVLTXALLSALGIXF   51
                  ||||||||||||||||||||||||||||||||||||||| ||||||||| |
orf13ng  MTVWFVAAVAVLIIELLTGTVYLLVVSAALAGSGIAYGLTGSTPAAVLTAALLSALGIWF   60 orf13    VHAKTAVRKVETDSYQDLDAGQYVEILRHTGGNRYEVXYRGTXWQAQNTGQEELEPGTRA  111
         |||||||| |||||||||||:|:|:||||:|||||||| |||| |||||||| ||||||
orf13ng  VHAKTAVGKVETDSYQDLDTGKYAEILRYTGGNRYEVFYRGTHWQAQNTGQEVFEPGTRA  120 orf13    LIVRKEGNLLIITHP                                              126
         ||||||||||||::|
orf13ng  LIVRKEGNLLIIANP                                              135
```

The complete length ORF13ng nucleotide sequence (SEQ ID NO: 65) is:

```
  1 ATGACTGTAT GGTTTGTTGC CGCTGTTGCC GTCTTAATCA TCGAATTATT

51 GACGGGAACG GTTTATCTTT TGGTTGTCAG CGCGGCTTTG GCGGGTTCGG

101 GCATTGCCTA CGGGCTGACT GGCAGCACGC CTGCCGCCGT CTTGACCGCC

151 GCACTGCTTT CCGCGCTGGG CATTTGGTTC GTACATGCCA AAACCGCCGT

201 GGGAAAAGTT GAAACGGATT CATATCAGGA TTTGGATACC GGAAAATATG

251 CCGAAATCCT CCGATACACA GGCGGCAACC GTTACGAAGT TTTTTATCGC

301 GGTACGCACT GGCAGGCGCA AAATACGGGG CAGGAAGTGT TTGAACCGGG

351 AACGCGCGCC CTCATCGTCC GCAAAGAAGG TAACCTTCTT ATCATCGCAA

401 ACCCTTAA
```

This encodes a protein having amino acid sequence (SEQ ID NO: 66):

```
  1 MTVWFVAAVA VLIIELLTGT VYLLVVSAAL AGSGIAYGLT GSTPAAVLTA
 51 ALLSALGIWF VHAKTAVGKV ETDSYQDLDT GKYAEILRYT GGNRYEVFYR
101 GTHWQAQNTG QEVFEPGTRA LIVRKEGNLL IIANP*
```

ORF13ng (SEQ ID NO: 66) shows 91.3% identity in 126 aa overlap with ORF13-1 (SEQ ID NO: 62):

```
                       10        20        30        40        50
orf13-1.pep        AVLIIELLTGTVYLLVVSAALAGSGIAYGLTGSTPAAVLTXALLSALGIXF
                   ||||||||||||||||||||||||||||||||||||||||| ||||||| |
orf13ng    MTVWFVAAVAVLIIELLTGTVYLLVVSAALAGSGIAYGLTGSTPAAVLTAALLSALGIWF
                   10        20        30        40        50        60

60        70        80        90       100       110
orf13-1.pep VHAKTAVRKVETDSYQDLDAGQYVEILRHTGNRYEVFYRGTHWQAQNTGQEELEPGTRA
            ||||||| |||||||||||||:|:|:||||:|||||||||||||||||||||| :||||||
orf13ng     VHAKTAVGKVETDSYQDLDTGKYAEILRYTGGNRYEVFYRGTHWQAQNTGQEVFEPGTRA
                   70        80        90       100       110       120

120
orf13-1.pep LIVRKEGNLLIITHPX
            |||||||||||||::||
orf13ng     LIVRKEGNLLIIANPX
                   130
```

Based on this analysis, including the extensive leader sequence in this protein, it is predicted that ORF13 (SEQ ID NO: 60) and ORF13ng (SEQ ID NO: 66) are likely to be outer membrane proteins. Its is thus predicted that the proteins from *N.meningitidis* and *N.gonorrhoeae*, and their epitopes, could be useful antigens for vaccines or diagnostics, or for raising antibodies.

Example 9

The following DNA sequence was identified in *N.meningitidis* (SEQ ID NO: 67):

```
  1 ATGTwTGATT TCGGTTTrGG CGArCTGGTT TTTGTCGGCA TTATCGCCCT
 51 GATwGtCCTC GGCCCCGAAC GCsTGCCCGA GGCCGCCCGC AyCGCCGGAC
101 GGcTCATCGG CAGGCTGCAA CGCTTTGTCG GcAGCGTCAA ACAGGAATTT
151 GACACTCAAA TCGAACTGGA AGAACTGAGG AAGGCAAAGC AGGGATTTGA
201 AGCTGCCGcC GCTCAGGTTC GAGACAGCCT CAAAGAAACC GGTACGGATA
251 TGGAAGGCAA TCTGCACGAC ATTTCCGACG GTCTGAAGCC TTGGGAAAAA
301 CTGCCCGAAC AGCGGACACC TGCCGATTTC GGTGTCGATG AAAACGGCAA
351 TCCGCT.TCC CGATGCGGCA AACACCCTAT CAGACGGCAT TTCCGACGTT
401 ATGCCGTC..
```

This corresponds to the amino acid sequence (SEQ ID NO: 68; ORF2):

```
  1 MXDFGLGELV FVGIIALIVL GPERXPEAAR XAGRLIGRLQ RFVGSVKQEF
 51 DTQIELEELR KAKQEFEAAA AQVRDSLKET GTDMEGNLHD ISDGLKPWEK
101 LPEQRTPADF GVDENGNPXS RCGKHPIRRH FRRYAV..
```

Further work revealed the complete nucleotide sequence (SEQ ID NO: 69):

```
  1 ATGTTTGATT TCGGTTTGGG CGAGCTGGTT TTTGTCGGCA TTATCGCCCT
 51 GATTGTCCTC GGCCCCGAAC GCCTGCCCGA GGCCGCCCGC ACCGCCGGAC
101 GGCTCATCGG CAGGCTGCAA CGCTTTGTCG GCAGCGTCAA ACAGGAATTT
151 GACACTCAAA TCGAACTGGA ACAACTGAGG AAGGCAAAGC AGGAATTTGA
201 AGCTGCCGCC GCTCAGGTTC GAGACAGCCT CAAAGAAACC GGTACGGATA
251 TGGAAGGCAA TCTGCACGAC ATTTCCGACG GTCTGAAGCC TTGGGAAAAA
301 CTGCCCGAAC AGCGGACACC TGCCGATTTC GGTGTCGATG AAAACGGCAA
351 TCCGCTTCCC GATGCGGCAA ACACCCTATC AGACGGCATT TCCGACGTTA
401 TGCCGTCCGA ACGTTCCTAC GCTTCCGCCG AAACCCTTGG GGACAGCGGG
451 CAAACCGGCA GTACAGCCGA ACCCGCGGAA ACCGACCAAG ACCGCGCATG
501 GCGGGAATAC CTGACTGCTT CTGCCGCCGC ACCCGTCGTA CAGACCGTCG
551 AAGTCAGCTA TATCGATACT GCTGTTGAAA CGCCTGTTCC GCACACCACT
601 TCCCTGCGCA AACAGGCAAT AAGCCGCAAA CGCGATTTTC GTCCGAAACA
651 CCGCGCCAAA CCTAAATTGC GCGTCCGTAA ATCATAA
```

This corresponds to the amino acid sequence (SEQ ID NO: 70; ORF2-1):

```
  1 MFDFGLGELV FVGIIALIVL GPERLPEAAR TAGRLIGRLQ RFVGSVKQEF
 51 DTQIELEELR KAKQEFEAAA AQVRDSLKET GTDMEGNLHD ISDGLKPWEK
101 LPEQRTPADF GVDENGNPLP DAANTLSDGI SDVMPSERSY ASAETLGDSG
151 QTGSTAEPAE TDQDRAWREY LTASAAAPVV QTVEVSYIDT AVETPVPHTT
201 SLRKQAISRK RDFRPKHRAK PKLRVRKS*
```

Further work identified the corresponding gene in strain A of *N.meningitidis* (SEQ ID NO: 71):

```
  1 ATGTTTGATT TCGGTTTGGG CGAGCTGGTT TTTGTCGGCA TTATCGCCCT
 51 GATTGTCCTC GGCCCCGAAC GCCTGCCCGA GGCCGCCCGC ACCGCCGGAC
101 GGCTCATCGG CAGGCTGCAA CGCTTTGTCG GCAGCGTCAA ACAGGAATTT
151 GACACGCAAA TCGAACTGGA AGAACTAAGG AAGGCAAAGC AGGAATTTGA
201 AGCTGCCGCT GCTCAGGTTC GAGACAGCCT CAAAGAAACC GGTACGGATA
251 TGGAGGGTAA TCTGCACGAC ATTTCCGACG GTCTGAAGCC TTGGGAAAAA
301 CTGCCCGAAC AGCGCACGCC TGCTGATTTC GGTGTCGATG AAAACGGCAA
351 TCCCTTTCCC GATGCGGCAA ACACCCTATT AGACGGCATT TCCGACGTTA
401 TGCCGTCCGA ACGTTCCTAC GCTTCCGCCG AAACCCTTGG GGACAGCGGG
451 CAAACCGGCA GTACAGCCGA ACCCGCGGAA ACCGACCAAG ACCGTGCATG
501 GCGGGAATAC CTGACTGCTT CTGCCGCCGC ACCCGTCGTA CAGACCGTCG
551 AAGTCAGCTA TATCGATACC GCTGTTGAAA CCCCTGTTCC GCATACCACT
601 TCGCTGCGTA AACAGGCAAT AAGCCGCAAA CGCGATTTGC GTCCTAAATC
651 CCGCGCCAAA CCTAAATTGC GCGTCCGTAA ATCATAA
```

This encodes a protein having amino acid sequence (SEQ ID) NO: 72; ORF2a):

```
  1 MFDFGLGELV FVGIIALIVL GPERLPEAAR TAGRLIGRLQ RFVGSVKQEF

51 DTQIELEELR KAKQEFEAAA AQVRDSLKET GTDMEGNLHD ISDGLKPWEK

101 LPEQRTPADF GVDENGNPFP DAANTLLDGI SDVMPSERSY ASAETLGDSG

151 QTGSTAEPAE TDQDRAWREY LTASAAAPVV QTVEVSYIDT AVETPVPHTT

201 SLRKQAISRK RDLRPKSRAK PKLRVRKS*
```

The originally-identified partial strain B sequence (ORF2) (SEQ ID NO: 68) shows 97.5% identity over a 118aa overlap with ORF2a (SEQ ID NO: 72):

```
                  10        20        30        40        50        60
orf2.pep MXDFGLGELVFVGIIALIVLGPERXPEAARXAGRLIGRLQRFVGSVKQEFDTQIELEELR
            ||||||||||||||||||| |||||:||||||||||||||||||||||||||||||
orf2a    MFDFGLGELVFVGIIALIVLGPERLPEAARTAGRLIGRLQRFVGSVKQEFDTQIELEELR
                  10        20        30        40        50        60

70        80        90       100       110       120
orf2.pep KAKQEFEAAAAQVRDSLKETGTDMEGNLHDISDGLKPWEKLPEQRTPADFGVDENGNPXS
         |||||||||||||||||||||||||||||||||||||||||||||||||||||||||
orf2a    KAKQEFEAAAAQVRDSLKETGTDMEGNLHDISDGLKPWEKLPEQRTPADFGVDENGNPFP
                  70        80        90       100       110       120

130
orf2.pep RCGKHPIRRHFRRYAV orf2a    DAANTLLDGISDVMPSERSYASAETLGDSGQTGSTAEPAETDQDRAWREYLTASAAAPVV
                 130       140       150       160       170       180
```

The complete strain B sequence (ORF2-1) (SEQ ID NO: 70) and ORF2a (SEQ ID NO: 72) show 98.2% identity in 228 aa overlap:

```
orf2a.pep MFDFGLGELVFVGIIALIVLGPERLPEAARTAGRLIGRLQRFVGSVKQEFDTQIELEELR  60
          ||||||||||||||||||||||||||||||||||||||||||||||||||||||||||||
orf2-1    MFDFGLGELVFVGIIALIVLGPERLPEAARTAGRLIGRLQRFVGSVKQEFDTQIELEELR  60 orf2a.pep KAKQEFEAAAAQVRDSLKETGTDMEGNLHDISDGLKPWEKLPEQRTPADFGVDENGNPFP 120
          |||||||||||||||||||||||||||||||||||||||||||||||||||||||||:|
orf2-1    KAKQEFEAAAAQVRDSLKETGTDMEGNLHDISDGLKPWEKLPEQRTPADFGVDENGNPLP 120 orf2a.pep DAANTLLDGISDVMPSERSYASAETLGDSGQTGSTAEPAETDQDRAWREYLTASAAAPVV 180
          |||||| |||||||||||||||||||||||||||||||||||||||||||||||||||
orf2-1    DAANTLSDGISDVMPSERSYASAETLGDSGQTGSTAEPAETDQDRAWREYLTASAAAPVV 180 orf2a.pep QTVEVSYIDTAVETPVPHTTSLRKQAISRKRDLRPKSRAKPKLRVRKSX            229
          |||||||||||||||||||||||||||||||||:|||  ||||||||||
orf2-1    QTVEVSYIDTAVETPVPHTTSLRKQAISRKRDFRPKHRAKPKLRVRKSX            229
```

Further work identified a partial DNA sequence (SEQ I) NO: 73) in *N.gonorrhoeae* encoding the following amino acid sequence (SEQ ID NO: 74; ORF2ng):

```
  1 MFDFGLGELI FVGIIALIVL GPERLPEAAR TAGRLIGRLQ RFVGSVKQEL

51 DTQIELEELR KVKQAFEAAA AQVRDSLKET DTDMQNSLHD ISDGLKPWEK

101 LPEQRTPADF GVDEKGNSLS RYGKHRIRRH FRRYAV*
```

Further work identified the complete gonococcal gene sequence (SEQ ID NO: 75):

```
  1 ATGTTTGATT TCGGTTTGGG CGAGCTGATT TTTGTCGGCA TTATCGCCCT

51 GATTGTCCTT GGTCCAGAAC GCCTGCCCGA AGCCGCCCGC ACTGCCGGAC

101 GGCTTATCGG CAGGCTGCAA CGCTTTGTAG GAAGCGTCAA ACAAGAACTT

151 GACACTCAAA TCGAACTGGA AGAGCTGAGG AAGGTCAAGC AGGCATTCGA

201 AGCTGCCGCC GCTCAGGTTC GAGACAGCCT CAAAGAAACC GATACGGATA

251 TGCAGAACAG TCTGCACGAC ATTTCCGACG GTCTGAAGCC TTGGGAAAAA

301 CTGCCCGAAC AGCGCACGCc tgccgatttc gGTGTCGATg AAAacggcaa 351 tccccttccc gATACGGCAA ACACCGTATC AGACGGCATT TCCGACGTTA 401 TGCCGTCTGA ACGTTCCGAT ACTtccgcCG AAACCCTTGG GACGACAGG

451 CAAACCGGCA GTACAGCCGA ACCTGCGGAA ACCGACAAAG ACCGCGCATG

501 GCGGGAATAC CTGactgctt ctgccgccgc acctgtcgta Cagagggccg 551 tcgaagtcag ctaTATCGAT ACTGCTGTTG AAacgcctgT tccgcaCacc 601 acttccctgc gcaAACAGGC AATAAACCGC AAACGCGATT TttgtccgaA 651 ACACCGCGCc aAACCGAAat tgcgcgtcCG TAAATCATAA
```

This encodes a protein having the amino acid sequence (SEQ ID NO: 76; ORF2ng-1):

```
  1 MFDFGLGELI FVGIIALIVL GPERLPEAAR TAGRLIGRLQ RFVGSVKQEL

51 DTQIELEELR KVKQAFEAAA AQVRDSLKET DTDMQNSLHD ISDGLKPWEK

101 LPEQRTPADF GVDENGNPLP DTANTVSDGI SDVMPSERSD TSAETLGDDR

151 QTGSTAEPAE TDKDRAWREY LTASAAAPVV QRAVEVSYID TAVETPVPHT

201 TSLRKQAINR KRDFCPKHRA KPKLRVRKS*
```

The originally-identified partial strain B sequences (ORF2) (SEQ ID NO: 68) shows 87.5% identity over a 136aa overlap with ORF2NG (SEQ ID NO: 74):

```
orf2.pep MXDFGLGELVFVGIIALIVLGPERXPEAARXAGRLIGRLQRFVGSVKQEFDTQIELEELR   60
         |  ||||||:|||||||||||||| |||||:||||||||||||||||||||:||||||||
orf2ng   MFDFGLGELIFVGIIALIVLGPERLPEAARTAGRLIGRLQRFVGSVKQELDTQIELEELR   60 orf2.pep KAKQEFEAAAAQVRDSLKETGTDMEGNLHDISDGLKPWEKLPEQRTPADFGVDENGNPXS  120
         |:|| |||||||||||||||| |||:::||||||||||||||||||||||||||||:||
orf2ng   KVKQAFEAAAAQVRDSLKETDTDMQNSLHDISDGLKPWEKLPEQRTPADFGVDEKGNSLP  120 orf2.pep RCGKHPIRRHFRRYAV                                              136
         | ||| ||||||||||
orf2ng   RYGKHRIRRHFRRYAV                                              136
```

The complete strain B and gonococcal sequences (ORF2-1 & ORF2NG-1) (SEQ ID NO: 70 & SEQ ID NO: 79) show 91.7% identity in 229 aa overlap:

```
                      10         20         30         40         50         60
orf2-1.pep   MFDFGLGELVFVGIIALIVLGPERLPEAARTAGRLIGRLQRFVGSVKQEFDTQIELEELR
             |||||||||:||||||||||||||||||||||||||||||||||||||:||||||||||
orf2ng-1     MFDFGLGELIFVGIIALIVLGPERLPEAARTAGRLIGRLQRFVGSVKQELDTQIELEELR
                      10         20         30         40         50         60
```

```
                              -continued
orf2-1.pep  KAKQEFEAAAAQVRDSLKETGTDMEGNLHDISDGLKPWEKLPEQRTPADFGVDENGNPLP
            |:||  |||||||||||||| |||:::||||||||||||||||||||||||||||||||
orf2ng-1    KVKQAFEAAAAQVRDSLKETDTDMQNSLHDISDGLKPWEKLPEQRTPADFGVDENGNPLP
                    70        80        90       100       110       120

130       140       150       160       170       180
orf2-1.pep  DAANTLSDGISDVMPSERSYASAETLGDSGQTGSTAEPAETDQDRAWREYLTASAAAPVV
            |:|||:||||||||||||| :|||||||: ||||||||||||:|||||||||||||||
orf2ng-1    DTANTVSDGISDVMPSERSDTSAETLGDDRQTGSTAEPAETDKDRAWREYLTASAAAPVV
                    130       140       150       160       170       180

190       200       210       220       229
orf2-1.pep  Q-TVEVSYIDTAVETPVPHTTSLRKQAISRKRDFRPKHRAKPKLRVRKSX
            | :||||||||||||||||||||||||||:||||| ||||||||||||||
orf2ng-1    QRAVEVSYIDTAVETPVPHTTSLRKQAINRKRDFCPKHRAKPKLRVRKSX
                    190       200       210       220       230
```

Computer analysis of these amino acid sequences indicates a transmembrane region (underlined), and also revealed homology (59% identity) between the gonococcal sequence and the TatB protein (SEQ ID NO: 1118) of *E.coli*:

```
gnl|PID|e1292181 (AJ005830) TatB protein [Escherichia coli] Length = 171
Score = 56.6 bits (134), Expect = 1e-07
Identities = 30/88 (34%), Positives = 52/88 (59%), Gaps = 1/88 (1%)

Query:  1 MFDFGLGELIFVGIIALIVLGPERLPEAARTAGRLIGRLQRFVGSVKQELDTQIELEELR  60
          MFD G  EL+ V II L+VLGP+RLP A +T      I  L+    +V+ EL +++L+E +
Sbjct:  1 MFDIGFSELLLVFIIGLVVLGPQRLPVAVKTVAGWIRALRSLATTVQNELTQELKLQEFQ  60

Query: 61 -KVKQAFEAAAAQVRDSLKETDTDMQNS  87
           +K+ +A+   +  LK +  +++ +
Sbjct: 61 DSLKKVEKASLTNLTPELKASMDELRQA  88
```

Based on this analysis, it was predicted that ORF2 (SEQ ID NO: 68), ORF2a (SEQ ID NO: 72) and ORF2ng (SEQ ID NO: 74) are likely to be membrane proteins and so the proteins from *N.meningitidis* and *N.gonorrhoeae*, and their epitopes, could be useful antigens for vaccines or diagnostics, or for raising antibodies.

Figure 3A:
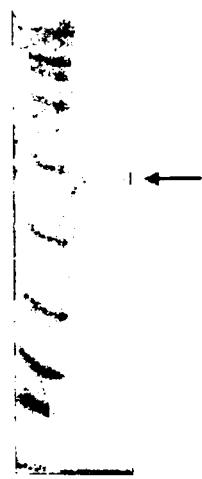
Figure 3B:
Figure 3C:
Figure 3D:
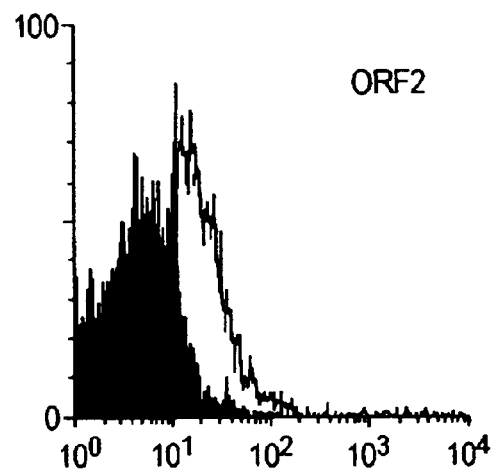

ORF2-1 (SEQ ID NO: 70) (16 kDa) was cloned in pET and pGex vectors and expressed in *E.coli*, as described above. The products of protein expression and purification were analyzed by SDS-PAGE. FIG. 3A shows the results of affinity purification of the GST-fusion protein, and FIG. 3B shows the results of expression of the His-fusion in *E.coli*. Purified GST-fusion protein was used to immunise mice, whose sera were used for Western blots (FIG. 3C), ELISA (positive result), and FACS analysis (FIG. 3D). These experiments confirm that ORF37-1 (SEQ ID NO: 4) is a surface-exposed protein, and that it is a useful immunogen.

Example 10

The following partial DNA sequence was identified in *N.meningitidis* (SEQ ID NO: 77):

```
  1 ATGCAAGCAC GGCTGCTGAT ACCTATTCTT TTTTCAGTTT TTATTTTATC
 51 CGC.TGCGGG ACACTGCACG GTATTCCATC GCATGGCGgA GkTAAACgCT
101 TTgCGGTCGA ACAAGAACTT GTGGCCGCTT CTGCCAGAGC TGCCGTTAAA
151 GACATGGATT TACAGGCATT ACACGGACGA AAAGTTGCAT TGTACATTGC
201 CACTATGGGC GACCAAGGTT CAGGcAGTTT GACAGGGGGG TCGCTACTCC
251 ATTGATGCAC kGrTwCsTGG CGAATACATA AACAGCCCTG CCGTCCGTAC
301 CGATTACACC TATCCACGTT ACGAAACCAC CGCTGAAACA ACATCAGGCG
351 GTTTGACAGG TTTAACCACT TCTTTATCTA CACTTAATGC CCCTGCACTC
401 TCTCGCACCC AATCAGACGG TAGCGGAAGT AAAAGCAGTC TGGGCTTAAA
451 TATTGGCGGG ATGGGGGATT ATCGAAATGA AACCTTGACG ACTAACCCGC
501 GCGACACTGC CTTTCTTTCC CACTTGGTAC AGACCGTATT TTTCCTGCGC
551 GGCATAGACG TTGTTTCTCC TGCCAATGCC GATACAGATG TGTTTATTAA
601 CATCGACGTA TTCGGAACGA TACGCAACAG AACCGAAATG..
```

This corresponds to the amino acid sequence (SEQ ID NO: 78; ORF15):

```
  1 MQARLLIPIL FSVFILSACG TLTGIPSHGG XKRFAVEQEL VAASARAAVK
 51 DMDLQALHGR KVALYIATMG DQGSGSLTGG RYSIDAXXXG EYINSPAVRT
101 DYTYPRYETT AETTSGGLTG LTTSLSTLNA PALSRTQSDG SGSKSSLGLN
151 IGGMGDYRNE TLTTNPRDTA FLSHLVQTVF FLRGIDVVSP ANADTDVFIN
201 IDVFGTIRNR TEM..
```

Further work revealed the complete nucleotide sequence (SEQ ID NO: 79):

```
  1 ATGCAAGCAC GGCTGCTGAT ACCTATTCTT TTTTCAGTTT TTATTTTATC
 51 CGCCTGCGGG ACACTGACAG GTATTCCATC GCATGGCGGA GGTAAACGCT
101 TTGCGGTCGA ACAAGAACTT GTGGCCGCTT CTGCCAGAGC TGCCGTTAAA
151 GACATGGATT TACAGGCATT ACACGGACGA AAAGTTGCAT TGTACATTGC
201 CACTATGGGC GACCAAGGTT CAGGCAGTTT GACAGGGGGT CGCTACTCCA
251 TTGATGCACT GATTCGTGGC GAATACATAA ACAGCCCTGC CGTCCGTACC
301 GATTACACCT ATCCACGTTA CGAAACCACC GCTGAAACAA CATCAGGCGG
351 TTTGACAGGT TTAACCACTT CTTTATCTAC ACTTAATGCC CCTGCACTCT
401 CTCGCACCCA ATCAGACGGT AGCGGAAGTA AAAGCAGTCT GGGCTTAAAT
451 ATTGGCGGGA TGGGGGATTA TCGAAATGAA ACCTTGACGA CTAACCCGCG
501 CGACACTGCC TTTCTTTCCC ACTTGGTACA GACCGTATTT TTCCTGCGCG
551 GCATAGACGT TGTTTCTCCT GCCAATGCCG ATACAGATGT GTTTATTAAC
601 ATCGACGTAT TCGGAACGAT ACGCAACAGA ACCGAAATGC ACCTATACAA
651 TGCCGAAACA CTGAAAGCCC AAACAAAACT GGAATATTTC GCAGTAGACA
701 GAACCAATAA AAAATTGCTC ATCAAACCAA AAACCAATGC GTTTGAAGCT
751 GCCTATAAAG AAAATTACGC ATTGTGGATG GGGCCGTATA AGTAAGCAA
801 AGGAATTAAA CCGACGGAAG GATTAATGGT CGATTTCTCC GATATCCGAC
851 CATACGGCAA TCATACGGGT AACTCCGCCC CATCCGTAGA GGCTGATAAC
901 AGTCATGAGG GGTATGGATA CAGCGATGAA GTAGTGCGAC AACATAGACA
951 AGGACAACCT TGA
```

This corresponds to the amino acid sequence (SEQ ID NO: 80; ORF15-1):

```
  1 MQARLLIPIL FSVFILSACG TLTGIPSHGG GKRFAVEQEL VAASARAAVK
 51 DMDLQALHGR KVALYIATMG DQGSGSLTGG RYSIDALIRG EYINSPAVRT
101 DYTYPRYETT AETTSGGLTG LTTSLSTLNA PALSRTQSDG SGSKSSLGLN
151 IGGMGDYRNE TLTTNPRDTA FLSHLVQTVF FLRGIDVVSP ANADTDVFIN
201 IDVFGTIRNR TEMHLYNAET LKAQTKLEYF AVDRTNKKLL IKPKTNAFEA
251 AYKENYALWM GPYKVSKGIK PTEGLMVDFS DIRPYGNHTG NSAPSVEADN
301 SHEGYGYSDE VVRQHRQGQP *
```

Further work identified the corresponding gene in strain A of *N.meningitidis* (SEQ ID NO: 81):

```
  1  ATGCAAGCAC GGCTGCTGAT ACCTATTCTT TTTTCAGTTT TTATTTTATC
 51  CGCCTGCGGG ACACTGACAG GTATTCCATC GCATGGCGGA GGTAAACGCT
101  TTGCGGTCGA ACAAGAACTT GTGGCCGCTT CTGCCAGAGC TGCCGTTAAA
151  GACATGGATT TACAGGCATT ACACGGACGA AAAGTTGCAT TGTACATTGC
201  AACTATGGGC GACCAAGGTT CAGGCAGTTT GACAGGGGGT CGCTACTCCA
251  TTGATGCACT GATTCGTGGC GAATACATAA ACAGCCCTGC CGTCCGTACC
301  GATTACACCT ATCCACGTTA CGAAACCACC GCTGAAACAA CATCAGGCGG
351  TTTGACAGGT TTAACCACTT CTTTATCTAC ACTTAATGCC CCTGCACTCT
401  CGCGCACCCA ATCAGACGGT AGCGGAAGTA AAAGCAGTCT GGGCTTAAAT
451  ATTGGCGGGA TGGGGGATTA TCGAAATGAA ACCTTGACGA CTAACCCGCG
501  CGACACTGCC TTTCTTTCCC ACTTGGTACA GACCGTATTT TTCCTGCGCG
551  GCATAGACGT TGTTTCTCCT GCCAATGCCG ATACGGATGT GTTTATTAAC
601  ATCGACGTAT TCGGAACGAT ACGCAACAGA ACCGAAATGC ACCTATACAA
651  TGCCGAAACA CTGAAAGCCC AAACAAAACT GGAATATTTC GCAGTAGACA
701  GAACCAATAA AAAATTGCTC ATCAAACCAA AAACCAATGC GTTTGAAGCT
751  GCCTATAAAG AAAATTACGC ATTGTGGATG GGACCGTATA AAGTAAGCAA
801  AGGAATTAAA CCGACAGAAG GATTAATGGT CGATTTCTCC GATATCCAAC
851  CATACGGCAA TCATATGGGT AACTCTGCCC CATCCGTAGA GGCTGATAAC
901  AGTCATGAGG GGTATGGATA CAGCGATGAA GCAGTGCGAC GACATAGACA
951  AGGGCAACCT TGA
```

This encodes a protein having amino acid sequence (SEQ ID NO: 82; ORF15a):

```
  1  MQARLLIPIL FSVFILSACG TLTGIPSHGG GKRFAVEQEL VAASARAAVK
 51  DMDLQALHGR KVALYIATMG DQGSGSLTGG RYSIDALIRG EYINSPAVRT
101  DYTYPRYETT AETTSGGLTG LTTSLSTLNA PALSRTQSDG SGSKSSLGLN
151  IGGMGDYRNE TLTTNPRDTA FLSHLVQTVF FLRGIDVVSP ANADTDVFIN
201  IDVFGTIRNR TEMHLYNAET LKAQTKLEYF AVDRTNKKLL IKPKTNAFEA
251  AYKENYALWM GPYKVSKGIK PTEGLMVDFS DIQPYGNHMG NSAPSVEADN
301  SHEGYGYSDE AVRRHRQGQP *
```

The originally-identified partial strain B sequence (ORF15) (SEQ ID NO: 78) shows 98.1% identity over a 213aa overlap with ORF15a (SEQ ID NO: 82):

```
                    10        20        30        40        50        60
orf15.pep  MQARLLIPILFSVFILSACGTLTGIPSHGGXKRFAVEQELVAASARAAVKDMDLQALHGR
           |||||||||||||||||||||||||||||| |||||||||||||||||||||||||||||
orf15a     MQARLLIPILFSVFILSACGTLTGIPSHGGGKRFAVEQELVAASARAAVKDMDLQALHGR
                    10        20        30        40        50        60
```

```
                  70        80        90       100       110       120
orf15.pep  KVALYIATMGDQGSGSLTGGRYSIDAXXXGEYINSPAVRTDYTYPRYETTAETTSGGLTG
           ||||||||||||||||||||||||||   ||||||||||||||||||||||||||||||
orf15a     KVALYIATMGDQGSGSLTGGRYSIDALIRGEYINSPAVRTDYTYPRYETTAETTSGGLTG
                  70        80        90       100       110       120

130       140       150       160       170       180
orf15.pep  LTTSLSTLNAPALSRTQSDGSGSKSSLGLNIGGMGDYRNETLTTNPRDTAFLSHLVQTVF
           ||||||||||||||||||||||||||||||||||||||||||||||||||||||||||||
orf15a     LTTSLSTLNAPALSRTQSDGSGSKSSLGLNIGGMGDYRNETLTTNPRDTAFLSHLVQTVF
                 130       140       150       160       170       180

190       200       210
orf15.pep  FLRGIDVVSPANADTDVFINIDVFGTIRNRTEM
           ||||||||||||||||||||||||||||||||
orf15a     FLRGIDVVSPANADTDVFINIDVFGTIRNRTEMHLYNAETLKAQTKLEYFAVDRTNKKLL
                 190       200       210       220       230       240
```

The complete strain B sequence (ORF15-1) (SEQ ID NO: 80) and ORF15a (SEQ ID NO: 82) show 98.8% identity in 320 aa overlap:

```
                  10        20        30        40        50        60
orf15a.pep MQARLLIPILFSVFILSACGTLTGIPSHGGGKRFAVEQELVAASARAAVKDMDLQALHGR
           ||||||||||||||||||||||||||||||||||||||||||||||||||||||||||||
orf15-1    MQARLLIPILFSVFILSACGTLTGIPSHGGGKRFAVEQELVAASARAAVKDMDLQALHGR
                  10        20        30        40        50        60

70        80        90       100       110       120
orf15a.pep KVALYIATMGDQGSGSLTGGRYSIDALIRGEYINSPAVRTDYTYPRYETTAETTSGGLTG
           ||||||||||||||||||||||||||||||||||||||||||||||||||||||||||||
orf15-1    KVALYIATMGDQGSGSLTGGRYSIDALIRGEYINSPAVRTDYTYPRYETTAETTSGGLTG
                  70        80        90       100       110       120

130       140       150       160       170       180
orf15a.pep LTTSLSTLNAPALSRTQSDGSGSKSSLGLNIGGMGDYRNETLTTNPRDTAFLSHLVQTVF
           ||||||||||||||||||||||||||||||||||||||||||||||||||||||||||||
orf15-1    LTTSLSTLNAPALSRTQSDGSGSKSSLGLNIGGMGDYRNETLTTNPRDTAFLSHLVQTVF
                 130       140       150       160       170       180

190       200       210       220       230       240
orf15a.pep FLRGIDVVSPANADTDVFINIDVFGTIRNRTEMHLYNAETLKAQTKLEYFAVDRTNKKLL
           ||||||||||||||||||||||||||||||||||||||||||||||||||||||||||||
orf15-1    FLRGIDVVSPANADTDVFINIDVFGTIRNRTEMHLYNAETLKAQTKLEYFAVDRTNKKLL
                 190       200       210       220       230       240

250       260       270       280       290       300
orf15a.pep IKPKTNAFEAAYKENYALWMGPYKVSKGIKPTEGLMVDFSDIQPYGNHMGNSAPSVEADN
           |||||||||||||||||||||||||||||||||||||||||:|||| |||||||||||||
orf15-1    IKPKTNAFEAAYKENYALWMGPYKVSKGIKPTEGLMVDFSDIRPYGNHTGNSAPSVEADN
                 250       260       270       280       290       300

310       320
orf15a.pep SHEGYGYSDEAVRRHRQGQPX
           ||||||||||:||:|||||||
orf15-1    SHEGYGYSDEVVRQHRQGQPX
                 310       320
```

Further work identified the corresponding gene in *N.gonorrhoeae* (SEQ ID NO: 83):

```
  1  ATGCGGGCAC GGCTGCTGAT ACCTATTCTT TTTTCAGTTT TTATTTTATC

51  CGCCTGCGGG ACACTGACAG GTATTCCATC GCATGGCGGA GGCAAACGCT

101  TCGCGGTCGA ACAAGAACTT GTGGCCGCTT CTGCCAGAGC TGCCGTTAAA

151  GACATGGATT TACAGGCATT ACACGGACGA AAAGTTGCAT TGTACATTGC

201  AACTATGGGC GACCAAGGTT CAGGCAGTTT GACAGGGGGT CGCTACTCCA

251  TTGATGCACT GATTCGCGGC GAATACATAA ACAGCCCTGC CGTCCGCACC

301  GATTACACCT ATCCGCGTTA CGAAACCACC GCTGAAACAA CATCAGGCGG
```

```
-continued
351  TTTGACGGGT TTAACCACTT CTTTATCTAC ACTTAATGCC CCTGCACTCT

401  CGCGCACCCA ATCAGACGGT AGCGGAAGTA GGAGCAGTCT GGGCTTAAAT

451  ATTGGCGGGA TGGGGGATTA TCGAAATGAA ACCTTGACGA CCAACCCGCG

501  CGACACTGCC TTTCTTTCCC ACTTGGTGCA GACCGTATTT TTCCTGCGCG

551  GCATAGACGT TGTTTCTCCT GCCAATGCCG ATACAGATGT GTTTATTAAC

601  ATCGACGTAT TCGGAACGAT ACGCAACAGA ACCGAAATGC ACCTATACAA

651  TGCCGAAACA CTGAAAGCCC AAACAAAACT GGAATATTTC GCAGTAGACA

701  GAACCAATAA AAAATTGCTC ATCAAACCCA AAACCAATGC GTTTGAAGCT

751  GCCTATAAAG AAAATTACGC ATTGTGGATG GGGCCGTATA AAGTAAGCAA

801  AGGAATCAAA CCGACGGAAG GATTGATGGT CGATTTCTCC GATATCCAAC

851  CATACGGCAA TCATACGGGT AACTCCGCCC CATCCGTAGA GGCTGATAAC

901  AGTCATGAGG GGTATGGATA CAGCGATGAA GCAGTGCGAC AACATAGACA

951  AGGGCAACCT TGA
```

This encodes a protein having amino acid sequence (SEQ ID NO: 84; ORF15ng):

```
  1  MRARLLIPIL FSVFILSACG TLTGIPSHGG GKRFAVEQEL VAASARAAVK

51  DMDLQALHGR KVALYIATMG DQGSGSLTGG RYSIDALIRG EYINSPAVRT

101  DYTYPRYETT AETTSGGLTG LTTSLSTLNA PALSRTQSDG SGSRSSLGLN

151  IGGMGDYRNE TLTTNPRDTA FLSHLVQTVF FLRGIDVVSP ANADTDVFIN

201  IDVFGTIRNR TEMHLYNAET LKAQTKLEYF AVDRTNKKLL IKPKTNAFEA

251  AYKENYALWM GPYKVSKGIK PTEGLMVDFS DIQPYGNHTG NSAPSVEADN

301  SHEGYGYSDE AVRQHRQGQP *
```

The originally-identified partial strain B sequence (ORF15) (SEQ ID NO: 78) shows 97.2% identity over a 213aa overlap with ORF15ng (SEQ ID NO: 84):

```
orf15.pep  MQARLLIPILFSVFILSACGTLTGIPSHGGXKRFAVEQELVAASARAAVKDMDLQALHGR   60
           |:||||||||||||||||||||||||||||| |||||||||||||||||||||||||||
orf15ng    MRARLLIPILFSVFILSACGTLTGIPSHGGGKRFAVEQELVAASARAAVKDMDLQALHGR   60 orf15.pep  KVALYIATMGDQGSGSLTGGRYSIDAXXXGEYINSPAVRTDYTYPRYETTAETTSGGLTG  120
           |||||||||||||||||||||||||||   ||||||||||||||||||||||||||||||
orf15ng    KVALYIATMGDQGSGSLTGGRYSIDALIRGEYINSPAVRTDYTYPRYETTAETTSGGLTG  120 orf15.pep  LTTSLSTLNAPALSRTQSDGSGSKSSLGLNIGGMGDYRNETLTTNPRDTAFLSHLVQTVF  180
           |||||||||||||||||||||||:||||||||||||||||||||||||||||||||||||
orf15ng    LTTSLSTLNAPALSRTQSDGSGSRSSLGLNIGGMGDYRNETLTTNPRDTAFLSHLVQTVF  180 orf15.pep  FLRGIDVVSPANADTDVFINIDVFGTIRNRTEM                            213
           |||||||||||||||||||||||||||||||||
orf15ng    FLRGIDVVSPANADTDVFINIDVFGTIRNRTEMHLYNAETLKAQTKLEYFAVDRTNKKLL  240
```

The complete strain B sequence (ORF15-1) (SEQ ID NO: 80) and ORF15ng (SEQ ID NO: 84) show 98.8% identity in 320 aa overlap:

```
              10         20         30         40         50         60
orf15-1.pep MQARLLIPILFSVFILSACGTLTGIPSHGGGKRFAVEQELVAASARAAVKDMDLQALHGR
            |:||||||||||||||||||||||||||||||||||||||||||||||||||||||||
orf15ng     MRARLLIPILFSVFILSACGTLTGIPSHGGGKRFAVEQELVAASARAAVKDMDLQALHGR
              10         20         30         40         50         60

70         80         90        100        110        120
orf15-1.pep KVALYIATMGDQGSGSLTGGRYSIDALIRGEYINSPAVRTDYTYPRYETTAETTSGGLTG
            ||||||||||||||||||||||||||||||||||||||||||||||||||||||||||
orf15ng     KVALYIATMGDQGSGSLTGGRYSIDALIRGEYINSPAVRTDYTYPRYETTAETTSGGLTG
              70         80         90        100        110        120

130        140        150        160        170        180
orf15-1.pep LTTSLSTLNAPALSRTQSDGSGSKSSLGLNIGGMGDYRNETLTTNPRDTAFLSHLVQTVF
            |||||||||||||||||||||||:||||||||||||||||||||||||||||||||||
orf15ng     LTTSLSTLNAPALSRTQSDGSGSRSSLGLNIGGMGDYRNETLTTNPRDTAFLSHLVQTVF
             130        140        150        160        170        180

190        200        210        220        230        240
orf15-1.pep FLRGIDVVSPANADTDVFINIDVFGTIRNRTEMHLYNAETLKAQTKLEYFAVDRTNKKLL
            ||||||||||||||||||||||||||||||||||||||||||||||||||||||||||
orf15ng     FLRGIDVVSPANADTDVFINIDVFGTIRNRTEMHLYNAETLKAQTKLEYFAVDRTNKKLL
             190        200        210        220        230        240

250        260        270        280        290        300
orf15-1.pep IKPKTNAFEAAYKENYALWMGPYKVSKGIKPTEGLMVDFSDIRPYGNHTGNSAPSVEADN
            |||||||||||||||||||||||||||||||||||||||||:||||||||||||||||
orf15ng     IKPKTNAFEAAYKENYALWMGPYKVSKGIKPTEGLMVDFSDIQPYGNHTGNSAPSVEADN
             250        260        270        280        290        300

310        320
orf15-1.pep SHEGYGYSDEVVRQHRQGQPX
            |||||||||:|||||||||||
orf15ng     SHEGYGYSDEAVRQHRQGQPX
             310        320
```

Computer analysis of these amino acid sequences reveals an ILSAC motif (putative membrane lipoprotein lipid attachment site, as predicted by the MOTIFS program).

Indicates a putative leader sequence, and it was predicted that the proteins from N.meningitidis and N.gonorrhoeae, and their epitopes, could be useful antigens for vaccines or diagnostics, or for raising antibodies.

Figure 4A:
Figure 4B:
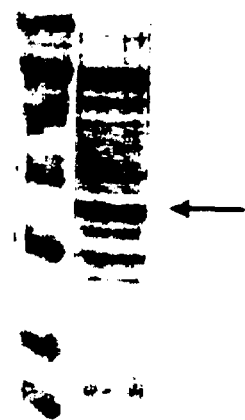
Figure 4C:
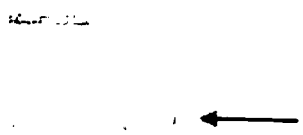

ORF15-1 (SEQ ID NO: 80) (31.7 kDa) was cloned in pET and pGex vectors and expressed in E.coli, as described above. The products of protein expression and purification were analyzed by SDS-PAGE. FIG. 4A shows the results of affinity purification of the GST-fusion protein, and FIG. 4B shows the results of expression of the His-fusion in E.coli. Purified GST-fusion protein was used to immunise mice, whose sera were used for Western blot (FIG. 4C) and ELISA (positive result). These experiments confirm that ORFX-1 is a surface-exposed protein, and that it is a useful immunogen.

Example 11

The following partial DNA sequence was identified in N.meningitidis (SEQ ID NO: 85):

```
  1  ..GG.CAGCACA AAAAACAGGC GGTTGAACGG AAAAACCGTA TTTACGATGA
 51  TGCCGGGTAT GATATTCGGC GTATTCACGG GCGCATTCTC CGCAAAATAT
101  ATCCCCGCGT TCGGGCTTCA AATTTTCTTC ATCCTGTTTT TAACCGCCGT
151  CGCATTCAAA ACACTGCATA CCGACCCTCA GACGGCATCC CGCCCGCTGC
201  CCGGACTGCC CrGACTGACT GCGGTTTCCA CACTGTTCGG CACAATGTCG
251  AGCTGGGTCG GCATAGGCGG CGGTTCACTT TCCGTCCCCT TCTTAATCCA
301  CTGCGGCTTC CCCGCCCATA AAGCCATCGG CACATCATCC GGCCTTGCCT
351  GGCCGATTGC ACTCTCCGGC GCAATATCGT ATCTGCTCAA CGGCCTGAAT
401  ATTGCAGGAT TGCCCGAAGG GTCACTGGGC TTCCTTTACC TGCCCGCCGT
451  CGCCGTCCTC AGCGCGGCAA CCATTGCCTT TGCCCCGCTC GGTGTCAAAA
501  CCGCCCACAA ACTTTCTTCT GCCAAACTCA AAAAATC.TT CGGCATTATG
551  TTGCTTTTGA TTGCCGGAAA AATGCTGTAC AACCTGCTTT AA
```

This corresponds to the amino acid sequence (SEQ ID NO: 86; ORF17):

```
  1 ..GQHKKQAVNG KTVFTMMPGM IFGVFTGAFS AKYIPAFGLQ IFFILFLTAV

51   AFKTLHTDPQ TASRPLPGLP XLTAVSTLFG TMSSWVGIGG GSLSVPFLIH

101   CGFPAHKAIG TSSGLAWPIA LSGAISYLLN GLNIAGLPEG SLGFLYLPAV

151   AVLSAATIAF APLGVKTAHK LSSAKLKKSF GIMLLLIAGK MLYNLL*
```

Further work revealed the complete nucleotide sequence (SEQ ID NO: 87):

```
  1 ATGTGGCATT GGGACATTAT CTTAATCCTG CTTGCCGTAG GCAGTGCGGC

51 AGGTTTTATT GCCGGCCTGT TCGGCGTAGG CGGCGGCACG CTGATTGTCC

101 CTGTCGTTTT ATGGGTGCTT GATTTGCAGG GTTTGGCACA ACATCCTTAC

151 GCGCAACACC TCGCCGTCGG CACATCCTTC GCCGTCATGG TCTTCACCGC

201 CTTTTCCAGT ATGCTGGGGC AGCACAAAAA ACAGGCGGTC GACTGGAAAA

251 CCGTATTTAC GATGATGCCG GGTATGATAT TCGGCGTATT CACGGGCGCA

301 CTCTCCGCAA AATATATCCC CGCGTTCGGG CTTCAAATTT TCTTCATCCT

351 GTTTTTAACC GCCGTCGCAT TCAAAACACT GCATACCGAC CCTCAGACGG

401 CATCCCGCCC GCTGCCCGGA CTGCCCGGAC TGACTGCGGT TTCCACACTG

451 TTCGGCACAA TGTCGAGCTG GGTCGGCATA GGCGGCGGTT CACTTTCCGT

501 CCCCTTCTTA ATCCACTGCG GCTTCCCCGC CCATAAAGCC ATCGGCACAT

551 CATCCGGCCT TGCCTGGCCG ATTGCACTCT CCGGCGCAAT ATCGTATCTG

601 CTCAACGGCC TGAATATTGC AGGATTGCCC GAAGGGTCAC TGGGCTTCCT

651 TTACCTGCCC GCCGTCGCCG TCCTCAGCGC GGCAACCATT GCCTTTGCCC

701 CGCTCGGTGT CAAAACCGCC CACAAACTTT CTTCTGCCAA ACTCAAAAAA

751 Tc.TTCGGCA TTATGTTGCT TTTGATTGCC GGAAAAATGC TGTACAACCT

801 GCTTTAA
```

This corresponds to the amino acid sequence (SEQ ID NO: 88; ORF17-1):

```
  1 MWHWDIILIL LAVGSAAGFI AGLFGVGGGT LIVPVVLWVL DLQGLAQHPY

51 AQHLAVGTSF AVMVFTAFSS MLGQHKKQAV DWKTVFTMMP GMIFGVFTGA

101 LSAKYIPAFG LQIFFILFLT AVAFKTLHTD PQTASRPLPG LPGLTAVSTL

151 FGTMSSWVGI GGGSLSVPFL IHCGFPAHKA IGTSSGLAWP IALSGAISYL

201 LNGLNIAGLP EGSLGFLYLP AVAVLSAATI AFAPLGVKTA HKLSSAKLKK

251 XFGIMLLLIA GKMLYNLL*
```

Computer analysis of this amino acid sequence gave the following results:

Homology with Hypothetical *H.influenzae* Transmembrane Protein HI0902 (Accession Number P44070) (SEQ ID NO: 1119)

ORF17 (SEQ ID NO: 86) and HI0902 proteins (SEQ ID-NO: 1119) show 28% aa identity in 192 aa overlap:

```
ORF17    3 HKKQAVNGKTVFTMMPGMIFGVFT-GAFSAKYIPAFGLQIF--FILFLTAVAFKTLHTDP   59
           HK   + +V  +P ++  VF  G F  +        +IF   +++L        ++  D
HI0902  72 HKLGNIVWQAVRILAPVIMLSVFICGLFIGRLDREISAKIFACLVVYLATKMVLSIKKD-  130

ORF17   60 QTASRPLPGLPXLTAVSTLFGTMSSWVGIGGGSLSVPFLIHCGFPAHKAIGTSSGLAWPI  119
           Q  ++ L  L +        L G  SS GIGGG    VPFL    G    +AIG+S+     +
HI0902 131 QVTTKSLTPLSSVIG-GILIGMASSAAGIGGGFIVPFLTARGINIKQAIGSSAFCGMLL  189

ORF17  120 ALSGAISYLLNGLNIAGLPEGSLGFLYLPAVAVLSAATIAFAPLGVXXXXXXXXXXXXXX  179
           +SG  S++++G       +PE SLG++YLPAV  ++A +    + LG
HI0902 190 GISGMFSFIVSGWGNPLMPEYSLGYIYLPAVLGITATSFFTSKLGASATAKLPVSTLKKG  249

ORF17  180 FGIMLLLIAGKM                                                 191
           F + L+++A  M
HI0902 250 FALFLIVVAINM                                                 261
```

Homology with a Predicted ORF from *N.meningitidis* (Strain A)

ORF17 (SEQ ID NO: 86) shows 96.9% identity over a 196aa overlap with an ORF (ORF17a) (SEQ ID NO: 90) from strain A of *N. meningitidis*:

```
                                           10        20        30
orf17.pep                         GQHKKQAVNGKTVFTMMPGMIFGVFTGAFS
                                  ||||||||: ||||||||||:||||:|||:|
orf17a    QGLAQHPYAQHLAVGTSFAVMVFTAFSSMLGQHKKQAVDWKTVFTMMPGMVFGVFAGALS
              50        60        70        80        90       100

40        50        60        70        80        90
orf17.pep AKYIPAFGLQIFFILFLTAVAFKTLHTDPQTASRPLPGLPXLTAVSTLFGTMSSWVGIGG
          |||||||||||||||||||||||||||||||||||||||||| ||||||||||||||||||
orf17a    AKYIPAFGLQIFFILFLTAVAFKTLHTDPQTASRPLPGLPGLTAVSTLFGTMSSWVGIGG
             110       120       130       140       150       160

100       110       120       130       140       150
orf17.pep GSLSVPFLIHCGFPAHKAIGTSSGLAWPIALSGAISYLLNGLNIAGLPEGSLGFLYLPAV
          ||||||||||||||||||||||||||||||||||||||||||||||||||||||||||||
orf17a    GSLSVPFLIHCGFPAHKAIGTSSGLAWPIALSGAISYLLNGLNIAGLPEGSLGFLYLPAV
             170       180       190       200       210       220

160       170       180       190
orf17.pep AVLSAATIAFAPLGVKTAHKLSSAKLKKSFGIMLLLIAGKMLYNLLX
          |||||||||||||||||||||||||||||||||||||||||||||||
orf17a    AVLSAATIAFAPLGVKTAHKLSSAKLKKSFGIMLLLIAGKMLYNLLX
             230       240       250       260
```

The complete length ORF17a nucleotide sequence (SEQ ID NO: 89) is:

```
  1 ATGTGGCATT GGGACATTAT CTTAATCCTG CTTGCCGTAG GCAGTGCGGC

51 AGGTTTTATT GCCGGCCTGT TCGGCGTAGG CGGCGGCACG CTGATTGTCC

101 CTGTCGTTTT ATGGGTGCTT GATTTGCAGG GTTTGGCACA ACATCCTTAC

151 GCGCAACACC TCGCCGTCGG CACATCCTTC GCCGTCATGG TCTTCACCGC

201 CTTTTCCAGT ATGCTGGGGC AGCACAAAAA ACAGGCGGTC GACTGGAAAA

251 CCGTATTTAC GATGATGCCG GGTATGGTAT TCGGCGTATT CGCTGGCGCA

301 CTCTCCGCAA AATATATCCC AGCGTTCGGG CTTCAAATTT TCTTCATCCT
```

-continued

```
351 GTTTTTAACC GCCGTCGCAT TCAAAACACT GCATACCGAC CCTCAGACGG

401 CATCCCGCCC GCTGCCCGGA CTGCCCGGAC TGACTGCGGT TTCCACACTG

451 TTCGGCACAA TGTCGAGCTG GGTCGGCATA GGCGGCGGTT CACTTTCCGT

550 CCCCTTCTTA ATCCACTGCG GCTTCCCCGC CCATAAAGCC ATCGGCACAT

551 CATCCGGCCT TGCCTGGCCG ATTGCACTCT CCGGCGCAAT ATCGTATCTG

601 CTCAACGGCC TGAATATTGC AGGATTGCCC GAAGGGTCAC TGGGCTTCCT

651 TTACCTGCCC GCCGTCGCCC TCCTCAGCGC GGCAACCATT GCCTTTGCCC

701 CGCTCGGTGT CAAAACCGCC CACAAACTTT CTTCTGCCAA ACTCAAAAAA

751 TCCTTCGGCA TTATGTTGCT TTTGATTGCC GGAAAAATGC TGTACAACCT

801 GCTTTAA
```

This encodes a protein having amino acid sequence (SEQ ID NO: 90):

```
  1 MWHWDIILIL LAVGSAAGFI AGLFGVGGGT LIVPVVLWVL DLQGLAQHPY

51 AQHLAVGTSF AVMVFTAFSS MLGQHKKQAV DWKTVFTMMP GMVFGVFAGA

101 LSAKYIPAFG LQIFFILFLT AVAFKTLHTD PQTASRPLPG LPGLTAVSTL

151 FGTMSSWVGI GGGSLSVPFL IHCGFPAHKA IGTSSGLAWP IALSGAISYL

201 LNGLNIAGLP EGSLGFLYLP AVAVLSAATI AFAPLGVKTA HKLSSAKLKK

251 SFGIMLLLIA GKMLYNLL*
```

ORF17a (SEQ ID NO: 90) and ORF17-1 (SEQ ID NO: 88) show 98.9% identity in 268 aa overlap:

```
                   10         20         30         40         50         60
orf17a.pep MWHWDIILILLAVGSAAGFIAGLFGVGGGTLIVPVVLWVLDLQGLAQHPYAQHLAVGTSF
           ||||||||||||||||||||||||||||||||||||||||||||||||||||||||||||
orf17-1    MWHWDIILILLAVGSAAGFIAGLFGVGGGTLIVPVVLWVLDLQGLAQHPYAQHLAVGTSF
                   10         20         30         40         50         60

70         80         90        100        110        120
orf17a.pep AVMVFTAFSSMLGQHKKQAVDWKTVFTMMPGMVFGVFAGALSAKYIPAFGLQIFFILFLT
           |||||||||||||||||||||||||||||||||:||||:|||||||||||||||||||||
orf17-1    AVMVFTAFSSMLGQHKKQAVDWKTVFTMMPGMIFGVFTGALSAKYIPAFGLQIFFILFLT
                   70         80         90        100        110        120

130        140        150        160        170        180
orf17a.pep AVAFKTLMTDPQTASRPLPGLPGLTAVSTLFGTMSSWVGIGGGSLSVPFLIHCGFPAHKA
           ||||||||||||||||||||||||||||||||||||||||||||||||||||||||||||
orf17-1    AVAFKTLMTDPQTASRPLPGLPGLTAVSTLFGTMSSWVGIGGGSLSVPFLIHCGFPAHKA
                  130        140        150        160        170        180

190        200        210        220        230        240
orf17a.pep IGTSSGLAWPIALSGAISYLLNGLNIAGLPEGSLGFLYLPAVAVLSAATIAFAPLGVKTA
           ||||||||||||||||||||||||||||||||||||||||||||||||||||||||||||
orf17-1    IGTSSGLAWPIALSGAISYLLNGLNIAGLPEGSLGFLYLPAVAVLSAATIAFAPLGVKTA
                  190        200        210        220        230        240

250        260      269
orf17a.pep HKLSSAKLKKSFGIMLLLIAGKMLYNLLX
           |||||||||| ||||||||||||||||||
orf17-1    HKLSSAKLKKXFGIMLLLIAGKMLYNLLX
                  250        260
```

Homolopy with a Predicted ORF from *N.gonorrhoeae*
ORF17 (SEQ ID NO: 86) shows 93.9% identity over a 196aa overlap with a predicted ORF (ORF17.ng) (SEQ ID NO: 92) from *N. gonorrhoeae*:

```
orf17.pep                             GQHKKQAVNGKTVFTMMPGMIFGVFTGAFS    30
                                      ||||||||: ||:|:||||||||||:||:|
orf17ng    QGLAQHPYAQHLAVGTSFAVMVFTAFSSMLGQHKKQAVDWKTIFAMMPGMIFGVFAGALS   102 orf17.pep  AKYIPAFGLQIFFILFLTAVAFKTLHTDPQTASRPLPGLPXLTAVSTLFGTMSSWVGIGG     90
           ||||||||||||||||||||||||||||| |||||||||||| :||||||||||:|||||
orf17ng    AKYIPAFGLQIFFILFLTAVAFKTLHTGRQTASRPLPGLPGLTAVSTLFGAMSSWVGIGG   162 orf17.pep  GSLSVPFLIHCGFPAHKAIGTSSGLAWPIALSGAISYLLNGLNIAGLPEGSLGFLYLPAV    150
           |||||||||||||||||||||||||||||||||||||:||||||||||||||||||||||
orf17ng    GSLSVPFLIHCGFPAHKAIGTSSGLAWPIALSGAISYLVNGLNIAGLPEGSLGFLYLPAV   202 orf17.pep  AVLSAATIAFAPLGVKTAHKLSSAKLKKSFGIMLLLIAGKMLYNLL                  196
           ||||||||||||||||||||||||||||:|||||||||||||||||
orf17ng    AVLSAATIAFAPLGVKTAHKLSSAKLKESFGIMLLLIAGKMLYNLL                  268
```

An ORF17ng nucleotide sequence (SEQ ID NO: 91) is predicted to encode a protein having amino acid sequence (SEQ ID NO: 92):

```
  1  MWHWDIILIL LAVGSAAGFI AGLFGVGGGT LIVPVVLWVL DLQGLAQHPY
 51  AQHLAVGTSF AVMVFTAFSS MLGQHKKQAV DWKTIFAMMP GMIFGVFAGA
101  LSAKYIPAFG LQIFFILFLT AVAFKTLHTG RQTASRPLPG LPGLTAVSTL
151  FGAMSSWVGI GGGSLSVPFL IHCGFPAHKA IGTSSGLAWP IALSGAISYL
201  VNGLNIAGLP EGSLGFLYLP AVAVLSAATI AFAPLGVKTA HKLSSAKLKE
251  SFGIMLLLIA GKMLYNLL*
```

Further work revealed the complete gonococcal DNA sequence (SEQ ID NO: 93):

```
  1  ATGTGGCATT GGGACATTAT CTTAATCCTG CTTGCcgtag gcAGTGCGGC
 51  AGGTTTTATT GCCGGCCTGT Tcggtgtagg cggcgGTACG CTGATTGTCC
101  CTGTCGTTTT ATGGGTGCTT GATTTGCAGG GTTTGCCACA ACATCCTTAC
151  GCGCAACACC TCGCCGTCGG CAcaTccttc gcCGTCATGG TCTTCACCGC
201  CTTTTCCAGT ATGTTGGGGC AGCACAAAAA ACAGGCGGTC GACTGGAAAA
251  CCATATTTGC GATGATGCCG GGTATGATAT TCGGCGTATT CGCTGGCGCA
301  CTCTCCGCAA AATATATCCC CGCGTTCGGG CTTCAAATTT TCTTCATCCT
351  GTTTTTAACC GCCGTCGCAT TCAAAACACT GCATACCGGT CGTCAGACGG
401  CATCCCGCCC GCTGCCCGGG CTGCCCGGAC TGACTGCGGT TTCCACACTG
451  TTCGGCGCAA TGTCGAGCTG GGTCGGCATA GGCGGCGGTT CACTTTCCGT
501  CCCCTTCTTA ATCCACTGCG GCTTCCCCGC CCATAAAGCC ATCGGCACAT
551  CATCCGGCCT TGCCTGGCCG ATTGCACTCT CCGGCGCAAT ATCGTATCTG
601  GTCAACGGTC TGAATATTGC AGGATTGCCC GAAGGGTCGC TGGGCTTCCT
651  TTACCTGCCC GCCGTCGCCG TCCTCAGCGC GGCAACCATT GCCTTTGCCC
701  CGCTCGGTGT CAAAACCGCC CACAAACTTT CTTCTGCCAA ACTCAAAGAA
751  TCCTTCGGCA TTATGTTGCT TTTGATTGCC GGAAAAATGC TGTACAACCT
801  GCTTTAA
```

This corresponds to the amino acid sequence (SEQ ID NO: 94; ORF17ng-1):

```
  1 MWHWDIILIL LAVGSAAGFI AGLFGVGGGT LIVPVVLWVL DLQGLAQHPY

51 AQHLAVGTSF AVMVFTAFSS MLGQHKKQAV DWKTIFAMMP GMIFGVFAGA

101 LSAKYIPAFG LQIFFILFLT AVAFKTLHTG RQTASRPLPG LPGLTAVSTL

151 FGAMSSWVGI GGGSLSVPFL IHCGFPAHKA IGTSSGLAWP IALSGAISYL

201 VNGLNIAGLP EGSLGFLYLP AVAVLSAATI AFAPLGVKTA HKLSSAKLKE

251 SFGIMLLLIA GKMLYNLL*
```

ORF17ng-1 (SEQ ID NO: 94) and ORF17-1 (SEQ ID NO: 88) show 96.6% identity in 268 aa overlap:

```
                   10         20         30         40         50         60
orf17-1.pep  MWHWDIILILLAVGSAAGFIAGLFGVGGGTLIVPVVLWVLDLQGLAQHPYAQHLAVGTSF
             ||||||||||||||||||||||||||||||||||||||||||||||||||||||||||||
orf17ng-1    MWHWDIILILLAVGSAAGFIAGLFGVGGGTLIVPVVLWVLDLQGLAQHPYAQHLAVGTSF
                   10         20         30         40         50         60

70         80         90        100        110        120
orf17-1.pep  AVMVFTAFSSMLGQHKKQAVDWKTVFTMMPGMIFGVFTGALSAKYIPAFGLQIFFILFLT
             ||||||||||||||||||||||||| :|: ||||||||| :|||||||||||||||||||
orf17ng-1    AVMVFTAFSSMLGQHKKQAVDWKTIFAMMPGMIFGVFAGALSAKYIPAFGLQIFFILFLT
                   70         80         90        100        110        120

130        140        150        160        170        180
orf17-1.pep  AVAFKTLHTDPQTASRPLPGLPGLTAVSTLFGTMSSWVGIGGGSLSVPFLIHCGFPAHKA
             |||||||||   |||||||||||||||||||| :||||||||||||||||||||||||||
orf17ng-1    AVAFKTLHTGRQTASRPLPGLPGLTAVSTLFGAMSSWVGIGGGSLSVPFLIHCGFPAHKA
                   130        140        150        160        170        180

190        200        210        220        230        240
orf17-1.pep  IGTSSGLAWPIALSGAISYLLNGLNIAGLPEGSLGFLYLPAVAVLSAATIAFAPLGVKTA
             ||||||||||||||||||||| :||||||||||||||||||||||||||||||||||||||
orf17ng-1    IGTSSGLAWPIALSGAISYLVNGLNIAGLPEGSLGFLYLPAVAVLSAATIAFAPLGVKTA
                   190        200        210        220        230        240

250        260    269
orf17-1.pep  HKLSSAKLKKXFGIMLLLIAGKMLYNLLX
             |||||||||: ||||||||||||||||||
orf17ng-1    HKLSSAKLKESFGIMLLLIAGKMLYNLLX
                   250        260
```

In addition, ORF17ng-1 (SEQ ID NO: 94) shows significant homology with a hypothetical *H.influenzae* protein (SEQ ID NO: 1119):
sp|P44070|Y902_HAEIN HYPOTHETICAL PROTEIN HI0902 pir||G64015 hypothetical protein HI0902—*Haemophilus influenzae* (strain Rd KW20) gi|1573922 (U32772) *H. influenzae* predicted coding region HI0902 [*Haemophilus influenzae*] Length=264 Score=74 (34.9 bits), Expect=1.6e-23, Sum P(2)=1.6e-23 Identities=15/43 (34%), Positives=23/43 (53%)

```
sp|P44070|Y902_HAEIN HYPOTHETICAL PROTEIN HI0902 pir||G64015 hypothetical protein
HI0902 - Haemophilus influenzae (strain Rd KW20) gi|1573922 (U32772) H. influenzae
predicted coding region HI0902 [Haemophilus influenzae] Length = 264
Score = 74 (34.9 bits), Expect = 1.6e-23, Sum P(2) = 1.6e-23
Identities = 15/43 (34%), Positives = 23/43 (53%)

Query:  55 AVGTSFAVMVFTAFSSMLGQHKKQAVDWKTIFAMMPGMIFGVF                 97
           A+GTSFA +V  T  S    HK   + W+ +   + P ++  VF
Sbjct:  52 ALGTSFATXVITGIGSAQRHHKLGNIVWQAVRILAPVIMLSVF                 94

Score = 195 (91.9 bits), Expect = 1.6e-23, Sum P(2) = 1.6e-23
Identities = 44/114 (38%), Positives = 65/114 (57%)
Query: 150 LFGAMSSWVGIGGGSLSVPFLIHCGFPAHKAIGTSSGLAWPIALSGAISYLVNGLNIAGL 209
            L G SS GIGGG  VPFL  G   +AIG+S+     +SG  S++V+G      +
Sbjct: 148 LIGMASSAAGIGGGGFIVPFLTARGINIKQAIGSSAFCGMLLGISGMFSFIVSGWGNPLM 207

Query: 210 PEGSLGFLYLPAVAVLSAATIAFAPLGVKTAHKLSSAKLKESFGIMLLLIAGKM        263
            PE SLG++YLPAV  ++A +  + LG     KL  + LK+ F + L+++A M
Sbjct: 208 PEYSLGYIYLPAVLGITATSFFTSKLGASATAKLPVSTLKKGFALFLIVVAINM        261
```

This analysis, including the homology with the hypothetical *H.influenzae* transmembrane protein, suggests that the proteins from *N.meningitidis* and *N.gonorrhoeae*, and their epitopes, could be useful antigens for vaccines or diagnostics, or for raising antibodies.

Example 12

The following partial DNA sequence was identified in *N.meningitidis* (SEQ ID NO: 95):

```
  1    ..GGAAACGGAT GGCAGGCAGA CCCCGAACAT CCGCTGCTCG GGCTTTTTGC
 51      CGTCAGTAAT GTATCGATGA CGCTTGCTTT TGTCGGAATA TGTGCGTTGG
101      TGCATTATTG CTTTTCGGGA ACGGTTCAAG TGTTTGTGTT TGCGGCACTG
151      CTCAAACTTT ATGCGCTGAA GCCGGTTTAT TGGTTCGTGT TGCAGTTTGT
201      GCTGATGGCG GTTGCCTATG TCCACCGCTG CGGTATAGAC CGGCAGCCGC
251      CGTCAACGTT CGGCGGCTCG CAGCTGCGAC TCGGCGGGTT GACGGCAGCG
301      TTGATGCAGG TCTCGGTACT GGTGCTGCTG CTTTCAGAAA TTGGAAGATA
351      A
```

This corresponds to the amino acid sequence (SEQ ID NO: 96; ORF18):.

```
  1    ..GNGWQADPEH PLLGLFAVSN VSMTLAFVGI CALVHYCFSG TVQVFVFAAL
 51      LKLYALKPVY WFVLQFVLMA VAYVHRCGID RQPPSTFGGS QLRLGGLTAA
101      LMQVSVLVLL LSEIGR*
```

Further work revealed the complete nucleotide sequence (SEQ ID NO: 97):

```
  1    ATGATTTTGC TGCATTTGGA TTTTTTGTCT GCCTTACTGT ATGCGGCGGT
 51    TTTTCTGTTT CTGATATTCC GCGCAGGAAT GTTGCAATGG TTTTGGGCGA
101    GTATTATGCT GTGGCTGGGC ATATCGGTTT TGGGGGCAAA GCTGATGCCC
151    GGCATATGGG GAATGACCCG CGCCGCGCCC TTGTTCATCC CCCATTTTTA
201    CCTGACTTTG GGCAGCATAT TTTTTTTCAT CGGGCATTGG AACCGGAAAA
251    CAGATGGAAA CGGATGGCAG GCAGACCCCG AACATCCGCT GCTCGGGCTT
301    TTTGCCGTCA GTAATGTATC GATGACGCTT GCTTTTGTCG GAATATGTGC
351    GTTGGTGCAT TATTGCTTTT CGGGAACGGT TCAAGTGTTT GTGTTTGCGG
401    CACTGCTCAA ACTTTATGCG CTGAAGCCGG TTTATTGGTT CGTGTTGCAG
451    TTTGTGCTGA TGGCGGTTGC CTATGTCCAC CGCTGCGGTA TAGACCGGCA
501    GCCGCCGTCA ACGTTCGGCG GCTCGCAGCT GCGACTCGGC GGGTTGACGG
551    CAGCGTTGAT GCAGGTCTCG GTACTGGTGC TGCTGCTTTC AGAAATTGGA
601    AGATAA
```

This corresponds to the amino acid sequence (SEQ ID NO: 98; ORF18-1):

```
  1  MILLHLDFLS ALLYAAVFLF LIFRAGMLQW FWASIMLWLG ISVLGAKLMP
 51  GIWGMTRAAP LFIPHFYLTL GSIFFFIGHW NRKTDGNGWQ ADPEHPLLGL
101  FAVSNVSMTL AFVGICALVH YCFSGTVQVF VFAALLKLYA LKPVYWFVLQ
151  FVLMAVAYVH RCGIDRQPPS TFGGSQLRLG GLTAALMQVS VLVLLLSEIG
201  R*
```

Computer analysis of this amino acid sequence gave the following results:
Homology with a Predicted ORF from *N.meningitidis* (Strain A)

ORF18 (SEQ ID NO: 96) shows 98.3% identity over a 116aa overlap with an ORF (ORF18a) (SEQ ID NO: 100) from strain A of *N. meningitidis*:

```
                              10        20        30
orf18.pep                GNGWQADPEHPLLGLFAVSNVSMTLAFVGI
                         |||||||||||||||||||||||||||||
orf18a    TRAAPLFIPHFYLTLGSIFFFIGHWNRKTDGNGWQADPEHPLLGLFAVSNVSMTLAFVGI
            60        70        80        90       100       110

40        50        60        70        80        90
orf18.pep  CALVHYCFSGTVQVFVFAALLKLYALKPVYWFVLQFVLMAVAYVHRCGIDRQPPSTFGGS
           ||||||||| |||||||||||||||||||||||||||||||||||||||||||||||||
orf18a     CALVHYCFSXTVQVFVFAALLKLYALKPVYWFVLQFVLMAVAYVHRCGIDRQPPSTFGGS
              120       130       140       150       160       170

100       110
orf18.pep  QLRLGGLTAALMQVSVLVLLLSEIGRX
           ||||||||||||| |||||||||||||
orf18a     QLRLGGLTAALMQXSVLVLLLSEIGRX
              180       190       200
```

The complete length ORF18a nucleotide sequence (SEQ ID NO: 99) is:

```
  1  ATGATTTTGC TGCATTTGGA TTTTTTGTCT GCCTTACTGT ATGCGGCGGT
 51  TTTTCTGTTT CTGATATTCC GCGCAGGAAT GTTGCAATGG TTTTGGGCGA
101  GTATTATGCT GTGGCTGGGC ATATCGGTTT TGGGGGCAAA GCTGATGCCC
151  GGCATATGGG GAATGACCCG CGCCGCGCCC TTGTTCATCC CCATTTTTA
201  CCTGACTTTG GCAGCATAT TTTTTTTCAT CGGGCATTGG AACCGGAAAA
251  CGGATGGAAA CGGATGGCAG GCAGACCCCG AACATCCTCT GCTCGGGCTG
301  TTTGCCGTCA GTAATGTATC GATGACGCTT GCTTTTGTCG GAATATGTGC
351  GTTGGTGCAT TATTGCTTTT CGNGAACGGT TCAAGTGTTT GTGTTTGCGG
401  CACTGCTCAA ACTTTATGCG CTGAAGCCGG TTTATTGGTT CGTGTTGCAG
451  TTTGTGCTGA TGGCGGTTGC CTATGTCCAC CGCTGCGGTA TAGACCGGCA
501  GCCGCCGTCA ACGTTCGGCG GNTCGCAGCT GCGACTCGGC GGGTTGACGG
551  CAGCGTTGAT GCAGNTCTCG GTACTGGTGC TGCTGCTTTC AGAAATTGGA
601  AGATAA
```

This encodes a protein having amino acid sequence (SEQ ID NO: 100):

```
  1  MILLHLDFLS ALLYAAVFLF LIFRAGMLQW FWASIMLWLG ISVLGAKLMP

51  GIWGMTRAAP LFIPHFYLTL GSIFFFIGHW NRKTDGNGWQ ADPEHPLLGL

101  FAVSNVSMTL AFVGICALVH YCFSXTVQVF VFAALLKLYA LKPVYWFVLQ

151  FVLMAVAYVH RCGIDRQPPS TFGGSQLRLG GLTAALMQXS VLVLLLSEIG

201  R*
```

ORF18a (SEQ ID NO: 100) and ORF18-1 (SEQ ID NO: 98) show 99.0% identity in 201 aa overlap:

```
                    10         20         30         40         50         60
orf18a.pep  MILLHLDFLSALLYAAVFLFLIFRAGMLQWFWASIMLWLGISVLGAKLMPGIWGMTRAAP
            ||||||||||||||||||||||||||||||||||||||||||||||||||||||||||||
orf18-1     MILLHLDFLSALLYAAVFLFLIFRAGMLQWFWASIMLWLGISVLGAKLMPGIWGMTRAAP
                    10         20         30         40         50         60

70         80         90        100        110        120
orf18a.pep  LFIPHFYLTLGSIFFFIGHWNRKTDGNGWQADPEHPLLGLFAVSNVSMTLAFVGICALVH
            ||||||||||||||||||||||||||||||||||||||||||||||||||||||||||||
orf18-1     LFIPHFYLTLGSIFFFIGHWNRKTDGNGWQADPEHPLLGLFAVSNVSMTLAFVGICALVH
                    70         80         90        100        110        120

130        140        150        160        170        180
orf18a.pep  YCFSXTVQVFVFAALLKLYALKPVYWFVLQFVLMAVAYVHRCGIDRQPPSTFGGSQLRLG
            ||||  ||||||||||||||||||||||||||||||||||||||||||||||||||||||
orf18-1     YCFSGTVQVFVFAALLKLYALKPVYWFVLQFVLMAVAYVHRCGIDRQPPSTFGGSQLRLG
                   130        140        150        160        170        180

190        200
orf18a.pep  GLTAALMQXSVLVLLLSEIGRX
            |||||||| |||||||||||||
orf18-1     GLTAALMQVSVLVLLLSEIGRX
                   190        200
```

Homology with a Predicted ORF from N.gonorrhoeae

ORF18 (SEQ ID NO: 96) shows 93.1% identity over a 116aa overlap with a predicted ORF (ORF18.ng) (SEQ ID NO: 102) from N. gonorrhoeae:

```
orf18.pep                GNGWQADPEHPLLGLFAVSNVSMTLAFVGI   30
                         ||||||||||||||||||||||||||||||
orf18ng    TRAAPLFIPHFYLTLGSIFFFIGYWNRKTDGNGWQADPEHPLLGLFAVSNVSMTLAFVGI  115 orf18.pep  CALVHYCFSGTVQVFVFAALLKLYALKPVYWFVLQFVLMAVAYVHRCGIDRQPPSTFGGS   90
           ||||||||||||||||||||||||||||||||||||||||||||||||||||||||||||
orf18ng    CALVHYCFSGTVQVFVFAALLKLYALKPVYWFVLQFVLMAVAYVHRCGIDRQPPSTFGGS  175 orf18.pep  QLRLGGLTAALMQVSVLVLLLSEIGR                                   116
           ||||| |:| ||||:| ::||:||||
orf18ng    QLRLGGLAAMLMQVAVTAMLLAEIGR                                   201
```

The complete length ORF18ng nucleotide sequence is (SEQ ID NO: 101):

```
  1  ATGATTTTGC TGCATTTGGA TTTTTTGTCT GCCTTACTGt aTGCGGcggt 51  tttTctgTTT CTGATATTCC GCGCAGGAAT GTTGCAATGG TTTTGGGCGA

101  GTATTGCGTT GTGGCTCGGC ATCTCGGTTT TAGGGGTAAA GCTGATGCCG

151  GGGATGTGGG GAATGACCCG CGCCGCGCCT TTGTTCATCC CCCATTTTTA

201  CCTGACTTTG GGCAGCATAT TTTTTTTCAT CGGGTATTGG AACCGGAAAA
```

-continued

```
251 CAGATGGAAA CGGATGGCAG GCAGACCCCG AACATCCGCT GCTCGGGCTT

301 TTTGCCGTCA GTAATGTATC GATGACGCTT GCTTTTGTCG GAATATGTGC

351 GTTGGTGCAT TATTGCTTTT CGGGAACGGT TCAAGTGTTT GTGTTTGCGG

401 CATTGCTCAA ACTTTATGCG CTGAAGCCGG TTTATTGGTT CGTGTTGCAG

451 TTTGTATTGA TGGCGGttgC CTATGTCCAC CGCTGCGGTA TAGACCGGCA

501 GCCGCCGTCA ACGTTCGGCG GTTCGCAGCT GCGACTCGGC GTGTTGGCGG

551 CGATGTTGAT GCAGGTTGCG GTAACGGCGA TGCTGCTTGC CGAAATCGGC

601 AGATGA
```

This encodes a protein having amino acid sequence (SEQ ID NO: 102):

```
  1 MILLHLDFLS ALLYAAVFLF LIFRAGMLQW FWASIALWLG ISVLGVKLMP

51 GMWGMTRAAP LFIPHFYLTL GSIFFFIGYW NRKTDGNGWQ ADPEHPLLGL

101 FAVSNVSMTL AFVGICALVH YCFSGTVQVF VFAALLKLYA LKPVYWFVLQ

151 FVLMAVAYVH RCGIDRQPPS TFGGSQLRLG VLAAMLMQVA VTAMLLAEIG

201 R*
```

This ORF18ng (SEQ ID NO: 102) protein sequence shows 94.0% identity in 201 aa overlap with ORF18-1 (SEQ ID NO: 98):

```
                    10         20         30         40         50         60
orf18-1.pep MILLHLDFLSALLYAAVFLFLIFRAGMLQWFWASIMLWLGISVLGAKLMPGIWGMTRAAP
            ||||||||||||||||||||||||||||||||||:|||||:|||||:|||||:|||||||
orf18ng     MILLHLDFLSALLYAAVFLFLIFRAGMLQWFWASIALWLGISVLGVKLMPGMWGMTRAAP
                    10         20         30         40         50         60

70         80         90        100        110        120
orf18-1.pep LFIPHFYLTLGSIFFFIGHWNRKTDGNGWQADPEHPLLGLFAVSNVSMTLAFVGICALVH
            |||||||||||||||||:||||||||||||||||||||||||||||||||||||||||||
orf18ng     LFIPHFYLTLGSIFFFIGYWNRKTDGNGWQADPEHPLLGLFAVSNVSMTLAFVGICALVH
                    70         80         90        100        110        120

130        140        150        160        170        180
orf18-1.pep YCFSGTVQVFVFAALLKLYALKPVYWFVLQFVLMAVAYVHRCGIDRQPPSTFGGSQLRLG
            ||||||||||||||||||||||||||||||||||||||||||||||||||||||||||||
orf18ng     YCFSGTVQVFVFAALLKLYALKPVYWFVLQFVLMAVAYVHRCGIDRQPPSTFGGSQLRLG
                   130        140        150        160        170        180

190        200
orf18-1.pep GLTAALMQVSVLVLLLSEIGRX
            |:| ||||:| ::||:|||||
orf18ng     VLAAMLMQVAVTAMLLAEIGRX
                   190        200
```

Based on this analysis, including the presence of several putative transmembrane domains in the gonococcal protein, it is predicted that the proteins from *N.meningitidis* and *N.gonorrhoeae*, and their epitopes, could be useful antigens for vaccines or diagnostics, or for raising antibodies.

Example 13

The following partial DNA sequence was identified in *N.meningitidis* (SEQ ID NO: 103):

```
  1 ATGAAAACCC CACTCCTCAA GCCTCTGCTN ATTACCTCGC TTCCCGTTTT

51 CGCCAGTGTT TTTACCGCCG CCTCCATCGT CTGGCAGCTA GGCGAACCCA

101 AGCTCGCCAT GCCCTTCGTA CTCGGCATCA TCGCCGGCGG CCTTGTCGAT
```

-continued
```
151  TTGGACAACC NCNTGACCGG ACGGCTNAAA AACATCATCA CCACCGTCGC

201  CCTGTTCACC CTCTCCTCGC TCACGGCACA AAGCACCCTC GGCACAGGGC

251  TGCCCTTCAT CCTCGCCATG ACCCTGATGA CTT.CG.CTT CACCATTTTA

301  GGCGCGGNCG ...
```

This corresponds to the amino acid sequence (SEQ ID NO: 104; ORF19):

```
  1  MKTPLLKPLL ITSLPVFASV FTAASIVWQL GEPKLAMPFV LGIIAGGLVD

51  LDNXXTGRLK NIITTVALFT LSSLTAQSTL GTGLPFILAM TLMTXXFTIL

101  GAX...
```

Further work revealed the complete nucleotide sequence (SEQ ID NO: 105):

```
   1  ATGAAAACCC CACTCCTCAA GCCTCTGCTC ATTACCTCGC TTCCCGTTTT

51  CGCCAGTGTT TTTACCGCCG CCTCCATCGT CTGGCAGCTA GGCGAACCCA

101  AGCTCGCCAT GCCCTTCGTA CTCGGCATCA TCGCCGGCGG CCTTGTCGAT

151  TTGGACAACC GCCTGACCGG ACGGCTGAAA AACATCATCA CCACCGTCGC

201  CCTGTTCACC CTCTCCTCGC TCACGGCACA AAGCACCCTC GGCACAGGGC

251  TGCCCTTCAT CCTCGCCATG ACCCTGATGA CCTTCGGCTT CACCATTTTA

301  GGCGCGGTCG GGCTCAAATA CCGCACCTTC GCCTTCGGTG CACTCGCCGT

351  CGCCACCTAC ACCACACTTA CCTACACCCC CGAAACCTAC TGGCTGACCA

401  ACCCCTTCAT GATTTTATGC GGCACCGTAC TGTACAGCAC CGCCATCCTC

451  CTGTTCCAAA TCGTCCTGCC CCACCGCCCC GTCCAAGAAA GCGTCGCCAA

501  CGCCTACGAC GCACTCGGCG GCTACCTCGA AGCCAAAGCC GACTTCTTCG

551  ACCCCGATGA GGCAGCCTGG ATAGGCAACC GCCACATCGA CCTCGCCATG

601  AGCAACACCG GCGTCATCAC CGCCTTCAAC CAATGCCGTT CCGCCCTGTT

651  TTACCGCCTT CGCGGCAAAC ACCGCCACCC GCGCACCGCC AAAATGCTGC

701  GTTACTACTT TGCCGCCCAA GACATACACG AACGCATCAG CTCCGCCCAC

751  GTCGATTATC AGGAAATGTC CGAAAAATTC AAAAACACCG ACATCATCTT

801  CCGCATCCAC CGCCTGCTCG AAATGCAGGG ACAAGCCTGC CGCAACACCG

851  CCCAAGCCCT GCGCGCAAGC AAAGACTACG TTTACAGCAA ACGCCTCGGC

901  CGCGCCATCG AAGGCTGCCG CCAATCGCTG CGCCTCCTTT CAGACAGCAA

951  CGACAGTCCC GACATCCGCC ACCTGCGCCG CCTTCTCGAC AACCTCGGCA

1001  GCGTCGACCA GCAGTTCCGC CAACTCCAGC ACAACGGCCT GCAGGCAGAA

1051  AACGACCGCA TGGGCGACAC CCGCATCGCC GCCCTCGAAA CCAGCAGCCT

1101  CAAAAACACC TGGCAGGCAA TCCGTCCGCA GCTAAACCTC GAATCAGGCG

1151  TATTCCGCCA TGCCGTCCGC CTGTCCCTCG TCGTTGCCGC CGCCTGCACC

1201  ATCGTCGAAG CCCTCAACCT CAACCTCGGC TACTGGATAC TACTGACCGC

1251  CCTTTTCGTC TGCCAACCCA ACTACACCGC CACCAAAAGC CGCGTCCGCC

1301  AGCGCATCGC CGGCACCGTA CTCGGCGTAA TCGTCGGCTC GCTCGTCCCC
```

-continued

```
1351    TACTTCACCC CGTCTGTCGA AACCAAACTC TGGATTGTCA TCGCCAGTAC
1401    CACCCTCTTT TTCATGACCC GCACCTACAA ATACAGTTTC TCCACCTTCT
1451    TCATTACCAT TCAAGCCCTG ACCAGCCTCT CCCTCGCAGG TTTGGACGTA
1501    TACGCCGCCA TGCCCGTACG CATCATCGAC ACCATTATCG GCGCATCCCT
1551    TGCCTGGGCG GCAGTCAGCT ACCTGTGGCC AGACTGGAAA TACCTCACGC
1601    TCGAACGCAC CGCCGCCCTT GCCGTATGCA GCAACGGTGC CTATCTCGAA
1651    AAAATCACCG AACGCCTCAA AAGCGGCGAA ACCGGCGACG ACGTCGAATA
1701    CCGCGCCACC CGCCGCCGCG CCCACGAACA CACCGCCGCC CTCAGCAGCA
1751    CCCTTTCCGA CATGAGCAGC GAACCCGCAA AATTCGCCGA CAGCCTGCCA
1801    CCCGGCTTTA CCCTGCTCAA AACCGGCTAC GCCCTGACCG GCTACATCTC
1851    CGCCCTCGGC GCATACCGCA GCGAAATGCA CGAAGAATGC AGCCCCGACT
1901    TTACCGCACA GTTCCACCTC GCCGCCGAAC ACACCGCCCA CATCTTCCAA
1951    CACCTGCCCG AAACCGAACC CGACGACTTT CAGACAGCAC TGGATACACT
2001    GCGCGGCGAA CTCGACACCC TCCGCACCCA CAGCAGCGGA ACACAAAGCC
2051    ACATCCTCCT CCAACAGCTC CAACTCATCG CCCGACAGCT CGAACCCTAC
2101    TACCGCGCCT ACCGCCAAAT TCCGCACAGG CAGCCCCAAA ATGCAGCCTG
2151    A
```

This corresponds to the amino acid sequence (SEQ ED NO: 106; ORF19-1):

```
  1    MKTPLLKPLL ITSLPVFASV FTAASIVWQL GEPKLAMPFV LGIIAGGLVD

51    LDNRLTGRLK NIITTVALFT LSSLTAQSTL GTGLPFILAM TLMTFGFTIL

101    GAVGLKYRTF APGALAVATY TTLTYTPETY WLTNPFMILC GTVLYSTAIL

151    LFQIVLPHRP VQESVANAYD ALGGYLEAKA DFFDPDEAAW IGNRHIDLAM

201    SNTGVITAFN QCRSALFYRL RGKHRHPRTA KMLRYYFAAQ DIHERISSAH

251    VDYQEMSEKF KNTDIIFRIH RLLEMQGQAC RNTAQALRAS KDYVYSKRLG

301    RAIEGCRQSL RLLSDSNDSP DIRHLRRLLD NLGSVDQQFR QLQHNGLQAE

351    NDRHGDTRIA ALETSSLKNT WQAIRPQLNL ESGVFRHAVR LSLVVAAACT

401    IVEALNLNLG YWILLTALFV CQPNYTATKS RVRQRIAGTV LGVIVGSLVP

451    YFTPSVETKL WIVIASTTLF FMTRTYKYSF STFFITIQAL TSLSLAGLDV

501    YAAMPVRIID TIIGASLAWA AVSYLWPDWK YLTLERTAAL AVCSNGAYLE

551    KITERLKSGE TGDDVEYRAT RRRAHEHTAA LSSTLSDMSS EPAKFADSLQ

601    PGFTLLKTGY ALTGYISALG AYRSEMHEEC SPDFTAQFHL AAEHTAHIFQ

651    HLPETEPDDF QTALDTLRGE LDTLRTHSSG TQSHILLQQL QLIARQLEPY

701    YRAYRQIPHR QPQNAA*
```

Computer analysis of this amino acid sequence gave the following results:
Homology with Predicted Transmenbrane Protein YHFK of *H. influenzae* (Accession Number P44289) (SEQ ID NO: 1120)

ORF19 (SEQ ID NO: 104) and YHFK proteins (SEQ ID NO: 1120) show 45% aa identity in 97 aa

```
orf19    6 LKPLLITSLPVFASVFTAASIVWQLGEPKLAMPFVLGIIAGGLVDLDNXXTGRLKNIITT  65
             L   +I+++PVF +V  AA  +W        +MP +LGIIAGGLVDLDN   TGRLKN+  T
YHFK     5 LNAKVISTIPVFIAVNIAAVGIWFFDISSQSMPLILGIIAGGLVDLDNRLTGRLKNVFFT  64 orf19   66 VALFTLSSLTAQSTLGTGLPFILAMTLMTXXFTILGA                        102
             +  F++SS   Q  +G  + +I+ MT++T  FT++GA
YHFK    65 LIAFSISSFIVQLHIGKPIQYIVLMTVLTFIFTMIGA                        101
```

Homology with Predicted ORF from *N.meningitidis* (Strain A) ORF19 (SEQ ID NO: 104) shows 92.2% identity over a 102aa overlap with an ORF (ORF19a) (SEQ ID NO: 108) from strain A of *N. meningitidis*:

```
                    10        20        30        40        50        60
orf19.pep MKTPLLKPLLITSLPVFASVFTAASIVWQLGEPKLAMPFVLGIIAGGLVDLDNXXTGRLK
          ||||  |||||||||||||||||||||||||||||||||||||||||||||||  |||||
orf19a    MKTPPLKPLLITSLPVFASVFTAASIVWQLGEPKLAMPFVLGIIAGGLVDLDNRLTGRLK
                    10        20        30        40        50        60

70        80        90       100
orf19.pep NIITTVALFTLSSLTAQSTLGTGLPFILAMTLMTXXFTILGAX
          |||:||||||||||:|||||||||||||||||||  |||:||
orf19a    NIIATVALFTLSSLVAQSTLGTGLPFILAMTLMTFGFTIMGAVGLKYRTFAFGALAVATY
                    70        80        90       100       110       120 orf19a    TTLTYTPETYWLTNPFMILCGTVLYSTAIILFQIILPHRPVQENVANAYEALGSYLEAKA
                   130       140       150       160       170       180
```

The complete length ORF19a nucleotide sequence (SEQ ID NO: 107) is:

```
   1  ATGAAAACCC CACCCCTCAA GCCTCTGCTC ATTACCTCGG TTCCCGTTTT
  51  CGCCAGTGTC TTTACCGCCG CCTCCATCGT CTGGCAGCTG GGCGAACCCA
 101  AGCTCGCCAT GCCCTTCGTA CTCGGCATCA TCGCTGGCGG CCTGGTCGAT
 151  TTGGACAACC GCCTGACCGG ACGGCTGAAA AACATCATCG CCACCGTCGC
 201  CCTGTTCACC CTCTCCTCAC TTGTCGCGCA AAGCACCCTC GGCACAGGTT
 251  TGCCATTCAT CCTCGCCATG ACCCTGATGA CTTTCGGCTT TACCATCATG
 301  GGCGCGGTCG GGCTGAAATA CCGCACCTTC GCCTTCGGCG CACTCGCCGT
 351  CGCCACCTAC ACCACACTTA CCTACACCCC CGAAACCTAC TGGCTGACCA
 401  ACCCCTTTAT GATTCTGTGC GGAACCGTAC TGTACAGCAC CGCCATCATC
 451  CTGTTCCAAA TCATCCTGCC CCACCGCCCC GTTCAAGAAA ACGTCGCCAA
 501  CGCCTACGAA GCACTCGGCA GCTACCTCGA AGCCAAAGCC GACTTTTTCG
 551  ATCCCGACGA AGCCGAATGG ATAGGCAACC GCCACATCGA CCTCGCCATG
 601  AGCAACACCG GCGTCATCAC CGCCTTCAAC CAATGCCGTT CCGCCCTGTT
 651  TTACCGCCTT CGCGGCAAAC ACCGCCACCC GCGCACCGCC AAAATGCTGC
 701  GCTACTACTT CGCCGCCCAA GACATACACG AACGCATCAG CTCCGCCCAC
 751  GTCGACTACC AAGAGATGTC CGAAAAATTC AAAAACACCG ACATCATCTT
```

```
             -continued
 801   CCGCATCCAC CGCCTGCTCG AAATGCAGGG ACAAGCCTGC CGCAACACCG

851   CCCAAGCCCT GCGCGCAAGC AAAGACTACG TTTACAGCAA ACGCCTCGGC

901   CGCGCCATCG AAGGCTGCCG CCAATCGCTG CGCCTCCTTT CAGACAGCAA

951   CGACAATCCC GACATCCGCC ACCTGCGCCG CCTTCTCGAC AACCTCGGCA

1001   GCGTCGACCA GCAGTTCCGC CAACTCCAGC ACAACGGCCT GCAGGCAGAA

1051   AACGACCGCA TGGGCGACAC CCGCATCGCC GCCCTCGAAA CCGGCAGCCT

1101   CAAAAACACC TGGCAGGCAA TCCGTCCGCA GCTAAACCTC GAATCAGGCG

1151   TATTCCGCCA TGCCGTCCGC CTGTCCCTTG TCGTTGCCGC CGCCTGCACC

1201   ATCGTCGAAG CCCTCAACCT CAACCTCGGC TACTGGATAC TACTGACCGC

1251   CCTTTTCGTC TGCCAACCCA ACTACACCGC CACCAAAAGC CGCGTCCGCC

1301   AGCGCATCGC CGGCACCGTA CTCGGCGTAA TCGTCGGCTC GCTCGTCCCC

1351   TACTTTACCC CCTCCGTCGA AACCAAACTC TGGATCGTCA TCGCCAGTAC

1401   CACCCTCTTT TTCATGACCC GCACCTACAA ATACAGCTTC TCGACATTTT

1451   TCATCACCAT TCAAGCCCTG ACCAGCCTCT CCCTCGCAGG GTTGGACGTA

1501   TACGCCGCCA TGCCCGTACG CATCATCGAC ACCATTATCG GCGCATCCCT

1551   TGCCTGGGCG GCAGTCAGCT ACCTGTGGCC AGACTGGAAA TACCTCACGC

1601   TCGAACGCAC CGCCGCCCTT GCCGTATGCA GCAACGGCGC CTATCTCGAA

1651   AAAATCACCG AACGCCTCAA AAGCGGCGAA ACCGGCGACG ACGTCGAATA

1701   CCGCGCCACC CGCCGCCGCG CCCACGAACA CACCGCCGCC CTCAGCAGCA

1751   CCCTTTCCGA CATGAGCAGC GAACCCGCAA AATTCGCCGA CAGCCTGCAA

1801   CCCGGCTTTA CCCTGCTCAA AACCGGCTAC GCCCTGACCG GCTACATCTC

1851   CGCCCTCGGC GCATACCGCA GCGAAATGCA CGAAGAATGC AGCCCCGACT

1901   TTACCGCACA GTTCCACCTC GCCGCCGAAC ACACCGCCCA CATCTTCCAA

1951   CACCTGCCCG AAACCGAACC CGACGACTTT CAGACAGCAC TGGATACACT

2001   GCGCGGCGAA CTCGACACCC TCCGCACCCA CAGCAGCGGA ACACAAAGCC

2051   ACATCCTCCT CCAACAGCTC CAACTCATCG CCCGGCAGCT CGAACCCTAC

2101   TACCGCGCCT ACCGACAAAT TCCGCACAGG CAGCCCCAAA ACGCAGCCTG

2151   A
```

This encodes a protein having amino acid sequence (SEQ ID NO: 108):

```
  1   MKTPPLKPLL ITSLPVFASV FTAASIVWQL GEPKLAMPFV LGIIAGGLVD

51   LDNRLTGRLK NIIATVALFT LSSLVAQSTL GTGLPFILAM TLMTFGFTIM

101   GAVGLKYRTF AFGALAVATY TTLTYTPETY WLTNPFMILC GTVLYSTAII

151   LFQIILPHRP VQENVANAYE ALGSYLEAKA DFFDPDEAEW IGNRHIDLAM

201   SNTGVITAFN QCRSALFYRL RGKHRHPRTA KMLRYYFAAQ DIHERISSAH

251   VDYQEMSEKF KNTDIIFRIH RLLEMQGQAC RNTAQALRAS KDYVYSKRLG

301   RAIEGCRQSL RLLSDSNDNP DIRHLRRLLD NLGSVDQQFR QLQHNGLQAE

351   NDRMGDTRIA ALETGSLKNT WQAIRPQLNL ESGVFRHAVR LSLVVAAACT

401   IVEALNLNLG YWILLTALFV CQPNYTATKS RVRQRIAGTV LGVIVGSLVP
```

```
                    -continued
451  YFTPSVETKL WIVIASTTLF FWTRTYKYSF STFFITIQAL TSLSLAGLDV

501  YAAMPVRIID TIIGASLAWA AVSYLWPDWK YLTLERTAAL AVCSNGAYLE

551  KITERLKSGE TGDDVEYRAT RRRAHEHTAA LSSTLSDMSS EPAKFADSLQ

601  PGFTLLKTGY ALTGYISALG AYRSEMHEEC SPDFTAQFHL AAEHTAHIFQ

651  HLPETEPDDF QTALDTLRGE LDTLRTHSSG TQSHILLQQL QLIARQLEPY

701  YRAYRQIPHR QPQNAA*
```

ORF19a (SEQ ID NO: 108) and ORF19-1 (SEQ ID NO: 106) show 98.3% identity in 716 aa overlap:

```
                     10         20         30         40         50         60
orf19a.pep   MKTPPLKPLLITSLPVFASVFTAASIVWQLGEPKLAMPFVLGIIAGGLVDLDNRLTGRLK
             ||||  ||||||||||||||||||||||||||||||||||||||||||||||||||||||
orf19-1      MKTPLLKPLLITSLPVFASVFTAASIVWQLGEPKLAMPFVLGIIAGGLVDLDNRLTGRLK
                     10         20         30         40         50         60

70         80         90        100        110        120
orf19a.pep   NIIATVALFTLSSLVAQSTLGTGLPFILAMTLMTFGFTIMGAVGLKYRTFAFGALAVATY
             |||:||||||||||:|||||||||||||||||||||||:|||||||||||||||||||||
orf19-1      NIITTVALFTLSSLTAQSTLGTGLPFILAMTLMTFGFTILGAVGLKYRTFAFGALAVATY
                     70         80         90        100        110        120

130        140        150        160        170        180
orf19a.pep   TTLTYTPETYWLTNPFMILCGTVLYSTAIILFQIILPHRPVQENVANAYEALGSYLEAKA
             |||||||||||||||||||||||||||||:||||:|||||||||:||||:||:|||||||
orf19-1      TTLTYTPETYWLTNPFMILCGTVLYSTAILLFQIVLPHRPVQESVANAYDALGGYLEAKA
                    130        140        150        160        170        180

190        200        210        220        230        240
orf19a.pep   DFFDPDEAEWIGNRHIDLAMSNTGVITAFNQCRSALFYRLRGKHRHPRTAKMLRYYFAAQ
             ||||||||| ||||||||||||||||||||||||||||||||||||||||||||||||||
orf19-1      DFFDPDEAAWIGNRHIDLAMSNTGVITAFNQCRSALFYRLRGKHRHPRTAKMLRYYFAAQ
                    190        200        210        220        230        240

250        260        270        280        290        300
orf19a.pep   DIHERISSAHVDYQEMSEKFKNTDIIFRIHRLLEMQGQACRNTAQALRASKDYVYSKRLG
             ||||||||||||||||||||||||||||||||||||||||||||||||||||||||||||
orf19-1      DIHERISSAHVDYQEMSEKFKNTDIIFRIHRLLEMQGQACRNTAQALRASKDYVYSKRLG
                    250        260        270        280        290        300

310        320        330        340        350        360
orf19a.pep   RAIEGCRQSLRLLSDSNDNPDIRHLRRLLDNLGSVDQQFRQLQHNGLQAENDRMGDTRIA
             |||||||||||||||||||:||||||||||||||||||||||||||||||||||||||||
orf19-1      RAIEGCRQSLRLLSDSNDSPDIRHLRRLLDNLGSVDQQFRQLQHNGLQAENDRMGDTRIA
                    310        320        330        340        350        360

370        380        390        400        410        420
orf19a.pep   ALETGSLKNTWQAIRPQLNLESGVFRHAVRLSLVVAAACTIVEALNLNLGYWILLTALFV
             ||||:|||||||||||||||||||||||||||||||||||||||||||||||||||||||
orf19-1      ALETSSLKNTWQAIRPQLNLESGVFRHAVRLSLVVAAACTIVEALNLNLGYWILLTALFV
                    370        380        390        400        410        420

430        440        450        460        470        480
orf19a.pep   CQPNYTATKSRVRQRIAGTVLGVIVGSLVPYFTPSVETKLWIVIASTTLFFMTRTYKYSF
             ||||||||||||||||||||||||||||||||||||||||||||||||||||||||||||
orf19-1      CQPNYTATKSRVRQRIAGTVLGVIVGSLVPYFTPSVETKLWIVIASTTLFFMTRTYKYSF
                    430        440        450        460        470        480

490        500        510        520        530        540
orf19a.pep   STFFITIQALTSLSLAGLDVYAAMPVRIIDTIIGASLAWAAVSYLWPDWKYLTLERTAAL
             ||||||||||||||||||||||||||||||||||||||||||||||||||||||||||||
orf19-1      STFFITIQALTSLSLAGLDVYAAMPVRIIDTIIGASLAWAAVSYLWPDWKYLTLERTAAL
                    490        500        510        520        530        540

550        560        570        580        590        600
orf19a.pep   AVCSNGAYLEKITERLKSGETGDDVEYRATRRRAHEHTAALSSTLSDMSSEPAKFADSLQ
             ||||||||||||||||||||||||||||||||||||||||||||||||||||||||||||
orf19-1      AVCSNGAYLEKITERLKSGETGDDVEYRATRRRAHEHTAALSSTLSDMSSEPAKFADSLQ
                    550        560        570        580        590        600
```

```
                        -continued
                610       620       630       640       650       660
orf19a.pep   PGFTLLKTGYALTGYISALGAYRSEMHEECSPDFTAQFHLAAEHTAHIFQHLPETEPDDF
             ||||||||||||||||||||||||||||||||||||||||||||||||||||||||||||
orf19-1      PGFTLLKTGYALTGYISALGAYRSEMHEECSPDFTAQFHLAAEHTAHIFQHLPETEPDDF
                610       620       630       640       650       660

670       680       690       700       710
orf19a.pep   QTALDTLRGELDTLRTHSSGTQSHILLQQLQLIARQLEPYYRAYRQIPHRQPQNAAX
             ||||||||||||||||||||||||||||||||||||||||||||||||||||||||
orf19-1      QTALDTLRGELDTLRTHSSGTQSHILLQQLQLIARQLEPYYRAYRQIPHRQPQNAAX
                670       680       690       700       710
```

Homology with a Predicted ORF from *N.gonorrhoeae*

ORF19 (SEQ ID NO: 104) shows 95.1% identity over a 102aa overlap with a predicted ORF (ORF19.ng) (SEQ ID NO: 110) from *N. gonorrhoeae*:

```
orf19.pep   MKTPLLKPLLITSLPVFASVFTAASIVWQLGEPKLAMPFVLGIIAGGLVDLDNXXTGRLK   60
            |||||||||||||||||||||||||||||||||||||||||||||||||||| ||||
orf19ng     MKTPLLKPLLITSLPVFASVFTAASIVWQLGEPKLAMPFVLGIIAGGLVDLDNRLTGRLK   60 orf19.pep   NIITTVALFTLSSLTAQSTLGTGLPFILAMTLMTXXFTILGAX                   103
            ||| :||||||||||||||||||||||||||||||   ||||||
orf19ng     NIIATVALFTLSSLTAQSTLGTGLPFILAMTLMTFGFTILGAVGLKYRTFAFGALAVATY  120
```

An ORF19ng nucleotide sequence (SEQ ID NO: 109) is predicted to encode a protein having amino acid sequence (SEQ ID NO: 110):

```
  1   MKTPLLKPLL ITSLPVFASV FTAASIVWQL GEPKLAMPFV LGIIAGGLVD

51   LDNRLTGRLK NIIATVALFT LSSLTAQSTL GTGLPFILAM TLMTFGFTIL

101   GAVGLKYRTF AFGALAVATY TTLTYTPETY WLTNPFMILC GTVLYSTAII

151   LFQIILPHRP VQESVANAYE ALGGYLEAKA DFFDPDEAAW IGNRHIDLAM

201   SNTGVITAFN QCRSALFYRL RGKHRHPRTA KMLRYYFAAQ DIHERISSAH

251   VDYQEMSEKF KNTDIIFRIR RLLEMQGQAC RNTAQAIRSG KDYVYSKRLG

301   RAIEGCRQSL RLLSDGNDSP DIRHLSRLLD NLGSVDQQFR QLRHSDSPAE

351   NDRMGDTRIA ALETGSFKNT *
```

Further work revealed the complete nucleotide sequence (SEQ ID NO: 111):

```
  1   ATGAAAACCC CACTCCTCAA GCCTCTGCTC ATTACCTCGC TTCCCGTTTT

51   CGCCAGTGTC TTTACCGCCG CCTCCATCGT CTGGCAGCTA GGCGAACCCA

101   AGCTCGCCAT GCCCTTCGTA CTCGGCATCA TCGCCGGCGG CCTGGTCGAT

151   TTGGACAACC GCCTGACCGG ACGGCTGAAA AACATCATCG CCACCGTCGC

201   CCTGTTTACC CTCTCCTCGC TCACGGCGCA AAGCACCCTC GGCACAGGGC

251   TGCCCTTCAT CCTCGCCATG ACCCTGATGA CCTTCGGCTT TACCATTTTA

301   GGCGCGGTCG GGCTGAAATA CCGCACCTTC GCCTTCGGCG CACTCGCCGT

351   CGCCACCTAC ACCACGCTTA CCTACACCCC CGAAACCTAC TGGCTGACCA

401   ACCCCTTCAT GATTTTATGC GGCACCGTAC TGTACAGCAC CGCCATCATC

451   CTGTTCCAAA TCATCCTGCC CCACCGCCCC GTCCAAGAAA GCGTCGCCAA

501   TGCCTACGAA GCACTCGGCG GCTACCTCGA AGCCAAAGCC GACTTCTTCG
```

-continued

```
 551  ACCCCGATGA GGCAGCCTGG ATAGGCAACC GCCACATCGA CCTCGCCATG
 601  AGCAACACCG GCGTCATCAC CGCCTTCAAC CAATGCCGTT CCGCCCTGTT
 651  TTACCGTTTG CGCGGCAAAC ACCGCCACCC GCGCACCGCC AAAATGCTGC
 701  GCTACTACTT CGCCGCCCAA GACATCCACG AACGCATCAG CTCCGCCCAC
 751  GTCGACTACC AAGAGATGTC CGAAAAATTC AAAAACACCG ACATCATCTT
 801  CCGCATCCGC CGCCTGCTCG AAATGCAGGG GCAGGCGTGC CGCAACACCG
 851  CCCAAGCCAT CCGGTCGGGC AAAGACTAcg tTTACAGCAA ACGCCTCGGA
 901  CGCGCCATCg aaggctgCCG CCAGTCGCtg cgcctCCTTt cagacggcaA
 951  CGACAGTCCC GACATCCGCC ACCTGAGccg CCTTCTCGAC AACCTCGgca
1001  GCGTcgacca gcagtTCcgc caactCCGAC ACAgcgactC CCCCGCcgaa
1051  Aacgaccgca tgggcgacaC CCGCATCGCC GCCCtcgaaa ccggcagctT
1101  caaaaaCAcc tggcaggCAA TCCGTCCGCa gctgaaCCTC GAATCatgCG
1151  TATTCCGCCA TGCCGTCCGC CTGTCCCTCG TCGTTGCCGC CGCCTGCACC
1201  ATCGTCgaag cCCTCAACCT CAACCTCGGC TACTGGATAC TGCTGACCGC
1251  CCTTTTCGTC TGCCAACCCA ACTACACCGC CACCAAAAGC CGCGTGTACC
1301  AACGCATCGC CGGCACCGTA CTCGGCGTAA TCGTCGGCTC GCTCGTCCCC
1351  TACTTCACCC CCTCCGTCGA AACCAAACTC TGGATTGTCA TCGCCGGTAC
1401  CACCCTGTTC TTCATGACCC GCACCTACAA ATACAGTTTC TCCACCTTCT
1451  TCATCACCAT TCAGGCACTG ACCAGCCTCT CCCTCGCAGG TTTGGACGTA
1501  TACGCCGCCA TGCCCGTGCG CATCATCgaC ACCATTATCG GCGCATCCCT
1551  TGCCTGGGCG GCGGTCAGCT ACCTGTGGCC AGACTGGAAA TACCTCACGC
1601  TCGAACGCAC CGCCGCCCTT GCCGTATGCA GCAGCGGCAC ATACCTCCAA
1651  AAAATTGCCG AACGCCTCAA AACCGGCGAA ACCGGCGACG ACATAGAATA
1701  CCGCATCACC CGCCGCCGCG CCCACGAACA CACCGCCGCC CTCAGCAGCA
1751  CCCTTTCCGA CATGAGCAGC GAACCCGCAA AATTCGCCGA CAGCCTGCAA
1801  CCCGGCTTTA CCCTGCTCAA AACCGGCTAC GCCCTGACCG GCTACATCTC
1851  CGCCCTCGGC GCATACCGCA GCGAAATGCA CGAAGAATGC AGCCCCGACT
1901  TTACCGCACA GTTCCACCTT GCCGCCGAAC ACACCGCCCA CATCTTCCAA
1951  CACCTGCCCG ACATGGGACC CGACGACTTT CAGACGGCAT GGATACACT
2001  GCGCGGCGAA CTCGGCACCC TCCGCACCCG CAGCAGCGGA ACACAAAGCC
2051  ACATCCTCCT CCAACAGCTC CAACTCATCG CccgGCAACT CGAACCCTAC
2101  TACCGCGCCT ACCGACAAAT TCCGCACAGG CAGCCCCAAA ACGCAGCCTG
2151  A
```

This corresponds to the amino acid sequence (SEQ ID NO: 112; ORF19ng-1):

```
  1  MKTPLLKPLL ITSLPVFASV FTAASIVWQL GEPKLAMPFV LGIIAGGLVD
 51  LDNRLTGRLK NIIATVALFT LSSLTAQSTL GTGLPFILAM TLMTFGFTIL
101  GAVGLKYRTF AFGALAVATY TTLTYTPETY WLTNPFMILC GTVLYSTAII
151  LFQIILPHRP VQESVANAYE ALGGYLEAKA DFFDPDEAAW IGNRHIDLAM
```

```
                 -continued
201  SNTGVITAFN QCRSALFYRL RGKHRHPRTA KMLRYYFAAQ DIHERISSAH

251  VDYQEMSEKF KNTDIIFRIR RLLEMQGQAC RNTAQAIRSG KDYVYSKRLG

301  RAIEGCRQSL RLLSDGNDSP DIRHLSRLLD NLGSVDQQFR QLRHSDSPAE

351  NDRMGDTRIA ALETGSFKNT WQAIRPQLNL ESCVFRHAVR LSLVVAAACT

401  IVEALNLNLG YWILLTALFV CQPNYTATKS RVYQRIAGTV LGVIVGSLVP

451  YFTPSVETKL WIVIAGTTLF FMTRTYKYSF STFFITIQAL TSLSLAGLDV

501  YAAMPVRIID TIIGASLAWA AVSYLWPDWK YLTLERTAAL AVCSSGTYLQ

551  KIAERLKTGE TGDDIEYRIT RRRAHEHTAA LSSTLSDMSS EPAKFADSLQ

601  PGFTLLKTGY ALTGYISALG AYRSEMHEEC SPDFTAQFHL AAEHTAHIFQ

651  HLPDMGPDDF QTALDTLRGE LGTLRTRSSG TQSHILLQQL QLIARQLEPY

701  YRAYRQIPHR QPQNAA*
```

ORF19ng-1 (SEQ ID NO: 112) and ORF19-1 (SEQ ID NO: 106) show 95.5% identity in 716 aa overlap:

```
                    10         20         30         40         50         60
orf19-1.pep MKTPLLKPLLITSLPVFASVFTAASIVWQLGEPKLAMPFVLGIIAGGLVDLDNRLTGRLK
            ||||||||||||||||||||||||||||||||||||||||||||||||||||||||||||
orf19ng-1   MKTPLLKPLLITSLPVFASVFTAASIVWQLGEPKLAMPFVLGIIAGGLVDLDNRLTGRLK
                    10         20         30         40         50         60

70         80         90        100        110        120
orf19-1.pep NIITTVALFTLSSLTAQSTLGTGLPFILAMTLMTFGFTILGAVGLKYRTFAFGALAVATY
            |||:||||||||||||||||||||||||||||||||||||||||||||||||||||||||
orf19ng-1   NIIATVALFTLSSLTAQSTLGTGLPFILAMTLMTFGFTILGAVGLKYRTFAFGALAVATY
                    70         80         90        100        110        120

130        140        150        160        170        180
orf19-1.pep TTLTYTPETYWLTNPFMILCGTVLYSTAILLFQIVLPHRPVQESVANAYDALGGYLEAKA
            ||||||||||||||||||||||||||||||:||||:||||||||||||||||:|||||||
orf19ng-1   TTLTYTPETYWLTNPFMILCGTVLYSTAIILFQIILPHRPVQESVANAYEALGGYLEAKA
                   130        140        150        160        170        180

190        200        210        220        230        240
orf19-1.pep DFFDPDEAAWIGNRHIDLAMSNTGVITAFNQCRSALFYRLRGKHRHPRTAKMLRYYFAAQ
            ||||||||||||||||||||||||||||||||||||||||||||||||||||||||||||
orf19ng-1   DFFDPDEAAWIGNRHIDLAMSNTGVITAFNQCRSALFYRLRGKHRHPRTAKMLRYYFAAQ
                   190        200        210        220        230        240

250        260        270        280        290        300
orf19-1.pep DIHERISSAHVDYQEMSEKFKNTDIIFRIHRLLEMQGQACRNTAQALRASKDYVYSKRLG
            |||||||||||||||||||||||||||||:||||||||||||||||:|::||||||||||
orf19ng-1   DIHERISSAHVDYQEMSEKFKNTDIIFRIRRLLEMQGQACRNTAQAIRSGKDYVYSKRLG
                   250        260        270        280        290        300

310        320        330        340        350        360
orf19-1.pep RAIEGCRQSLRLLSDSNDSPDIRHLRRLLDNLGSVDQQFRQLHNGLQAENDRMGDTRIA
            ||||||||||||||:|||:|:  ||||||||||||||||||:|:   ||||||||||||
orf19ng-1   RAIEGCRQSLRLLSDGNDSPDIRHLSRLLDNLGSVDQQFRQLRHSDSPAENDRMGDTRIA
                   310        320        330        340        350        360

370        380        390        400        410        420
org19-1.pep ALETSSLKNTWQAIRPQLNLESGVFRHAVRLSLVVAAACTIVEALNLNLGYWILLTALFV
            ||||:|:|||||||||||||  ||||||||||||||||||||||||||||||||||||||
orf19ng-1   ALETGSFKNTWQAIRPQLNLESCVFRHAVRLSLVVAAACTIVEALNLNLGYWILLTALFV
                   370        380        390        400        410        420

430        440        450        460        470        480
org19-1.pep CQPNYTATKSRVRQRIAGTVLGVIVGSLVPYFTPSVETKLWIVIASTTLFFMTRTYKYSF
            |||||||||| ||||||||||||||||||||||||||||||||||:||||||||||||||
orf19ng-1   CQPNYTATKSRVYQRIAGTVLGVIVGSLVPYFTPSVETKLWIVIAGTTLFFMTRTYKYSF
                   430        440        450        460        470        480
```

```
                   490        500        510        520        530        540
orf19-1.pep STFFITIQALTSLSLAGLDVYAAMPVRIIDTIIGASLAWAAVSYLWPDWKYLTLERTAAL
            ||||||||||||||||||||||||||||||||||||||||||||||||||||||||||||
orf19ng-1   STFFITIQALTSLSLAGLDVYAAMPVRIIDTIIGASLAWAAVSYLWPDWKYLTLERTAAL
                   490        500        510        520        530        540

550        560        570        580        590        600
orf19-1.pep AVCSNGAYLEKITERLKSGETGDDVEYRATRRRAHEHTAALSSTLSDMSSEPAKFADSLQ
            ||||:|:||:||:||||:||||||:|||  ||||||||||||||||||||||||||||||
orf19ng-1   AVCSSGTYLQKIAERLKTGETGDDIEYRITRRRAHEHTAALSSTLSDMSSEPAKFADSLQ
                   550        560        570        580        590        600

610        620        630        640        650        660
orf19-1.pep PGFTLLKTGYALTGYISALGAYRSEMHEECSPDFTAQFHLAAEHTAHIFQHLPETEPDDF
            ||||||||||||||||||||||||||||||||||||||||||||||||||||:  ||||
orf19ng-1   PGFTLLKTGYALTGYISALGAYRSEMHEECSPDFTAQFHLAAEHTAHIFQHLPDMGPDDF
                   610        620        630        640        650        660

670        680        690        700        710
orf19-1.pep QTALDTLRGELDTLRTHSSGTQSHILLQQLQLIARQLEPYYRAYRQIPHRQPQNAAX
            |||||||||||| ||||:||||||||||||||||||||||||||||||||||||||
orf19ng-1   QTALDTLRGELGTLRTRSSGTQSHILLQQLQLIARQLEPYYRAYRQIPHRQPQNAAX
                   670        680        690        700        710
```

In addition, ORF19ng-1 (SEQ ID NO: 112) shows significant homology to a hypothetical gonococcal protein (SEQ ID NO: 1121) previously entered in the databases:

```
sp|O33369|YOR2_NEIGO HYPOTHETICAL 45.5 KD PROTEIN (ORF2) gnl|PID|e1154438
(AJ002423) hypothetical protein [Neisseria gonorrh] Length = 417
 Score = 1512 (705.6 bits), Expect = 5.3e-203, P = 5.3e-203
 Identities = 301/326 (92%), Positives = 306/326 (93%)

Query:  307 RQSLRLLSDGNDSPDIRHLSRLLDNLGSVDQQFRQLRHSDSPAENDRMGDTRIAALETGS  366
            RQSLRLLSDGNDS DIRHLSRLLDNLGSVDQQFRQLRHSDSPAENDRMGDTRIAALETGS
Sbjct:    1 RQSLRLLSDGNDSXDIRHLSRLLDNLGSVDQQFRQLRHSDSPAENDRMGDTRIAALETGS   60

Query:  367 FKNTWQAIRPQLNLESCVFRHAVRLSLVVAAACTIVEALNLNLGYWILLTALFVCQPNYT  426
            FKNTWQAIRPQLNLES VFRHAVRLSLVVAAACTIVEALNLNLGYWILLT LFVCQPNYT
Sbjct:   61 FKNTWQAIRPQLNLESGVFRHAVRLSLVVAAACTIVEALNLNLGYWILLTRLFVCQPNYT  120

Query:  427 ATKSRVYQRIAGTVLGVIVGSLVPYFTPSVETKLWIVIAGTTLFFMTRTYKYSFSTFFIT  486
            ATKSRVYQRIAGTVLGVIVGSLVPYFTPSVETKLWIVIAGTTLFFMTRTYKYSFSTFFIT
Sbjct:  121 ATKSRVYQRIAGTVLGVIVGSLVPYFTPSVETKLWIVIAGTTLFFMTRTYKYSFSTFFIT  180

Query:  487 IQALTSLSLAGLDVYAAMPVRIIDTIIGASLAWAAVSYLWPDWKYLTLERTAALAVCSSG  546
            IQALTSLSLAGLDVYAAMPVRIIDTIIGASLAWAAVSYLWPDWKYLTLERTAALAVCSSG
Sbjct:  181 IQALTSLSLAGLDVYAAMPVRIIDTIIGASLAWAAVSYLWPDWKYLTLERTAALAVCSSG  240

Query:  547 TYLQKIAERLKTGETGDDIEYRITRRRAHEHTAALSSTLSDMSSEPAKFADSLQPGFTLL  606
            TYLQKIAERLKTGETGDDIEYRITRRRAHEHTAALSSTLSDMSSEPAKFAD+ P
Sbjct:  241 TYLQKIAERLKTGETGDDIEYRITRRRAHEHTAALSSTLSDMSSEPAKFADTCNPALPCS  300

Query:  607 KTGYALTGYISALGAYRSEMHEECSP                                   632
            K    ALTGYISALG  ++   +   +P
Sbjct:  301 KPATALTGYISALGHTAAKCTKNAAP                                   326
```

Based on this analysis, including the presence of several putative transmembrane domains in the gonococcal protein (the first of which is also seen in the meningococcal protein), and on homology with the YHFK protein (SEQ ID NO: 1120), it is predicted that the proteins from *N.meningitidis* and *N.gonorrhoeae*, and their epitopes, could be useful antigens for vaccines or diagnostics, or for raising antibodies.

Example 14

The following DNA sequence, believed to be complete, was identified in *N.meningitidis* (SEQ ID NO: 113):

```
  1 ATGAATATGC TGGGAGCTTT GGCAAAAGTC GGCAGCCTGA CGATGGTGTC

51 GCGCGTTTTG GGATTTGTGC GCGATACGGT CATTGCGCGG GCATTCGGCG

101 CGGGTATGGC GACGGATGCG TTTTTTGTCG CGTTCAAACT GCCCAACCTG
```

```
-continued
 151    CTTCGCCGCG TGTTTGCGGA GGGGGCGTTT GCCCAAGCGT TTGTGCCGAT
 201    TTTGGCGGAA TACAAGGAAA CGCGTTCAAA AGAGGCGG.C GAAGCCTTTA
 251    TCCGCCATGT GGCGGGGATG CTGTCGTTTG TACTGGTTAT CGTTACCGCG
 301    CTGGGCATAC TTGCCGCGCC TTGGGTGATT TATGTTTCCG CACCCGAGTT
 351    TTGCCCAAGA TGCCGACAAA TTTCAGCTCT CCATCGATTT GCTGCGGATT
 401    ACGTTTCCTT ATATATTATT GATTTCCCTG TCTTCATTTG TCGGCTCGGT
 451    ACTCAATTCT TATCATAAGT TCGGCATTCC GGCGTTTACG CCAC.GTTTC
 501    TGAACGTGTC GTTTATCGTA TTCGCGCTGT TTTTCGTGCC GTATTTCGAT
 551    CCGCCCGTTA CCGCGCyGGC GTGGGCGGTC TTTGTCGGCG GCATTTTGCA
 601    ACTCGrmTTC CAACTGCCCT GGCTGGCGAA ACTGGGCTTT TTGAAACTGC
 651    CCAAACtGAG TTTCAAAGAT GCGGCGGTCA ACCGCGTGAT GAAACAGATG
 701    GCGCCTGCgA TTTTgGGCGT GAgCGTGGCG CAGGTTTCTT TGGTGATCAA
 751    CACGATTTTc GCGTCTTATC TGCAATCGGG CAGCGTTTCA TGGATGTATT
 801    ACGCCGACCG CATGATGGAG CTGCCCAGCG GCGTGCTGGG GGCGGCACTC
 851    GGTACGATTT TGCTGCCGAC TTTGTCCAAA CACTCGGCAA ACCaAGATAC
 901    GGaACAGTTT TCCGCCCTGC TCGACTGGGG TTTGCGCCTG TGCATGCtgc
 951    TGACGCTGCC GGCGgcGGTC GGACTGGCGG TGTTGTCGTT cCCgCtGGTG
1001    GCGACGCTGT TTATGTACCG CGwATTTACG CTGTTTGACG CGCAGATGAC
1051    GCAACACGCG CTGATTGCCT ATTCTTTCGG TTTAATCGGC TTAATCATGA
1101    TTAAAGTGTT GGCACCCGGC TTCTATGCGC GGCAAAACAT CAAwAmGCCC
1151    GTCAAAATCG CCATCTTCAC GCTCATCTGC mCGCAGTTGA TGAACCTTGs
1201    CTTTAyCGGC CCACTrrAAC rCagTCGGAC TTTCGCTTGC CATCGGTCTG
1251    GGCGCGTGTA TCAATGCCGG ATTGTTGTTT TACCTGTTGC GCAGACACGG
1301    TATTTACCAA CCTGG.CAAG GGTTGGGCAG CGTTCTT.AG CAAAAATGCT
1351    GcTCTCGCTC GCCGTGA
```

This corresponds to the amino acid sequence (SEQ ID NO: 114; ORF20):

```
  1    MNMLGALAKV GSLTMVSRVL GFVRDTVIAR AFGAGMATDA FFVAFKLPNL

51    LRRVFAEGAF AQAFVPILAE YKETRSKEAX EAFIRHVAGM LSFVLIVTA

101    LGILAAPWVI YVSAPSFAQD ADKFQLSIDL LRITFPYILL ISLSSFVGSV

151    LNSYHKFGIP AFTPXFLNVS FIVFALFFVP YFDPPVTAXA WAVFVGGILQ

201    LXFQLPWLAK LGFLKLPKLS FKDAAVNRVM KQMAPAILGV SVAQVSLVIN

251    TIFASYLQSG SVSWMYYADR MMELPSGVLG AALGTILLPT LSKHSANQDT

301    EQFSALLDWG LRLCMLLTLP AAVGLAVLSF PLVATLFMYR XFTLFDAQMT

351    QHALIAYSFG LIGLIMIKVL APGFYARQNI XXPVKIAIFT LICXQLMNLX

401    FXGPLXXIGL SLAIGLGACI NAGLLFYLLR RHGIYQPXQG LGSVLXQKCC

451    SRSP*
```

These sequences were elaborated, and the complete DNA sequence (SEQ ID NO: 115) is:

```
   1  ATGAATATGC TGGGAGCTTT GGCAAAAGTC GGCAGCCTGA CGATGGTGTC
  51  GCGCGTTTTG GGATTTGTGC GCGATACGGT CATTGCGCGG GCATTCGGCG
 101  CGGGTATGGC GACGGATGCG TTTTTTGTCG CGTTCAAACT GCCCAACCTG
 151  CTTCGCCGCG TGTTTGCGGA GGGGGCGTTT GCCCAAGCGT TTGTGCCGAT
 201  TTTGGCGGAA TACAAGGAAA CGCGTTCAAA AGAGGCGGCG GAGGCTTTTA
 251  TCCGCCATGT GGCGGGGATG CTGTCGTTTG TACTGGTTAT CGTTACCGCG
 301  CTGGGCATAC TTGCCGCGCC TTGGGTGATT TATGTTTCCG CACCCGGTTT
 351  TGCCCAAGAT GCCGACAAAT TCAGCTCTC CATCGATTTG CTGCGGATTA
 401  CGTTTCCTTA TATATTATTG ATTTCCCTGT CTTCATTTGT CGGCTCGGTA
 451  CTCAATTCTT ATCATAAGTT CGGCATTCCG GCGTTTACGC CCACGTTTCT
 501  GAACGTGTCG TTTATCGTAT TCGCGCTGTT TTTCGTGCCG TATTTCGATC
 551  CGCCCGTTAC CGCGCTGGCG TGGGCGGTCT TTGTCGGCGG CATTTTGCAA
 601  CTCGGCTTCC AACTGCCCTG GCTGGCGAAA CTGGGCTTTT TGAAACTGCC
 651  CAAACTGAGT TCAAAGATG CGGCGGTCAA CCGCGTGATG AAACAGATGG
 701  CGCCTGCGAT TTTGGGCGTG AGCGTGGCGC AGGTTTCTTT GGTGATCAAC
 751  ACGATTTTCG CGTCTTATCT GCAATCGGGC AGCGTTTCAT GGATGTATTA
 801  CGCCGACCGC ATGATGGAGC TGCCCAGCGG CGTGCTGGGG GCGGCACTCG
 851  GTACGATTTT GCTGCCGACT TTGTCCAAAC ACTCGGCAAA CCAAGATACG
 901  GAACAGTTTT CCGCCCTGCT CGACTGGGGT TTGCGCCTGT GCATGCTGCT
 951  GACGCTGCCG GCGGCGGTCG GACTGGCGGT GTTGTCGTTC CCGCTGGTGG
1001  CGACGCTGTT TATGTACCGC GAATTTACGC TGTTTGACGC GCAGATGACG
1051  CAACACGCGC TGATTGCCTA TTCTTTCGGT TTAATCGGCT TAATCATGAT
1101  TAAAGTGTTG GCACCCGGCT TCTATGCGCG GCAAAACATC AAAACGCCCG
1151  TCAAAATCGC CATCTTCACG CTCATCTGCA CGCAGTTGAT GAACCTTGCC
1201  TTTATCGGCC CACTGAAACA CGTCGGACTT TCGCTTGCCA TCGGTCTGGG
1251  CGCGTGTATC AATGCCGGAT TGTTGTTTTA CCTGTTGCGC AGACACGGTA
1301  TTTACCAACC TGGCAAGGGT TGGGCAGCGT TCTTAGCAAA AATGCTGCTC
1351  TCGCTCGCCG TGATGTGCGG CGGACTGTGG GCAGCGCAGG CTTACCTGCC
1401  GTTTGAATGG GCGCACGCCG GCGGAATGCG GAAAGCGGGG CAGCTCTGCA
1451  TCCTGATTGC CGTCGGCGGC GGACTGTATT TCGCATCACT GGCGGCTTTG
1501  GGCTTCCGTC CGCGCCATTT CAAACGCGTG GAAAACTGA
```

This corresponds to the amino acid sequence (SEQ ID NO: 116; ORF20-1):

```
   1  MNMLGALAKV GSLTMVSRVL GFVRDTVIAR AFGAGMATDA FFVAFKLPNL
  51  LRRVFAEGAF AQAFVPILAE YKETRSKEAA EAFIRHVAGM LSFVLVIVTA
 101  LGILAAPWVI YVSAPGFAQD ADKFQLSIDL LRITFPYILL ISLSSFVGSV
 151  LNSYHKFGIP AFTPTFLNVS FIVFALFFVP YFDPPVTALA WAVFVGGILQ
```

-continued
```
201 LGFQLPWLAK LGFLKLPKLS FKDAAVNRVM KQMAPAILGV SVAQVSLVIN

251 TIFASYLQSG SVSWMYYADR MMELPSGVLG AALGTILLPT LSKHSANQDT

301 EQFSALLDWG LRLCMLLTLP AAVGLAVLSF PLVATLFMYR EFTLFDAQMT

351 QHALIAYSFG LIGLIMIKVL APGFYARQNI KTPVKIAIFT LICTQLMNLA

401 FIGPLKHVGL SLAIGLGACI NAGLLFYLLR RHGIYQPGKG WAAFLAKMLL

451 SLAVMCGGLW AAQAYLPFEW AHAGGMRKAG QLCILIAVGG GLYFASLAAL

501 GFRPRHFKRV EN*
```

Computer analysis of this amino acid sequence gave the following results:
Homology with the MviN Virulence Factor of *S. typhimurium* (Accession Number P37169) (SEQ ID NO: 1122)
ORF20 (SEQ ID NO: 114) and MviN proteins (SEQ ID NO: 1122) show 63% aa identity in 440aa overlap:

```
Orf20    1 MNMLGALAKVGSLTMVSRVLGFVRDTVIARAFGAGMATDAFFVAFKLPNLLRRVFAEGAF   60
           MN+L +LA V S+TM SRVLGF RD ++AR FGAGMATDAFFVAFKLPNLLRR+FAEGAF
MviN    14 MNLLKSLAAVSSMTMFSRVLGFARDAIVARIFGAGMATDAFFVAFKLPNLLRRIFAEGAF   73

Orf20   61 AQAFVPILAEYKETRSKEAXEAFIRHVAGMLSFVLVIVTALGILAAPWVIYVSAPSFAQD  120
           +QAFVPILAEYK  + +EA   F+ +V+G+L+   L +VT  G+LAAPWVI V+AP FA
MviN    74 SQAFVPILAEYKSKQGEEATRIFVAYVSGLLTLALAVVTVAGMLAAPWVIMVTAPGFADT  133

Orf20  121 ADKFQLSIDLLRITFPYILLISLSSFVGSVLNSYHKFGIPAFTPXFLNVSFIVFALFFVP  180
           ADKF L+  LLRITFPYILLISL+S VG++LN++++F IPAF P FLN+S I FALF  P
MviN   134 ADKFALTTQLLRITFPYILLISLASLVGAILNTWNRFSIPAFAPTFLNISMIGFALFAAP  193

Orf20  181 YFDPPVTAXAWAVFVGGILQLXFQLPWLAKLGFLKLPKLSFKDAAVNRVMKQMAPAILGV  240
           YF+PPV A AWAV VGG+LQL +QLP+L K+G L LP+++F+D    RV KQM PAILGV
MviN   194 YFNPPVLALAWAVTVGGVLQLVYQLPYLKKIGMLVLPRINFRDTGAMRVVKQMGPAILGV  253

Orf20  241 SVAQVSLVINTIFASYLQSGSVSWMYYADRMMELPSGVLGAALGTILLPTLSKHSANQDT  300
           SV+Q+SL+INTIFAS+L SGSVSWMYYADR+ME PSGVLG ALGTILLP+LSK  A+ +
MviN   254 SVSQISLIINTIFASFLASGSVSWMYYADRLMEFPSGVLGVALGTILLPSLSKSFASGNH  313

Orf20  301 EQFSALLDWGLRLCMLLTLPAAVGLAVLSFPLVATLFMYRXFTLFDAQMTQHALIAYSFG  360
            +++  L+DWGLRLC LL LP+AV L +L+ PL  +LF Y  FT FDA MTQ ALIAYS G
MviN   314 DEYCRLMDWGLRLCFLLALPSAVALGILAKPLTVSLFQYGKFTAFDAAMTQRALIAYSVG  373

Orf20  361 LIGLIMIKVLAPGFYARQNIXXPVKIAIFTLICXQLMNLXFXXXXXXXXXXXXXXXXXCI  420
           LIGLI++KVLAPGFY+RQ+I  PVKIAI TLI  QLMNL F                C+
MviN   374 LIGLIVVKVLAPGFYSRQDIKTPVKIAIVTLIMTQLMNLAFIGPLKHAGLSLSIGLAACL  433

Orf20  421 NAGLLFYLLRRHGIYQPXQG                                         440
           NA LL++ LR+  I +P G
MviN   434 NASLLYWQLRKQNIFTPQPG                                         453
```

Homology with a Predicted ORF from *N.meningitidis* (Strain A) ORF20 (SEQ ID NO: 114) shows 93.5% identity over a 447aa overlap with an ORF (ORF20a) (SEQ ID NO: 118) from strain A of *N. meningitidis*:

```
                    10        20        30        40        50        60
orf20.pep  MNMLGALAKVGSLTMVSRVLGFVRDTVIARAFGAGMATDAFFVAFKLPNLLRRVFAEGAF
           ||||||:|||||||||||||||||||||||||||||||||||||||||||||||||||||
orf20a     MNMLGALVKVGSLTMVSRVLGFVRDTVIARAFGAGMATDAFFVAFKLPNLLRRVFAEGAF
                    10        20        30        40        50        60

70        80        90       100       110       120
orf20.pep  AQAFVPILAEYKETRSKEAXEAFIRHVAGMLSFVLVIVTALGILAAPWVIYVSAPSFAQD
           |||||||||||||||||||:||||||||||||||||||||||||||||||||||:||:|
orf20a     AQAFVPILAEYKETRSKEATEAFIRHVAGMLSFVLVIVTALGILAAPWVIYVSAPGFAKD
                    70        80        90       100       110       120
```

-continued

```
              130        140        150        160        170        180
orf20.pep  ADKFQLSIDLLRITFPYILLISLSSFVGSVLNSYHKFGIPAFTPXFLNVSFIVFALFFVP
           |||||||||||||||||||||||||||||||||||||:||||||:|||||||||||||||
orf20a     ADKFQLSIDLLRITFPYILLISLSSFVGSVLNSYHKFSIPAFTPTFLNVSFIVFALFFVP
              130        140        150        160        170        180

190        200        210        220        230        240
orf20.pep  YFDPPVTAXAWAVFVGGILQLXFQLPWLAKLGFLKLPKLSFKDAAVNRVMKQMAPAILGV
           ||||||||| ||||||||||||| ||||||||||||||||||||||||||||||||||||
orf20a     YFDPPVTALAWAVFVGGILQLGFQLPWLAKLGFLKLPKLSFKDAAVNRVMKQMAPAILGV
              190        200        210        220        230        240

250        260        270        280        290        300
orf20.pep  SVAQVSLVINTIFASYLQSGSVSWMYYADRMMELPSGVLGAALGTILLPTLSKHSANQDT
           ||||:|||||||||||||||||||||||||||||||||:|||||||||||||||||||||
orf20a     SVAQISLVINTIFASYLQSGSVSWMYYADRMMELPGGVLGAALGTILLPTLSKHSANQDT
              250        260        270        280        290        300

310        320        330        340        350        360
orf20.pep  EQFSALLDWGLRLCMLLTLPAAVGLAVLSFPLVATLFMYRXFTLFDAQMTQHALIAYSFG
           |||||||||||| ||·||||||||||:|||||||||||||| ||||||||||||||||||
orf20a     EQFSALLDWGLRXCMLLTLPAAVGMAVLSFPLVATLFMYREFTLFDAQMTQHALIAYSFG
              310        320        330        340        350        360

370        380        390        400        410        420
orf20.pep  LIGLIMIKVLAPGFYARQNIXXPVKIAIFTLICXQLMNLXFXGPLXXIGLSLAIGLGACI
           |||||||||||||||||||||:||||||||||:||||| ||| :||||||||||
orf20a     LIGLIMIKVLAPGFYARQNIKTPVKIAIFTLICTQLMNLAFIGPLKHVGLSLAIGLGACI
              370        380        390        400        410        420

430        440        450
orf20.pep  NAGLLFYLLRRHGIYQPXQGLGSVLXQKCCSRSPX
           |||||||||||||||||| :|  ::  |   :
orf20a     NAGLLFYLLRRHGIYQPGKGWAAFLAKMLLSLAVMGGGLYAAQIWLPFDWAHAGGMQKAA
              430        440        450        460        470        480
```

The complete length ORF20a nucleotide sequence (SEQ ID NO: 117) is:

```
  1    ATGAATATGC TGGGAGCTTT GGTAAAAGTC GGCAGCCTGA CGATGGTGTC

51    GCGCGTTTTG GGATTTGTGC GCGATACGGT CATTGCGCGC GCATTCGGCG

101    CAGGCATGGC GACGGATGCG TTCTTTGTCG CGTTCAAACT GCCCAACCTG

151    CTTCGCCGCG TGTTTGCGGA GGGGGCGTTT GCCCAAGCGT TTGTGCCGAT

201    TTTGGCGGAA TATAAGGAAA CGCGTTCTAA AGAGGCGACG GAGGCTTTTA

251    TCCGCCATGT GGCGGGGATG CTGTCGTTTG TACTGGTCAT CGTTACCGCG

301    CTGGGCATAC TTGCCGCGCC TTGGGTGATT TATGTTTCCG CACCCGGTTT

351    TGCCAAAGAT GCCGACAAAT TTCAGCTCTC TATCGATTTG CTGCGGATTA

401    CGTTTCCTTA TATCTTATTG ATTTCACTTT CCTCTTTTGT CGGCTCGGTA

451    CTCAATTCCT ATCATAAATT CAGCATTCCT GCGTTTACGC CACGTTCCT

501    GAACGTGTCG TTTATCGTAT TCGCGCTGTT TTTCGTGCCG TATTTCGATC

551    CTCCCGTTAC CGCGCTGGCT TGGGCGGTTT TTGTCGGCGG CATTTTGCAA

601    CTCGGCTTCC AACTGCCCTG GCTGGCGAAA CTGGGTTTTT TGAAACTGCC

651    CAAACTGAGT TCAAAGATG CGGCGGTCAA CCGCGTGATG AAACAGATGG

701    CGCCTGCGAT TTTGGGCGTG AGCGTGGCGC AGATTTCTTT GGTGATCAAC

751    ACGATTTTCG CGTCTTATCT GCAATCGGGC AGCGTTTCAT GGATGTATTA

801    CGCCGACCGC ATGATGGAAC TGCCCGGCGG CGTGCTGGGG GCGGCACTCG

851    GTACGATTTT GCTGCCGACT TTGTCCAAAC ACTCGGCAAA CCAAGATACG

901    GAACAGTTTT CCGCCCTGCT CGACTGGGGT TGCGCNTGT GCATGCTGCT
```

-continued

```
 951  GACGCTGCCG GCGGCGGTCG GAATGGCGGT GTTGTCGTTC CCGCTGGTGG
1001  CAACCTTGTT TATGTACCGA GAATTCACGC TGTTTGACGC GCAGATGACG
1051  CAACACGCGC TGATTGCCTA TTCTTTCGGT TTAATCGGTT TAATCATGAT
1101  TAAAGTGTTG GCGCCCGGCT TTTATGCGCG GCAAAACATC AAAACGCCCG
1151  TCAAAATCGC CATCTTCACG CTCATTTGCA CGCAGTTGAT GAACCTTGCC
1201  TTTATCGGCC CACTGAAACA CGTCGGACTT TCGCTTGCCA TCGGTCTGGG
1251  CGCGTGTATC AATGCCGGAT TGTTGTTTTA CCTGTTGCGC AGACACGGTA
1301  TTTACCAACC TGGCAAGGGT TGGGCAGCGT TCTTGGCAAA AATGCTGCTC
1351  TCGCTCGCCG TGATGGGAGG CGGCCTGTAT GCCGCCCAAA TCTGGCTGCC
1401  GTTCGACTGG GCACACGCCG GCGGAATGCA AAAGGCCGCC CGGCTCTTCA
1451  TCCTGATTGC CGTCGGCGGC GGACTGTATT TCGCATCACT GGCGGCTTTG
1501  GGCTTCCGTC CGCGCCATTT CAAACGCGTG GAAAGCTGA
```

This encodes a protein having amino acid sequence (SEQ ID NO: 118):

```
  1  MNMLGALVKV GSLTMVSRVL GFVRDTVIAR AFGAGMATDA FFVAFKLPNL
 51  LRRVFAEGAF AQAPVPILAE YKETRSKEAT EAFIRHVAGM LSFVLVIVTA
101  LGILAAPWVI YVSAPGFAKD ADKFQLSIDL LRITFPYILL ISLSSFVGSV
151  LNSYHKFSIP AFTPTFLNVS FIVFALFFVP YFDPPVTALA WAVFVGGILQ
201  LGFQLPWLAK LGFLKLPKLS FKDAAVNRVM KQMAPAILGV SVAQISLVIN
251  TIFASYLQSG SVSWMYYADR MMELPGGVLG AALGTILLPT LSKHSANQDT
301  EQFSALLDWG LRXCMLLTLP AAVGMAVLSF PLVATLFMYR EFTLFDAQMT
351  QHALIAYSFG LIGLIMIKVL APGFYARQNI KTPVKIAIFT LICTQLMNLA
401  FIGPLKHVGL SLAIGLGACI NAGLLFYLLR RHGIYQPGKG WAAFLAKMLL
451  SLAVMGGGLY AAQIWLPFDW AHAGGMQKAA RLFILIAVGG GLYFASLAAL
501  GFRPRHFKRV ES*
```

ORF20-1 (SEQ ID NO: 116) show 96.5% identity in 512 aa

```
              10         20         30         40         50         60
orf20a.pep  MNMLGALVKVGSLTMVSRVLGFVRDTVIARAFGAGMATDAFFVAFKLPNLLRRVFAEGAF
            |||||||:||||||||||||||||||||||||||||||||||||||||||||||||||||
orf20-1     MNMLGALAKVGSLTMVSRVLGFVRDTVIARAFGAGMATDAFFVAFKLPNLLRRVFAEGAF
              10         20         30         40         50         60

70         80         90        100        110        120
orf20a.pep  AQAFVPILAEYKETRSKEATEAFIRHVAGMLSFVLVIVTALGILAAPWVIYVSAPGFAKD
            ||||||||||||||||||||:|||||||||||||||||||||||||||||||||||||:|
orf20-1     AQAFVPILAEYKETRSKEAAEAFIRHVAGMLSFVLVIVTALGILAAPWVIYVSAPGFAQD
              70         80         90        100        110        120

130        140        150        160        170        180
orf20a.pep  ADKFQLSIDLLRITFPYILLISLSSFVGSVLNSYHKFSIPAFTPTFLNVSFIVFALFFVP
            ||||||||||||||||||||||||||||||||||||||:|||||||||||||||||||||
orf20-1     ADKFQLSIDLLRITFPYILLISLSSFVGSVLNSYHKFGIPAFTPTFLNVSFIVFALFFVP
             130        140        150        160        170        180
```

```
                  -continued
            190       200       210       220       230       240
orf20a.pep  YFDPPVTALAWAVFVGGILQLGFQLPWLAKLGFLKLPKLSFKDAAVNRVMKQMAPAILGV
            ||||||||||||||||||||||||||||||||||||||||||||||||||||||||||||
orf20-1     YFDPPVTALAWAVFVGGILQLGFQLPWLAKLGFLKLPKLSFKDAAVNRVMKQMAPAILGV
            190       200       210       220       230       240

250       260       270       280       290       300
orf20a.pep  SVAQISLVINTIFASYLQSGSVSWMYYADRMMELPGGVLGAALGTILLPTLSKHSANQDT
            ||||:|||||||||||||||||||||||||||||||:|||||||||||||||||||||||
orf20-1     SVAQVSLVINTIFASYLQSGSVSWMYYADRMMELPSGVLGAALGTILLPTLSKHSANQDT
            250       260       270       280       290       300

310       320       330       340       350       360
orf20a.pep  EQFSALLDWGLRXCMLLTLPAAVGMAVLSFPLVATLFMYREFTLFDAQMTQHALIAYSFG
            |||||||||||| ||||||||||||:||||||||||||||||||||||||||||||||||
orf20-1     EQFSALLDWGLRLCMLLTLPAAVGLAVLSFPLVATLFMYREFTLFDAQMTQHALIAYSFG
            310       320       330       340       350       360

370       380       390       400       410       420
orf20a.pep  LIGLIMIKVLAPGFYARQNIKTPVKIAIFTLICTQLMNLAFIGPLKHVGLSLAIGLGACI
            ||||||||||||||||||||||||||||||||||||||||||||||||||||||||||||
orf20-1     LIGLIMIKVLAPGFYARQNIKTPVKIAIFTLICTQLMNLAFIGPLKHVGLSLAIGLGACI
            370       380       390       400       410       420

430       440       450       460       470       480
orf20a.pep  NAGLLFYLLRRHGIYQPGKGWAAFLAKMLLSLAVMGGGLYAAQIWLPFDWAHAGGMQKAA
            |||||||||||||||||||||||||||||||||||| |||:||| :|||:|||||||:||:
orf 20-1    NAGLLFYLLRRHGIYQPGKGWAAFLAKMLLSLAVMCGGLWAAQAYLPFEWAHAGGMRKAG
            430       440       450       460       470       480

490       500       510
orf20a.pep  RLFILIAVGGGLYFASLAALGFRPRHFKRVESX
            :| ||||||||||||||||||||||||||||:|
orf20-1     QLCILIAVGGGLYFASLAALGFRPRHFKRVENX
            490       500       510
```

Homology with a Predicted ORF from *N.gonorrhoeae*
ORF20 (SEQ ID NO: 114) shows 92.1% identity over a 454aa overlap with a predicted ORF (ORF20ng) (SEQ ID NO: 120) from *N. gonorrhoeae*:

```
orf20.pep  MNMLGALAKVGSLTMVSRVLGFVRDTVIARAFGAGMATDAFFVAFKLPNLLRRVFAEGAF   60
           ||||||||||||||||||||||||||||||||||||||||||||||||||||||||||||
orf20ng    MNMLGALAKVGSLTMVSRVLGFVRDTVIARAFGAGMATDAFFVAFKLPNLLRRVFAEGAF   60 orf20.pep  AQAFVPILAEYKETRSKEAXEAFIRHVAGMLSFVLVIVTALGILAAPWVIYVSAPSFAQD  120
           |||||||||||||||||||:||||||||||||||::|||||||||||||||||||:|::|
orf20ng    AQAFVPILAEYKETRSKEATEAFIRHVAGMLSFVLIVVTALGILAAPWVIYVSAPGFTKD  120 orf20.pep  ADKFQLSIDLLRITFPYILLISLSSFVGSVLNSYHKFGIPAFTPXFLNVSFIVFALFFVP  180
           ||||||||:|||||||||||||||||||||:|||||||||||||:|||:|||||||||||
orf20ng    ADKFQLSISLLRITFPYILLISLSSFVGSILNSYHKFGIPAFTPTFLNISFIVFALFFVP  180 orf20.pep  YFDPPVTAXAWAVFVGGILQLXFQLPWLAKLGFLKLPKLSFKDAAVNRVMKQMAPAILGV  240
           |||||||| ||||||||||||  |||||||||||||||:|||||||||||||||||||||
orf20ng    YFDPPVTALAWAVFVGGILQLGFQLPWLAKLGFLKLPKLNFKDAAVNRVMKQMAPAILGV  240 orf20.pep  SVAQVSLVINTIFASYLQSGSVSWMYYADRMMELPSGVLGAALGTILLPTLSKHSANQDT  300
           ||||:|||||||||||||||||||||||||||||||:|||||||||||||||||||||||
orf20ng    SVAQISLVINTIFASYLQSGSVSWMYYADRMMELPGGVLGAALGTILLPTLSKHSANQDT  300 orf20.pep  EQFSALLDWGLRLCMLLTLPAAVGLAVLSFPLVATLFMYRXFTLFDAQMTQHALIAYSFG  360
           ||||||||||||||||||||||:||||||||||||||||| |||||||||||||||||||
orf20ng    EQFSALLDWGLRLCMLLTLPAAAGLAVLSFPLVATLFMYREFTLFDAQMTQHALIAYSFG  360 orf20.pep  LIGLIMIKVLAPGFYARQNIXXPVKIAIFTLICXQLMNLXFGPLXXIGLSLAIGLGACI   420
           |||||||||| |||||||||  :|||||||||:||||| |||  ||| ||||||||||||
orf20ng    LIGLIMIKVLASGFYARQNIKTPVKIAIFTLICTQLMNLAFIGPLKHAGLSLAIGLGACI  420 orf20.pep  NAGLLFYLLRRHGIYQPXQGLGSVLXQKCCSRSP                            454
           |||||:|:|:|||||:| ||||:  :|||||||
orf20ng    NAGLLFFLFRKHGIYRPGQGLGQPSWRKCCSRSP                            454
```

An ORF20ng nucleotide sequence (SEQ ID NO: 119) was predicted to encode a protein having amino acid sequence (SEQ ID NO: 120):

```
  1  MNMLGALAKV GSLTMVSRVL GFVRDTVIAR AFGAGMATDA FFVAFKLPNL

51  LRRVFAEGAF AQAFVPILAE YKETRSKEAT EAFIRHVAGM LSFVLIVVTA

101  LGILAAPWVI YVSAPGFTKD ADKFQLSISL LRITFPYILL ISLSSFVGSI

151  LNSYHKFGIP AFTPTFLNIS FIVFALFFVP YFDPPVTALA WAVFVGGILQ

201  LGFQLPWLAK LGFLKLPKLN FKDAAVNRVM KQMAPAILGV SVAQISLVIN

251  TIFASYLQSG SVSWMYYADR MMELPGGVLG AALGTILLPT LSKHSANQDT

301  EQFSALLDWG LRLCMLLTLP AAAGLAVLSF PLVATLFMYR EFTLFDAQMT

351  QHALIAYSFG LIGLIMIKVL ASGFYARQNI KTPVKIAIFT LICTQLMNLA

401  FIGPLKHAGL SLAIGLGACI NAGLLFFLFR KHGIYRPGQG LGQPSWRKCC

451  SRSP*
```

Further DNA sequence analysis revealed the following DNA sequence (SEQ ID NO: 121):

```
   1  ATGAATATGC TTGGAGCTTT GGCAAAAGTC GGCAGCCTGA CGATGGTGTC

51  GCGCGTTTTG GGATTTGTGC GCGATACGGT CATTGCGCGG GCATTCGGCG

101  CGGGTATGGC GACGGATGCG TTTTTTGTCG CGTTCAAACT GCCCAACCTG

151  CTTCGCCGCG TGTTTGCGGA GGGGGCGTTT GCCCAAGCGT TTGTGCCGAT

201  TTTGGCGGAA TATAAGGAAA CGCGTTCTAA AGAGGCGAcg gAGGCTTTTA

251  TCCGCCACGt tgcgggAatg CTGTCGTTTG TGCTGATCgt cGttacCGCG

301  CTGGGCATAC TTGCCGCgcc tTGGGTGATT TATGTTtccg CgcccGGCTT

351  TACCAAAGAC GCGGACAAGT TCCAACTTTC CATCAGCCTG CTGCGGATTA

401  CGTTTCCTTA TATATTATTG ATTTCTTTGT CTTCTTTTGT CGGCTCGATA

451  CTCAATTCCT ACCATAAGTT CGGCATTCCC GCGTTTACGC CCACGTTTTT

501  AAACATCTCT TTTATCGTAT TCGCACTGTT TTTCGTGCCG TATTTCGATC

551  CGCCCGTTAC CGCGCTGGCG TGGGCGGTTT TTGTCGGCGG TATTTTGCAG

601  CTCGGTTTCC AACTGCCGTG GCTGGCGAAA CTGGGCTTTT TGAAACTGCC

651  CAAACTGAAT TCAAAGATG CGGCGGTCAA CCGCGTCATG AAACAGATGG

701  CGCCTGCGAT TTTGGGCGTG agcgTGGCGC AAATTTCTTT GgttATCAAC

751  ACGATTTTCG CGTCTTATCT GCAATCGGGC AGCGTTTCAT GGATGTatta 801  cgCCGACCGC ATGATGGAGc tgcgccGGGG CGTGCTGGGG GCTGCACTCG

851  GTACAATTTT GCTGCCGACT TTGTCCAAAC ACTCGGCAAA CCAAGATACG

901  GAACAGTTTT CCGCCCTGCT CGACTGGGGT TTGCGCCTGT GCATGCTGCT

951  GACGCTGCCG GCGGCGGccg GACTGGCGGT ATTGTCGTTC CCGCTGGTGG

1001  CGACGCTGTT TATGTACCGA GAATTCACGC TGTTTGACGC ACAAATGACG

1051  CAACACGCGC TGATTGCCTA TTCTTTCGGT TTAATCGGTT TAATTATGAT

1101  TAAAGTGTTG GCATCCGGCT TTTATGCGCG GCAAAACATC AAAACGCCCG

1151  TCAAAATCGC CATCTTCACG CTCATCTGCA CGCAGTTGAT GAACCTCGCC

1201  TTTATCGGTC CGTTGAAACA CGCCGGGCTT TCGCTCGCCA TCGGCCTGGG
```

-continued

```
1251  CGCGTGCATC AACGCCGGAT TGTTGTTCTT CCTGTTGCGC AAACACGGTA

1301  TTTACCGGCC cggcaggggt tgggcggcgt TCTTGGCGAA AATGCTGCTC

1351  GCGCTCGCCG TGATGTGCGG CGGACTGTGG GCGGCGCAGG CTTGCCTGCC

1401  GTTCGAATGG GCGCACGCCG GCGGAATGCG GAAAGCGGGG CAGCTCTGCA

1451  TCCTGATTGC CGTCGGCGGC GGACTGTATT TCGCATCTCT GGCGGCTTTG

1501  GGCTTCCGTC CGCGCCATTT CAAACGCGTG GAAAGCTGA
```

This encodes the following amino acid sequence (SEQ ID NO: 122; ORF20ng-1):

```
  1  MNMLGALAKV GSLTMVSRVL GFVRDTVIAR AFGAGMATDA FFVAFKLPNL

51  LRRVFAEGAF AQAFVPILAE YKETRSKEAT EAFIRHVAGM LSFVLIVVTA

101  LGILAAPWVI YVSAPGFTKD ADKFQLSISL LRITFPYILL ISLSSFVGSI

151  LNSYHKFGIP AFTPTFLNXS FIVFALFFVP YFDPPVTALA WAVFVGGILQ

201  LGFQLPWLAK LGFLKLPKLN FKDAAVNRVM KQMAPAILGV SVAQISLVIN

251  TIFASYLQSG SVSWMYYADR MMELRRGVLG AALGTILLPT LSKHSANQDT

301  EQFSALLDWG LRLCMLLTLP AAAGLAVLSF PLVATLFMYR EFTLFDAQMT

351  QHALIAYSFG LIGLXMIKVL ASGFYARQNI KTPVKIAIFT LICTQLMNLA

401  FXGPLKHAGL SLAIGLGACI NACLLFFLLR KHGIYRPGRG WAAFLAKMLL

451  ALAVMCGGLW AAQACLPFEW AHAGGMRKAG QLCILIAVGG GLYFASLAAL

501  GFRPRHFKRV ES*
```

ORF20ng-1 (SEQ ID NO: 122) and ORF201 (SEQ ID NO: 116) show 95.7% identity in 512 aa overlap:

```
                    10         20         30         40         50         60
orf20-1.pep MNMLGALAKVGSLTMVSRVLGFVRDTVIARAFGAGMATDAFFVAFKLPNLLRRVFAEGAF
            ||||||||| ||||||||||||||||||||||||||||||||||||||||||||||||||
orf20ng-1   MNNLGALAAVGSLTMVSRVLGFVRDTVIARAFGAGMATDAFFVAFKLPNLLRRVFAEGAF
                    10         20         30         40         50         60

70         80         90        100        110        120
orf20-1.pep AQAFVPILAEYKETRSKEAAEAFIRHVAGMLSFVLIVTALGILAAPWVIYVSAPGFAQD
            |||||||||||||||||||:||||||||||||||||::||||||||||||||||||:::|
orf20ng-1   AQAFVPILAEYKETRSKEATEAFIRHVAGMLSFVLIVVTALGILAAPWVIYVSAPGFTKD
                    70         80         90        100        110        120

130        140        150        160        170        180
orf20-1.pep ADKFQLSIDLLRZTFPYILLISLSSFVGSVLNSYHKFGIPAFTPTFLNVSFIVFALFFVP
            ||||||||:|||| ||||||||||||||||:|||||||||||||||||||:|||||||||
orf20ng-1   ADKFQLSISLLRITFPYILLISLSSFVGSILNSYHKFGIPAFTPTFLNVSFZVFALFFVP
                   130        140        150        160        170        180

190        200        210        220        230        240
orf20-1.pep YFDPPVTALAWAVFVGGILQLGFQLPWLAKLGFLKLPKLSFKDAAVNRVMKQMAPAILGV
            |||||||||||||||||||||||||||||||||||||||:||||||||||||||||||||
orf20ng-1   YFDPPVTALAWAVFVGGILQLGFQLPWLAKLGFLKLPKLNFKDAAVNRVMKQMAPAILGV
                   190        200        210        220        230        240

250        260        270        280        290        300
orf20-1.pep SVAQVSLVINTIFASYLQSGSVSMMYYADRMMELPSGVLGAALGTILLPTLSKHSANQDT
            ||||:||||||||||||||||||| ||||||||||||  ||||||||||||||||||||||
orf20ng-1   SVAQVSLVINTIFASYLQSGSVSWMYYADRMMELRRGVLGAALGTILLPTLSKHSANQDT
                   250        260        270        280        290        300
```

-continued

```
              310       320       330       340       350       360
orf20-1.pep  EQFSALLDWGLRLCMLLTLPAAVGLAVLSFPLVATLFMYREFTLFDAQMTQHALIAYSFG
             ||||||||||||||||||||||:||||||||||||||||||||||||||||||||||||
orf20ng-1    EQFSALLDWGLRLCMLLTLPAAAGLAVLSFPLVATLFMYREFTLFDAQMTQHALIAYSFG
              310       320       330       340       350       360

370       380       390       400       410       420
orf20-1.pep  LIGLIMIKVLAPSFYARQNIKTPVKIAIFTLICTQLMNLAFIGPLKHVGLSLAIGLGACI
             ||||||||||| |||||||||||||||||||||||||||||||||:||||||||||||||
orf20ng-1    LIGLIMIKVLASGFYARQNIKTPVKIAIFTLICTQLMNLAFIGPLKHAGLSLAIGLGACI
              370       380       390       400       410       420

430       440       450       460       470       480
orf20-1.pep  NAGLLFYLLRRHGIYQPGKGWAAFLAKMLLSLAVMCGGLWAAQAYLPFEWAHAGGMRKAG
             ||||||:|||:||||:||:||||||||||:||||||||||| ||||||||||||||||||
orf20ng-1    NAGLLFFLLRKHGIYRPGRGWAAFLAKILLALAVMCGGLWAAQACLPFEWAHAGGMRKAG
              430       440       450       460       470       480

490       500       510
orf20-1.pep  QLCILIAVGGGLYFASLAALGFRPRHFKRVENX
             |||||||||||||||||||||||||||||||:|
orf20ng-1    QLCILIAVGGGLYFASLAALGFRPRHFKRVESX
              490       500       510
```

In addition, ORF20ng-1 (SEQ ID NO: 122) shows significant homology with a virulence factor (SEQ ID NO: 1122) of *S.typhimurium*:

```
sp|P37169|MVIN_SALTY VIRULENCE FACTOR MVIN pir||S40271 mviN protein - Salmonella
typhimurium gi|438252 (Z26133) mviB gene product [Salmonella typhimurium]
gnl|PID|di005521 (D25292) ORD2 [Salmonella typhimurium] Length = 524
Score = 1573 (750.1 bits), Expect = 1.1e-220, Sum P(2) = 1.1e-220
Identities = 309/467 (66%), Positives = 368/467 (78%)

Query:    1  MNMLGALAKVGSLTMVSRVLGFVRDTVIARAFGAGMATDAFFVAFKLPNLLRRVFAEGAF    60
             MN+L +LA V S+TM SRVLGF RD ++AR FGAGMATDAFFVAFKLPNLLRR+FAEGAF
Sbjct:   14  MMLLKSLAAVSSMTMFSRVLGFARDAIVARIFGAGMATDAFFVAFKLPNLLRRIFAEGAF    73

Query:   61  AQAFVPILAFYKETRSKEATEAFIRHVAGMLSFVLIVVTALGILAAPWVIYVSAPGFTKD   120
             +QAFVPILA+YK + +EAT F+ +V+G+L+   L VVT G+LAAPWVI V+APGF
Sbjct:   74  SQAFVPILAEYKSKQGEEATRIFVAYVSGLLTLALAVVTLAGMLAAPWVIMVTAPGFADT   133

Query:  121  ADKFQLSISLLRITFPYILLISLSSFVGSILNSYHKFGIPAFTPTFLNISFIVFALFFVP   180
             ADKF L+ LLRITFPYILLISL+S VG+ILN++++F IPAF PTFLNIS I FALF P
Sbjct:  134  ADKFALTTQLLRITFPYILLISLASLVGAILNTWNRFSIPAFAPTFLNISMIGFALFAAP   193

Query:  181  YFDPPVTALAWAVFVGGILQLGFQLPWLAKLGFLKLPKLNFKDAAVNRVMKQMAPAILGV   240
             YF+PPV ALAWAV VGG+LQL +QLP+L K+G L LP++NF+D RV+KQM PAILGV
Sbjct:  194  YFNPPVLALAWAVTVGGVLQLVYQLPYLKKIGMLVLPRINFRDTGAMRVVKQIGPAILGV   253

Query:  241  SVAQISLVINTIFASYLQSGSVSWMYYADRMMELRRGVLGAALGTILLPTLSKHSANQDT   300
             SV+QISL+INTIFAS+L SGSVSWMYYADR+ME GVLG ALGTILLP+LSK A++
Sbjct:  254  SVSQISLIINTIFASFLASGSVSWMYYADRLMEFPSGVLGVALGTILLPSLSKSFASGNH   313

Query:  301  EQFSALLDWGLRLCMLLTLPAAAGLAVLSFPLVATLFMYREILFDAQMTQHALIAYSFG   360
             +++ L+DWGLRLC LL LP+A L +L+ PL +LF Y +FT FDA MTQ ALIAYS G
Sbjct:  314  DEYCRLMDWGLRLCFLLALPSAVALGILAKPLTVSLFQYGKFTAFDAAMTQPALIAYSVG   373

Query:  361  LIGLIMIKVVASGFYARQNIKTPVKIAIFTLICTQLMNLAFIGPLKHAGLSLAIGLGACI   420
             LIGLI++KVLA GFY+RQ+IKTPVKIAI TLI TQ+ILAFIGPLKHAGLSL+IGL AC+
Sbjct:  374  LIGLIVVKVLAPGFYSRQDIKTPVKIAIVTLIMTQLMNLAFIGPLKHAGLSLSIGLAACL   433

Query:  421  NAGLLFFLLRKHGIYRPGRGWXXXXXXXXXXXXXVMCGGLWAAQACLP               467
             NA LL++ LRK I+ P  GW            VM L+    +P
Sbjct:  434  NASLLYWQLRKQNIFTPQPGWMWFLMRLIISVLVAAAVLFGVLHIMP               480

Score = 70 (33.4 bits), Expect = 1.1e-220, Sum P(2) = 1.1e-220
Identities = 14/41 (34%), Positives = 23/41 (56%)

Query:  469  EWAHAGGMRKAGQLCILIAVGGGLYFASIAALGFRPRMFKR                      509
             EW+  + + +L ++ G YFA+LA LGF+ + F R
Sbjct:  481  RWSQGSMLWRLLRLMAVVIAGIAAYFAALAVLGFKVKEFVR                      521
```

Based on this analysis, including the homology with a virulence factor (SEQ ID NO: 1122) from *S.typhimurium*, it is predicted that these proteins from *N.meningitidis* and *N.gonorrhoeae*, and their epitopes, could be useful antigens for vaccines or diagnostics, or for raising antibodies.

Example 15

The following partial DNA sequence was identified in *N.meningitidis* (SEQ ID NO: 123):

```
  1    atGATTAAAA TCAAAAAAGG TCTAAACCTG CCCATCGCGG GCAGACCGGA

51    GCAAGCCGTT tACGACGGCC CGGCCaTTAC CGAAGtCGCG TTGCTTGGCG

101    AAGAATATGC CGGTATGCGC CCCTCGATGA AAGTCAAGGA AGGCGATGCC

151    GTcAAAAAAG GCCAAGTGCT GTTTGAAGAC AAAAAGAATC CGGGCGTGGT

201    GTTTACTGCG CCGGCTTCAG GCAAAATCGC CGCGATTCAC CGTGGCGAAA

251    AGCGCGTACT TCAGTCAGTC GTGATTGCCG TTGAArGCAA CGACGAAATC

301    GAGTTTGAAC GCTACGCACC TGAAGCGCTG GCAAACTTAA GCGGCGAAGA

351    AGTGCGCCGC AACCTGATCC AATCCGGTTT GTGGACTGCG CTGCGCACCC

401    GTCCGTTCAG CAAAATTCCT GCCGTCGATG CCGAGCCGTT CGCCATCTTC

451    GTCAATGCGA tGGACACCAA TCCG..
```

This corresponds to the amino acid sequence (SEQ ID NO: 124; ORF22):

```
  1    MIKIKKEGLNL PIAGRPEQAV YDGPATTEVA LLGEEYAGMR PSMKVKEGDA

51    VKKGQVLFED KKNPGVVFTA PASGKIAAIH RGEKRVLQSV VIAVEXNDEI

101    EFERYAPEAL ANLSGEEVRR NLIQSGLWTA LRTRPFSKIP AVDAEPFAIF

151    VNAMDTNP..
```

Further work revealed the complete nucleotide sequence (SEQ ID NO: 125):

```
  1    ATGATTAAAA TCAAAAAAGG TCTAAACCTG CCCATCGCGG GCAGACCGGA

51    GCAAGCCGTT TACGACGGCC CGGCCATTAC CGAAGTCGCG TTGCTTGGCG

101    AAGAATATGC CGGTATGCGC CCCTCGATGA AAGTCAAGGA AGGCGATGCC

151    GTCAAAAAAG GCCAAGTGCT GTTTGAAGAC AAAAAGAATC CGGGCGTGGT

201    GTTTACTGCG CCGGCTTCAG GCAAAATCGC CGCGATTCAC CGTGGCGAAA

251    AGCGCGTACT TCAGTCAGTC GTGATTGCCG TTGAAGGCAA CGACGAAATC

301    GAGTTTGAAC GCTACGCACC TGAAGCGCTG GCAAACTTAA GCGGCGAAGA

351    AGTGCGCCGC AACCTGATCC AATCCGGTTT GTGGACTGCG CTGCGCACCC

401    GTCCGTTCAG CAAAATTCCT GCCGTCGATG CCGAGCCGTT CGCCATCTTC

451    GTCAATGCGA TGGACACCAA TCCGCTGGCT GCCGACCCTA CGGTCATTAT

501    CAAAGAAGCC GCCGAGGATT TCAAACGCGG CCTGTTGGTA TTGAGCCGTT

551    TGACCGAACG CAAAATCCAT GTTTGTAAGG CAGCTGGCGC AGACGTGCCG

601    TCTGAAAATG CTGCCAACAT CGAAACACAT GAATTCGGCG CCCGCATCC

651    TGCCGGTTTG AGTGGCACGC ACATTCATTT CATCGAGCCG GTCGGCGCGA

701    ATAAAACCGT GTGGACCATC AATTATCAAG ATGTAATTAC CATTGGCCGT

751    TTGTTTGCAA CAGGCCGTCT GAACACCGAG CGCGTGATTG CCCTAGGTGG

801    TTCTCAAGTC AACAAACCGC GCCTCTTGCG TACCGTTTTG GGTGCGAGAG
```

-continued

```
 851  TATCGCAAAT TACTGCGGGC GAATTGGTTG ACACAGACAA CCGCGTGATT
 901  TCCGGTTCGG TATTGAACGG CGCGATTACA CAAGGCGCGC ACGATTATTT
 951  GGGACGCTAC CACAATCAGA TTTCCGTTAT CGAAGAAGGC CGCAGCAAAG
1001  AGCTGTTCGG CTGGGTTGCG CCGCAGCCGG ACAAATACTC CATCACGCGT
1051  ACAACCCTCG GCCATTTCCT GAAAAACAAA CTCTTCAAGT TCAACACAGC
1101  CGTCAACGGC GGCGACCGCG CCATGGTGCC GATTGGTACT TACGAGCGCG
1151  TGATGCCCTT GGATATCCTG CCCACCCTGC TTTTGCGCGA TTTAATCGTC
1201  GGCGATACCG ACAGCGCGCA GGCATTGGGT TGCTTGGAAT TGGACGAAGA
1251  AGACCTCGCT TTGTGCAGCT TCGTCTGCCC GGGCAAATAC GAATACGGCC
1301  CGCTGTTGCG CAAAGTGCTG GAAACCATTG AGAAGGAAGG CTGA
```

This corresponds to the amino acid sequence (SEQ ID NO: 126; ORF22-1):

```
  1  MIKIKKGLNL PIAGRPEQAV YDGPAITEVA LLGEEYAGMR PSMKVKEGDA
 51  VKKGQVLFED KKNPGVVFTA PASGKIAAIH RGEKRVLQSV VIAVEGNDEI
101  EFERYAPEAL ANLSGEEVRR NLIQSGLWTA LRTRPFSKIP AVDAEPFAIF
151  VNAMDTNPLA ADPTVIIKEA AEDFKRGLLV LSRLTERKIH VCKAAGADVP
201  SENAANIETH EFGGPHPAGL SGTHIHFIEP VGANKTVWTI NYQDVITIGR
251  LFATGRLNTE RVIALGGSQV NKPRLLRTVL GAKVSQITAG ELVDTDNPVI
301  SGSVLNGAIT QGAADYLGRY HNQISVIEEG RSKELFGWVA PQPDKYSITR
351  TTLGHFLKNK LFKFNTAVNG GDRAMVPIGT YERVMPLDIL PTLLLRDLIV
401  GDTDSAQALG CLELDEEDLA LCSFVCPGKY EYGPLLRKVL ETIEKEG*
```

Further work identified the corresponding gene in strain A of *N.meningitidis* (SEQ ID NO: 127):

```
  1  ATGATTAAAA TCAAAAAAGG TCTAAACCTG CCCATCGCGG GCAGACCGGA
 51  GCAAGTCATT TATGACGGGC CCGTCATTAC CGAAGTCGCG TTGCTTGGCG
101  AAGAATATGC CGGTATGCGC CCCTNGATGA AAGTCAAGGA AGGCGATGCC
151  GTCAAAAAAG GCCAAGTGCT GTTTGAAGAC AAAAAGNATC CGGGCGTGGT
201  GTTTACCGCG CCNGTTTCAG GCAAAATCGC CGCCATCCAT CGCGGCGAAA
251  AGCGCGTACT TCAGTCGGTC GTGATTGCCG TTGAAGGCAA CGACGAAATC
301  GAGTTCGAAC GCTACGCGCC CGAAGCGTTG GCAAACTTAA GCGGCGANGA
351  ANTNNGNNGC AATCTGATCC AATCCGGTTT GTGGACTGCG CTGCGTANCC
401  GTCCGTTCAG CAAAATCCCT GCCGTCGATG CCGAGCCGTT CGCCATCTTC
451  GTCAATGCGA TGGACACCAA TCCGCTNGCG GCAGACCCTG TGGTTGTGAT
501  CAAAGAAGCC GNCGANGATT TCAGACGANG TNTGCTGGTA TTGAGCCGTT
551  TGACCGAGCG TAAAATCCAT GTGTGTAAGG CAGCTGGCGC AGACGTGCCG
601  TCTGAAAATG CTGCCAACAT CGAAACACAT GAATTCGGCG GCCCGCATCC
651  GGCCGGTTTG AGTGGCACGC ACATTCATTT CATTGAGCCG GTCGGTGCAA
701  ACAAAACCGT TTGGACCATC AATTATCAAG ATGTAATTGC CATCGGACGT
```

-continued

```
 751  TTGTTTGCAA CAGGCCGTCT GAACACCGAG CGCGTGATTG CTTTGGGTGG

801  TTCTCAAGTC AACAAACCAC GCCTCTTGCG TACCGTTTTG GGTGCGAAAG

851  TATCGCAAAT TACTGCGGGC GAATTGGTTG ACGCAGACAA CCGCGTGATT

901  TCCGGTTCGG TATTGAACGG CGCGATTACA CAAGGCGCGC ACGATTATTT

951  GGGACGCTAC CACAATCAGA TTTCCGTTAT CGAAGAAGGC CGCAGCAAAG

1001  AGCTGTTCGG CTGGGTTGCG CCGCAGCCGG ACAAATACTC CATCACGCGT

1051  ACGACCCTCG GCCATTTCCT GAAAAACAAA CTCTTCAAGT TCACGACAGC

1101  CGTCAACGGT GGCGACCGCG CCATGGTGCC GATTGGTACT TACGAGCGCG

1151  TAATGCCGCT AGACATCCTG CCTACCCTGC TTTTGCGCGA TTTAATCGTC

1201  GGCGATACCG ACAGCGCGCA AGCATTGGGT TGCTTGGAAT TGGACGAAGA

1251  AGACCTCGCT TTGTGCAGCT TCGTCTGCCC GGGCAAATAC GAATANGGCC

1301  CGCTGTTGCG TAAGGTGCTG GAAACCNTTG AGAAGGAAGG CTGA
```

This encodes a protein having amino acid sequence (SEQ ID NO: 128; ORF22a):

```
  1  MIKIKKGLNL PIAGRPEQVI YDGPVITEVA LLGEEYAGMR PXMKVKEGDA

51  VKKGQVLFED KKXPGVVFTA PVSGKIAAIH RGEKRVLQSV VIAVEGNDEI

101  EFERYAPEAL ANLSGXEXXX NLIQSGLWTA LRXRPFSKIP AVDAEPFAIF

151  VNAMDTNPLA ADPVVVIKEA XXDFRRXXLV LSRLTERKIH VCKAAGADVP

201  SENAANIETH EFGGPHPAGL SGTHIMFIEP VGANKTVWTI NYQDVIAIGR

251  LFATGRLNTE RVIALGGSQV NKPRLLRTVL GAKVSQITAG ELVDADNRVI

301  SGSVLNGAIT QGAHDYLGRY HNQISVIEEG RSKELFGWVA PQPDKYSITR

351  TTLGHFLKNK LFKFTTAVNG GDRAKVPIGT YERVMPLDIL PTLLLRDLIV

401  GDTDSAQALG CLELDEEDLA LCSFVCPGKY EXGPLLRKVL ETXEKEG*
```

The originally-identified partial strain B sequence (ORF22) (SEQ ID NO: 124) shows 94.2% identity over a 158aa overlap with ORF22a (SEQ ID NO: 128):

```
                    10         20         30         40         50         60
orf22.pep MIKIKKGLNLPIAGRPEQAVYDGPAITEVALLGEEYAGMRPSMKVKEGDAVKKGQVLFED
          ||||||||||||||||||::||||:|||||||||||||| ||||||||||||||||||||
orf22a    MIKIKKGLNLPIAGRPEQVIYDGPVITEVALLGEEYAGMRPXMKVKEGDAVKKGQVLFED
                    10         20         30         40         50         60

70         80         90        100        110        120
orf22.pep KKNPGVVFTAPASGKIAAIHRGEKRVLQSVVIAVEXNDEIEFERYAPEALANLSGEEVRR
          || ||||||||:|||||||||||||||||||||||| |||||||||||||||||||| |
orf22a    KKXPGVVFTAPVSGKIAAIHRGEKRVLQSVVIAVEGNDEIEFERYAPEALANLSGXEXXX
                    70         80         90        100        110        120

130        140        150
orf22.pep NLIQSGLWTALRTRPFSKIPAVDAEPFAIFVNAMDTNP
          ||||||||||||:||||||||||||||||||||||||
orf22a    NLIQSGLWTALRXRPFSKIPAVDAEPFAIFVNAMDTNPLAADPVVVIKEAXXDFRRXXLV
                   130        140        150        160        170        180
```

The complete strain B sequence (ORF22-1) (SEQ ID NO: 126) and ORF22a (SEQ ID NO: 128) show 94.9% identity in 447 aa overlap:

```
                     10        20        30        40        50        60
orf22a.pep   MIKIKKGLNLPIAGRPEQVIYDGPVITEVALLGEEYAGMRPXMKVKEGDAVKKGQVLFED
             ||||||||||||||||||::||||:|||||||||||||||| ||||||||||||||||||
orf22-1      MIKIKKGLNLPIAGRPEQAVYDGPAITEVALLGEEYAGMRPSMKVKEGDAVKKGQVLFED
                     10        20        30        40        50        60

70        80        90       100       110       120
orf22a.pep   KKXPGVVFTAPVSGKIAAIHRGEKRVLQSVVIAVEGNDEIEFERYAPEALANLSGXEXXX
             || |||||||||:|||||||||||||||||||||||||||||||||||||||||||| |
orf22-1      KKNPGVVFTAPASGKIAAIHRGEKRVLQSVVIAVEGNDEIEFERYAPEALANLSGEEVRR
                     70        80        90       100       110       120

130       140       150       160       170       180
orf22a.pep   NLIQSGLWTALRXRPFSKIPAVDAEPFAIFVNAMDTNPLAADPVVVIKEAAEDFKRGLLV
             |||||||||||:|||||||||||||||||||||||||||||||:|:||||  ||:| ||
orf22-1      NLIQSGLWTALRTRPFSKIPAVDAEPFAIFVNAMDTNPLAADPVVVIKEAAEDFKRGLLV
                    130       140       150       160       170       180

190       200       210       220       230       240
orf22a.pep   LSRLTERKIHVCKAAGADVPSENAANIETHEFGGPHPAGLSGTHIHPIEPVGANKTVWTI
             ||||||||||||||||||||||||||||||||||||||||||||||||||||||||||||
orf22-1      LSRLTERKIHVCKAAGADVPSENAANIETHEFGGPHPAGLSGTHIHPIEPVGANKTVWTI
                    190       200       210       220       230       240

250       260       270       280       290       300
orf22a.pep   NYQDVIAIGRLFATGRLNTERVIALGGSQVNKPRLLRTVLGAKVSQITAGELVDADNRVI
             ||||||:|||||||||||||||||||||||||||||||||||||||||||||||:|||||
orf22-1      NYQDVITIGRLFATGRLNTERVIALGGSQVNKPRLLRTVLGAKVSQITAGELVDTDNRVI
                    250       260       270       280       290       300

310       320       330       340       350       360
orf22a.pep   SGSVLNGAITQGAHHDYLGRYMNQISVIEEGRSKELFGWVAPQPDKYSITRTTLGHFLKNK
             |||||||||||||| |||||||||||||||||||||||||||||||||||||||||||||
orf22-1      SGSVLNGAITQGAHDYLGRYHMNQISVIEEGRSKELFGWVAPQPDKYSITRTTLGHFLKNK
                    310       320       330       340       350       360

370       380       390       400       410       420
orf22a.pep   LFKFTTAVNGGDRAMVPIGTYERVMPLDILPTLLLRDLIVGDTDSAQALGCLELDEEDLA
             ||||:|||||||||||||||||||||||||||||||||||||||||||||||||| ||||
orf22-1      LFKFNTAVNGGDRAMVPIGTYERVMPLDILPTLLLRDLIVGDTDSAQALGCLELWEEDLA
                    370       380       390       400       410       420

430       440
orf22a.pep   LCSFVCPGKYEXGPLLRKVLETXEKEGX
             ||||||||||| |||||||||| |||||
orf22-1      LCSFVCPGKYEYGPLLRKVLETIEKEGX
                    430       440
```

Further work identified a partial gene sequence (SEQ ID NO: 129) from *N.gonorrhoeae*, which encodes the following amino acid sequence (SEQ ID NO: 130; ORF22ng):

```
  1  MIKIKKGLNL PIAGRPEQVI YDGPAITEVA LLGEEYVGMR PSMKIKEGEA

51  VKKGQVLFED KKNPGVVFTA PASGKIAAIH RGEKRVLQSV VIAVEGNDEI

101  EFERYVPEAL AKLSSEKVRR NLIQSGLWTA LRTRPFSKIP AVDAEPFAIF

151  VNAMDTNPLA ADPTVIIKEA AEDFKRGLLV LSRLTERKIH VCKAAGADVP

201  SENAANIETH EFGGPHPAGL SGTHIHFIEP VGANKTVWTI NYQDVIAIGR

251  LFVTGRLNTE RVVALGGLQV NKPRLLRTVL GAKVSQLTAG ELVDADNRVI

301  SGSVLNGAIA QGAHDYLGRY HN*
```

Further work identified complete gonococcal gene (SEQ ID NO: 131):

```
   1  ATGATTAAAA TCAAAAAAGG TCTAAATCTG CCCATCGCGG GCAGACCGGA
  51  GCAAGTCATT TATGACGGCC CGGCCATTAC CGAAGTCGCG TTGCTTGGCG
 101  AAGAATATGT CGGCATGCGC CCCTCGATGA AAATCAAGGA AGGTGAAGCC
 151  GTCAAAAAAG GCCAAGTGCT GTTTGAAGAC AAAAAGAATC CGGGCGTAGT
 201  ATTTACTGCG CCGGCTTCAG GCAAAATCGC CGCTATTCAC CGTGGCGAAA
 251  AGCGCGTACT TCAGTCAGTC GTGATTGCCG TTGAAGGCAA CGACGAAATC
 301  GAGTTCGAAC GCTACGTACC TGAAGCGCTG GCAAAATTGA GCAGCGAAAA
 351  AGTGCGCCGC AACCTGATTC AATCAGGCTT ATGGACTGCG CTTCGCACCC
 401  GTCCGTTCAG CAAAATCCCT GCCGTAGATG CCGAGCCGTT CGCCATCTTC
 451  GTCAATGCGA TGGACACCAA TCCGCTGGCT GCCGACCCTA CGGTCATCAT
 501  CAAAGAAGCC GCCGAAGACT TCAAACGCGG CCTGTTGGTA TTGAGCCGCC
 551  TGACCGAACG TAAAATCCAT GTGTGTAAAG CAGCAGGCGC AGACGTGCCG
 601  TCTGAAAATG CTGCCAATAT CGAAACACAT GAATTTGGCG GCCCGCATCC
 651  TGCCGGCTTG AGTGGCACGC ACATTCATTT CATCGAGCCA GTCGGCGCGA
 701  ATAAAACCGT GTGGACCATC AATTATCAAG ACGTGATTGC TATCGGACGT
 751  TTGTTCGTAA CAGGCCGTCT GAATACCGAG CGCGTGGTTG CCTTGGGCGG
 801  CCTGCAAGTC AACAAACCGC GCCTCTTGCG TACCGTTTTG GGTGCGAAGG
 851  TGTCTCAACT TACCGCCGGC GAATTGGTTG ACGCGGACAA CCGCGTGATT
 901  TCCGGTTCGG TATTGAACGG TGCGATTGCA CAAGGCGCGC ATGATTATTT
 951  GGGACGCTAC CACAATCAGA TTTCCGTTAT CGAAGAAGGC CGCAGCAAAG
1001  AGCTGTTCGG CTGGGTTGCG CCGCAGCCGG ACAAATACTC CATCACGCGC
1051  ACCACTCTCG GCCATTTCCT AAAAAACAAA CTCTTCAAGT TCACGACAGC
1101  CGTCAACGGC GGCGACCGCG CCATGGTACC GATCGGCACT TATGAGCGCG
1151  TAATGCCGTT GGACATCCTG CCTACCTTGC TTTTGCGCGA TTTAATCGTC
1201  GGCGATACCG ACAGCGCGCA GGCTTTGGGT TGCTTGGAAT TGGACGAAGA
1251  AGACCTCGCT TTGTGCAGCT TCGTCTGCCC GGGCAAATAC GAATACGGCC
1301  CGCTGTTGCG CAAAGTGCTG GAAACCATTG AGAAGGAAGG CTGA
```

This encodes a protein having amino acid sequence (SEQ ID NO: 132; ORF22ng-1):

```
   1  MIKIKKGLNL PIAGRPEQVI YDGPAITEVA LLGEEYVGMR PSMKIKEGEA
  51  VKKGQVLFED KKNPGVVFTA PASGKIAAIH RGEKRVLQSV VIAVEGNDEI
 101  EFERYVPEAL AKLSSEKVRR NLIQSGLWTA LRTRPFSKIP AVDAEPFAIF
 151  VNAMDTNPLA ADPTVIIKEA AEDFKRGLLV LSRLTERKIH VCKAAGADVP
 201  SENAANIETH EFGGPHPAGL SGTHIHFIEP VGANKTVWTI NYQDVIAIGR
 251  LFVTGRLNTE RVVALGGLQV NKPRLLRTVL GAKVSQLTAG ELVDADNRVI
 301  SGSVLNGAIA QGAHDYLGRY HNQISVIEEG RSKELFGWVA PQPDKYSITR
 351  TTLGHFLKNK LFKFTTAVNG GDRAMVPIGT YERVMPLDIL PTLLLRDLIV
 401  GDTDSAQALG CLELDEEDLA LCSFVCPGKY EYGPLLRKVL ETIEKEG*
```

The originally-identified partial strain B sequence (ORF22) (SEQ ID NO: 124) shows 93.7% identity over a 158aa overlap with ORF22ng (SEQ ID NO: 130):

```
orf22.pep  MIKIKKGLNLPIAGRPEQAVYDGPAITEVALLGEEYAGMRPSMKVKEGDAVKKGQVLFED    60
           |||||||||||||||::||||||||||||||||:||||||:|||:|||||||||||||
orf22ng    MIKIKKGLNLPIAGRPEQVIYDGPAITEVALLGEEYVGMRPSMKIKEGEAVKKGQVLFED    60 orf22.pep  KKNPGVVFTAPASGKIAAIHRGEKRVLQSVVIAVEXNDEIEFERYAPEALANLSGEEVRR   120
           ||||||||||||||||||||||||||||||||||  |||||||||:||||:||:|:|||
orf22ng    KKNPGVVFTAPASGKIAAIHRGEKRVLQSVVIAVEGNDEIEFERYVPEALAKLSSEKVRR   120 orf22.pep  NLIQSGLWTALRTRPFSKIPAVDAEPFAIFVNAMDTNP                         158
           ||||||||||||||||||||||||||||||||||||||
orf22ng    NLIQSGLWTALRTRPFSKIPAVDAEPFAIFVNAMDTNPLAADPTVIIKEAAEDFKRGLLV   180
```

The complete sequences from strain B (ORF22-1) (SEQ ID NO: 126) and gonococcus (ORF22ng-1) (SEQ ID NO: 132) show 96.2% identity in 447 aa overlap:

```
                    10         20         30         40         50         60
orf22-1.pep MIKIKKGLNLPIAGRPEQAVYDGPAITEVALLGEEYAGMRPSMKVKEGDAVKKGQVLFED
            |||||||||||||||::||||||||||||||||:||||||:|||:|||||||||||||
orf22ng-1   MIKIKKGLNLPIAGRPEQVIYDGPAITEVALLGEEYVGMRPSMKIKEGEAVKKGQVLFED
                    10         20         30         40         50         60

70         80         90        100        110        120
orf22-1.pep KKNPGVVFTAPASGKIAAIHRGEKRVLQSVVIAVEGNDEIEFERYAPEALANLSGEEVRR
            ||||||||||||||||||||||||||||||||||||||||||||:||||:||:|:|||
orf22ng-1   KKNPGVVFTAPASGKIAAIHRGEKRVLQSVVIAVEGNDEIEFERYVPEALAKLSSEKVRR
                    70         80         90        100        110        120

130        140        150        160        170        180
orf22-1.pep NLIQSGLWTALRTRPFSKIPAVDAEPFAIFVNAMDTNPLAADPTVIIKEAAEDFKRGLLV
            ||||||||||||||||||||||||||||||||||||||||||||||||||||||||||
orf22ng-1   NLIQSGLWTALRTRPFSKIPAVDAEPFAIFVNAMDTNPLAADPTVIIKEAAEDFKRGLLV
                   130        140        150        160        170        180

190        200        210        220        230        240
orf22-1.pep LSRLTERKIHVCKAAGADVPSENAANTETHEFGGPHPAGLSGTHIHFIEPVGANKTVWTI
            ||||||||||||||||||||||||||||:|||||||||||||||||||||||||||||
orf22ng-1   LSRLTERKIHVCKAAGADVPSENAANIETHEFGGPHPAGLSGTHIHFIEPVGANKTVWTI
                   190        200        210        220        230        240

250        260        270        280        290        300
orf22-1.pep NYQDVITIGRLFATGRLNTERVIALGGSQVNKPRLLRTVLGAKVSQITAGELVDTDNRVI
            ||||||:|||||:|||||||:||||:|||||||||||||||||||:|||||||:|||||
orf22ng-1   NYQDVIAIGRLFVTGRLNTERVVALGGLQVNKPRLLRTVLGAKVSQLTAGELVDADNRVI
                   250        260        270        280        290        300

310        320        330        340        350        360
orf22-1.pep SGSVLNGAITQGAHDYLGRYHNQISVIEEGRSKELFGWVAPQPDKYSITRTTLGHFLKNK
            ||||||||:|||||||||||||||||||||||||||||||||||||||||||||||||
orf22ng-1   SGSVLNGAIAQGAHDYLGRYHNQISVIEEGRSKELFGWVAPQPDKYSITRTTLGHFLKNK
                   310        320        330        340        350        360

370        380        390        400        410        420
orf22-1.pep LFKFNTAVNGGDRAMVPIGTYERVMPLDILPTLLLRDLIVGDTDSAQALGCLELDEEDLA
            ||||:|||||||||||||||||||||||||||||||||||||||||||||||||||||
orf22ng-1   LFKFTTAVNGGDRAMVPIGTYERVMPLDILPTLLLRDLIVGDTDSAQALGCLELDEEDLA
                   370        380        390        400        410        420

430        440
orf22-1.pep LCSFVCPGKYEYGPLLRKVLETIEKEGX
            ||||||||||||||||||||||||||||
orf22ng-1   LCSFVCPGKYEYGPLLRKVLETIEKEGX
                   430        440
```

Computer analysis of these sequences gave the following results:
Homology with 48kDa Outer Membrane Protein of *Actinobacillus pleuropneumoniae* (Accession Number U24492) (SEQ ID NO: 1123).

ORF22 (SEQ D NO: 124) and this 48 kDa protein (SEQ ID NO: 1123) show 72% aa identity in 158aa overlap:

```
Orf22    1 MIKIKKGLNLPIAGRPEQAVYDGPAITEVALLGEEYAGMRPSMKVKEGDAVKKGQVLFED   60
           MI IKKGL+LPIAG P Q +++G  + EVA+LGEEY GMRPSMKV+EGD VKKGQVLFED
48kDa    1 MITIKKGLDLPIAGTPAQVIHNGNTVNEVAMLGEEYVGMRPSMKVREGDVVKKGQVLFED   60 orf22   61 KKNPGVVFTAPASGKIAAIHRGEKRVLQSVVIAVEXNDEIEFERYAPEALANLSGEEVRR  120
           KKNPGVVFTAPASG +  I+RGEKRVLQSVVI VE +++I F RY    LA+LS E+V++
48kDa   61 KKNPGVVFTAPASGTVVTINRGEKRVLQSVVIKVEGDEQITFTRYEAAQLASLSAEQVKQ  120 orf22  121 NLIQSGLWTALRTRPFSKIPAVDAEPFAIFVNAMDTNP                       158
           NLI+SGLWTA RTRPFSK+PA+DA P +IFVNAMDTNP
48kDa  121 NLIESGLWTAFRTRPFSKVPALDAIPSSIFVNAMDTNP                       158
```

ORF22a (SEQ ID NO: 128) also shows homology to the 48 kDa *Actinobacillus pleuropneumoniae* protein (SEQ ID NO: 123):

```
gi|1185395 (U24492) 48 kDa outer membrane protein [Actinobacillus pleuropneumoniae]
Length = 449

Score = 530 bits (1351), Expect = e-150
Identities = 274/450 (60%), Positives = 323/450 (70%), Gaps = 4/450 (0%)

Query:    1 MIKIKKGLNLPIAGRPEQVIYDGPVITEVALLGEEYAGMRPXMKVKEGDAVKKGQVLFED   60
            MI IKKGL+LPIAG P QVI++G  + EVA+LGEEY GMRP MKV+EGD VKKGQVLFED
Sbjct:    1 MITIKKGLDLPIAGTPAQVIHNGNTVNEVAMLGEEYVGMRPSMKVREGDVVKKGQVLFED   60

Query:   61 KKXPGVVFTAPVSGKIAAIHRGEKRVLQSVVIAVEGNDEIEFERYAPEALANLSGXEXXX  120
            KK PGVVFTAP SG +  I+RGEKRVLQSVVI VEG+++I F RY    LA+LS   +
Sbjct:   61 KKNPGVVFTAPASGTVVTINRGEKRVLQSVVIKVEGDEQITFTRYEAAQLASLSAEQVKQ  120

Query:  121 NLIQSGLWTALRXRPFSKIPAVDAEPFAIFVNAMDTNPLAADPVVVIKEAXXDFRRXXLV  180
            NLI+SGLWTA R RPFSK+PA+DA P +IFVNAMDTNPLAADP VV+KE    DF+    V
Sbjct:  121 NLIESGLWTAFRTRPFSKVPALDAIPSSIFVNAMDTNPLAADPEVVLKEYETDFKDGLTV  180

Query:  181 LSRL--TERKIHVCKAAGADVP-SENAANIETHEFGGPHPAGLSGTHIHFIEPVGANKTV  237
            L+RL   ++ +++CK A +++P S      I    F G HPAGL GTHIHF++PVGA K V
Sbjct:  181 LTRLFNGQKPVYLCKDADSNIPLSPAIEGITIKSFSGVHPAGLVGTHIHFVDPVGATKQV  240

Query:  238 WTINYQDVIAIGRLFATGRLNTERVIALGGSQVNKPRLLRTVLGAKVSQITAGELVDADN  297
            W +NYQDVIAIG+LF TG L T+R+I+L G QV  PRL+RT LGA +SQ+TA EL   +N
Sbjct:  241 WHLNYQDVIAIGKLFTTGELFTDRIISLAGPQVKNPRLVRTRLGANLSQLTANELNAGEN  300

Query:  298 RVISGSVLNGAITQGAHDYLGRYMNQISVIEEGRSKELFGWVAPQPDKYSITRTTLGHFL  357
            RVISGSVL+GA    G  DYLGRY Q+SV+ EGR KELFGW+ P  DK+SITRT LGHF
Sbjct:  301 RVISGSVLSGATAAGPVDYLGRYALQVSVLAEGREKELFGWIMPGSDKFSITRTVLGHFG  360

Query:  358 KNKLFKFTTAVNGGDRAMVPIGTYERVMXXXXXXXXXXXXXXXVGDTDSAQXXXXXXXXX  417
            K KLF FTTAV+GG+RAMVPIG YERVM               GDTDSAQ
Sbjct:  361 K-KLFNFTTAVHGGERAMVPIGAYERVMPLDIIPTLLLRDLAAGDTDSAQNLGCLELDEE  419

Query:  418 XXXXXSFVCPGKYEXGPLLRKVLETXEKEG                               447
                 ++VCPGK  GP+LR  LE  EKEG
```

ORF22ng-1 (SEQ ID NO: 132) also shows homology with the OMP (SEQ ID NO: 1123) from *A.pleuropneumoniae*:

```
gi|1185395 (U24492) 48 kDa outer membrane protein [Actinobacillus
pleuropneumoniae] Length = 449
Score = 555 bits (1414), Expect = e-157
Identities = 284/450 (63%), Positives = 337/450 (74%), Gaps = 4/450 (0%)

Query:   27 MIKIKKGLNLPIAGRPEQVIYDGPAITEVALLGEEYVGMRPSMKIKEGEAVKKGQVLFED   86
            MI IKKGL+LPIAG P QVI++G  + EVA+LGEEYVGMRPSMK++EG+ VKKGQVLFED
Sbjct:    1 MITIKKGLDLPIAGTPAQVIHNGNTVNEVAMLGEEYVGMRPSMKVREGDVVKKGQVLFED   60
```

```
                                    -continued
Query:  87 KKNPGVVFTAPASGKIAAIHRGSKRVLQSVVIAVEGNDEIEFERYVPEALAKLSSEKVRR   146
           KKNPGVVFTAPASG +   I+RGEKRVLQSVVI VEG+++I F RY     LA LS+E+V++
Sbjct:  61 KKNPGVVFTAPASGTVVTINRGEKRVLQSVVIKVEGDEQITFTRYEAAQLASLSAEQVKQ   120

Query: 147 NLIQSGLWTALRTRPFSKIPAVDAEPFAIFVNAMDTNPLAADPTVIIKEAAEDFKRGLLV   206
           NLI+SGLWTA RTRPFSK+PA+DA P +IFVNAMDTNPLAADP V++KE    DFK GL V
Sbjct: 121 NLIESGLWTAFRTRPFSKVPALDAIPSSIFVNAMDTNPLAADPEVVLKEYETDFKDGLTV   180

Query: 207 LSRL--TERKIHVCKAAGADVP-SENAANIETHEFGGPHPAGLSGTHIHFIEPVGANKTV   263
           L+RL   ++ +++CK A +++F  S   I    P G HPAGL GTHIHF++PVGA K V
Sbjct: 181 LTRLFNGQKPVYLCKDADSNIPLSPAIEGITIKSFSGVHPAGLVGTHIHFVDPVGATKQV   240

Query: 264 WTINYQDVIAIGRLFVTGRLNTERVVALGGLQVNKPRLLRTVLGAKVSQLTAGELVDADN   323
           W +NYQDVIAIG+LF TG L T+R+++L G QV  PRL+RT LGA +SQLTA EL    +N
Sbjct: 241 WHLNYQDVIAIGKLFTTGELFTDRIISLAGPQVKNPRLVRTRLGANLSQLTANELNAGEN   300

Query: 324 RVISGSVLNGAIAQGAHDYLGRYHNQISVIEEGRSKELFGWVAPQPDKYSITRTTLGHFL   383
           RVISGSVL+GA A G   DYLGRY  Q+SV+ EGR KELFGW+  P  DK+SITRT LGHF
Sbjct: 301 RVISGSVLSGATAAGPVDYLGRYALQVSVLAEGREKELFGWIMPGSDKFSITRTVLGHFG   360

Query: 384 KNKLFKFTTAVNGGDRAMVPIGTYERVMXXXXXXXXXXXXXXXXVGDTDSAQXXXXXXXXXX   443
           K KLF FTTAV+GG+RAMVPIG YERVM                GDTDSAQ
Sbjct: 361 K-KLFNFTTAVHGGERAMVPIGAYERVMPLDIIPTLLLRDLAAGDTDSAQNLGCLELDEE   419

Query: 444 XXXXXSFVCPGKYEYGPLLRKVLETIEKEG                                473
                ++VCPGK  YGP+LR  LE IEKEG
Sbjct: 420 DLALCTYVCPGKNNYGPMLRAALEKIEKEG                                449
```

Based on this analysis, including the homology with the outer membrane protein (SEQ ID NO: 1123) of *Actinobacillus pleuropneumoniae*, it was predicted that these proteins from *N.meningitidis* and *N.gonorrhoeae*, and their epitopes, could be useful antigens for vaccines or diagnostics, or for raising antibodies.

Figure 5A:
Figure 5B:
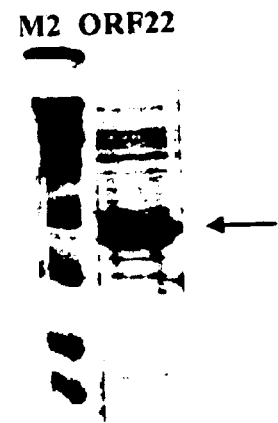
Figure 5C:
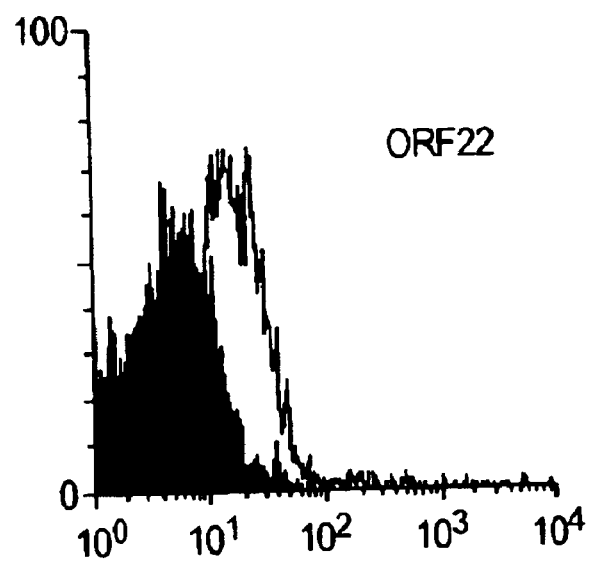

ORF22-1 (SEQ ID NO: 126) (35.4 kDa) was cloned in pET and pGex vectors and expressed in *E.coli*, as described above. The products of protein expression and purification were analyzed by SDS-PAGE. FIG. 5A shows the results of affinity purification of the GST-fusion protein, and FIG. 5B shows the results of expression of the His-fusion in *E.coli*. Purified GST-fusion protein was used to immunise mice, whose sera were used for ELISA (positive result) and FACS analysis (FIG. 5C). These experiments confirm that ORF22-1 (SEQ ID NO: 126) is a surface-exposed protein, and that it is a useful immunogen.

Example 16

The following partial DNA sequence was identified in *N.meningitidis* (SEQ ID NO: 133):

```
  1   ..GCGnCGnAAA TCATCCATCC CC..nACGTC GTAGGCCCTG AAGCCAACTG
 51     GTTTTTTATG GTAGCCAGTA CGTTTGTGAT TGCTTTGATT GGTTATTTTG
101     TTACTGAAAA AATCGTCGAA CCGCAATTGG GCCCTTATCA ATCAGATTTG
151     TCACAAGAAG AAAAAGACAT TCGGCATTCC AATGAAATCA CGCCTTTGGA
201     ATATAAAGGA TTAATTTGGG CTGGCGTGGT GTTTGTTGCC TTATCCGCCC
251     TATTGGCTTG GAGCATCGTC CCTGCCGACG GTATTTTGCG TCATCCTGAA
301     ACAGGATTGG TTTCCGGTTC GCCGTTTTTA AAATCGATTG TTGTTTTTAT
351     TTTCTTGTTG TTTGCACTGC CGGGCATTGT TTATGGCCGG GTAACCCGAA
401     GTTTGCGCGG CGAACAGGAA GTCGTTAATG CGmyGGCCGA ATCGATGAGT
451     ACTCTGGsGC TTTmTTTGsw CAkcATCTTT TTTGCCGCAC AGTTTGTCGC
501     ATTTTTTAAT TGGACGAATA TTGGGCAATA TATTGCCGTT AAAGGGGCGA
551     CGTTCTTAAA AGAAGTCGGC TTGGGCGGCA GCGTGTTGTT TATCGGTTTT
601     ATTTTAATTT GTGCTTTTAT CAATCTGATG ATAGGCTCCG CCTCCGCGCA
651     ATGGGCGGTA ACTGCGCCGA TTTTCGTCCC TATGCTGATG TTGGCCGGCT
701     ACGCGCCCGA AGTCATTCAA GCCGCTTACC GCATCGGTGA TTCCGTTACC
751     AATATTATTA CGCCGATGAT GAGTTATTTC GGGCTGATTA TGGCGACGGT
801     GrkCmmmTAC AAAAAAGATG CGGGCGTGGG TaCGcTGATT wCTATGATGT
```

```
851  TGCCGTATTC CGCTTTCTTC TTGATTGCgT GGATTGCCTT ATTCTGCATT

901  TGGGTATTTg TTTTGGGCCT GCCCGTCGGT CCCGGCGCGC CCACATTCTA

951  TCCCGCACCT TAA
```

This corresponds to the amino acid sequence (SEQ ID NO: 134; ORF12):

```
  1  ..AXXIIHPXXV VGPEANWFFM VASTFVIALI GYFVTEKIVE PQLGPYQSDL

51  SQEEKDIRHS NEITPLEYKG LIWAGVVFVA LSALLAWSIV PADGILRHPE

101  TGLVSGSPFL KSIVVFIFLL FALPGIVYGR VTRSLRGEQE VVNAXAESMS

151  TLXLXLXXIF FAAQFVAFFN WTNIGQYIAV KGATFLKEVG LGGSVLFIGF

201  ILICAFINLM IGSASAQWAV TAPIFVPMLM LAGYAPEVIQ AAYRIGDSVT

251  NIITPMMSYF GLIMATVXXY KKDAGVGTLI XMMLPYSAFF LIAWIALFCI

301  WVFVLGLPVG PGAPTFYPAP *
```

Further sequence analysis revealed the complete DNA sequence (SEQ ID NO: 135) to be:

```
   1  ATGAGTCAAA CCGATACGCA ACGGGACGGA CGATTTTTAC GCACAGTCGA

51  ATGGCTGGGC AATATGTTGC CGCATCCGGT TACGCTTTTT ATTATTTTCA

101  TTGTGTTATT GCTGATTGCC TCTGCCGTCG GTGCGTATTT CGGACTATCC

151  GTCCCCGATC CGCGCCCTGT TGGTGCGAAA GGACGTGCCG ATGACGGTTT

201  GATTTACATT GTCAGCCTGC TCAATGCCGA CGGTTTTATC AAAATCCTGA

251  CGCATACCGT TAAAAATTTC ACCGGTTTCG CGCCGTTGGG AACGGTGTTG

301  GTTTCTTTAT TGGGCGTGGG GATTGCGGAA AAATCGGGCT TGATTTCCGC

351  ATTAATGCGC TTATTGCTCA CAAAATCGCC ACGCAAACTC ACTACTTTTA

401  TGGTTGTTTT TACAGGGATT TTATCTAATA CCGCTTCTGA ATTGGGCTAT

451  GTCGTCCTAA TCCCTTTGTC CGCCATCATC TTTCATTCCC TCGGCCGCCA

501  TCCGCTTGCC GGTCTGGCTG CGGCTTTCGC CGGCGTTTCG GGCGGTTATT

551  CGGCCAATCT GTTCTTAGGC ACAATCGATC CGCTCTTGGC AGGCATCACC

601  CAACAGGCGG CGCAAATCAT CCATCCCGAC TACGTCGTAG GCCCTGAAGC

651  CAACTGGTTT TTTATGGTAG CCAGTACGTT TGTGATTGCT TTGATTGGTT

701  ATTTTGTTAC TGAAAAAATC GTCGAACCGC AATTGGGCCC TTATCAATCA

751  GATTTGTCAC AAGAAGAAAA AGACATTCGG CATTCCAATG AAATCACGCC

801  TTTGGAATAT AAAGGATTAA TTTGGGCTGG CGTGGTGTTT GTTGCCTTAT

851  CCGCCCTATT GGCTTGGAGC ATCGTCCCTG CCGACGGTAT TTTGCGTCAT

901  CCTGAAACAG GATTGGTTTC CGGTTCGCCG TTTTTAAAAT CGATTGTTGT

951  TTTTATTTTC TTGTTGTTTG CACTGCCGGG CATTGTTTAT GGCCGGGTAA

1001  CCCGAAGTTT GCGCGGCGAA CAGGAAGTCG TTAATGCGAT GGCCGAATCG

1051  ATGAGTACTC TGGGGCTTTA TTTGGTCATC ATCTTTTTTG CCGCACAGTT

1101  TGTCGCATTT TTTAATTGGA CGAATATTGG GCAATATATT GCCGTTAAAG

1151  GGGCGACGTT CTTAAAAGAA GTCGGCTTGG GCGGCAGCGT GTTGTTTATC
```

```
1201  GGTTTTATTT TAATTTGTGC TTTTATCAAT CTGATGATAG GCTCCGCCTC

1251  CGCGCAATGG GCGGTAACTG CGCCGATTTT CGTCCCTATG CTGATGTTGG

1301  CCGGCTACGC GCCCGAAGTC ATTCAAGCCG CTTACCGCAT CGGTGATTCC

1351  GTTACCAATA TTATTACGCC GATGATGAGT TATTTCGGGC TGATTATGGC

1401  GACGGTGATC AAATACAAAA AAGATGCGGG CGTGGGTACG CTGATTTCTA

1451  TGATGTTGCC GTATTCCGCT TTCTTCTTGA TTGCGTGGAT TGCCTTATTC

1501  TGCATTTGGG TATTTGTTTT GGGCCTGCCC GTCGGTCCCG GCGCGCCCAC

1551  ATTCTATCCC GCACCTTAA
```

This corresponds to the amino acid sequence (SEQ ID NO: 136; ORF12-1):

```
  1  MSQTDTQRDG RFLRTVEWLG NMLPHPVTLF IIFIVLLLIA SAVGAYFGLS

51  VPDPRPVGAK GRADDGLIYI VSLLNADGFI KILTHTVKNF TGFAPLGTVL

101  VSLLGVGIAE KSGLISALMR LLLTKSPRKL TTFMVVFTGI LSNTASELGY

151  VVLIPLSAII FHSLGRHPLA GLAAAFAGVS GGYSANLFLG TIDPLLAGIT

201  QQAAQIIHPD YVVGPEAAWF FMVASTFVIA LIGYFVTEKI VEPQLGPYQS

251  DLSQEEKDIR HSNEITPLEY KGLIWAGVVF VALSALLAWS IVPADGILRH

301  PETGLVSGSP FLKSIVVFIF LLFALPGIVY GRVTRSLRGE QEVVNAMAES

351  MSTLGLYLVI IFFAAQFVAF FNWTNIGQYI AVKGATFLKE VGLGGSVLFI

401  GFILICAFIN LMIGSASAQW AVTAPIFVPM LMLAGYAPEV IQAAYRIGDS

451  VTNIITPMMS YFGLIMATVI KYKKDAGVGT LISMMLPYSA FFLIAWIALF

501  CIWVFVLGLP VGPGAPTFYP AP*
```

Computer analysis of this amino acid sequence gave the following results:
Homology with a Predicted ORF from *N.meningitidis* (Strain A)

ORF12 (SEQ ID NO: 134) shows 96.3% identity over a 320aa overlap with an ORF (ORF12a) (SEQ ID NO: 138) from strain A of *N. meningitidis*:

```
                                          10        20        30
orf12.pep                           AXXIIHPXXVVGPEANWFFMVASTFVIALI
                                    |   ||||  ||||||||||||||||||||
orf12a    AAAFAGVSGGYSANLFLGTIDPLLAGITQQAAQIIHPDYVVGPEANWFFMVASTFVIALI
                180       190       200       210       220       230

40        50        60        70        80        90
orf12.pep GYFVTEKIVEPQLGPYQSDLSQEEKDIRHSNEITPLEYKGLIWAGVVFVALSALLAWSIV
          ||||||||||||||||||||||||||||||||||||||||||||||||||||||||||||
orf12a    GYFVTEKIVEPQLGPYQSDLSQEEKDIRHSNEITPLEYKGLIWAGVVFVALSALLAWSIV
                240       250       260       270       280       290

100       110       120       130       140       150
orf12.pep PADGILRHPETGLVSGSPFLKSIVVFIFLLFALPGIVYGRVTRSLRGEQEVVNAXAESMS
          |||||||||||||||||||||||||||||||||||||||||||||||||||||| |||||
orf12a    PADGILRHPETGLVSGSPFLKSIVVFIFLLFALPGIVYGRVTRSLRGEQEVVNAMAESMS
                300       310       320       330       340       350

160       170       180       190       200       210
orf12.pep TLXLXLXXIFFAAQFVAFFNWTNIGQYIAVKGATFLKEVGLGGSVLFIGFILICAFINLM
          || | | ||||||||||||||||||||||||||||||||||||||||||||||||||||
orf12a    TLGLYLVIIFFAAQFVAFFNWTNIGQYIAVKGATFLKEVGLGGSVLFIGFILICAFINLM
                360       370       380       390       400       410
```

```
                     220        230        240        250        260        270
orf12.pep  IGSASAQWAVTAPIFVPMLMLAGYAPEVIQAAYRIGDSVTNIITPMMSYFGLIMATVXXY
           ||||||||||||||||||||||||||||||||||||||||||||||||||||||||| |
orf12a     IGSASAQWAVTAPIFVPMLMLAGYAPEVIQAAYRIGDSVTNIITPMMSYFGLIMATVIKY
                     420        430        440        450        460        470

280        290        300        310        320
orf12.pep  KKDAGVGTLIXMMLPYSAFFLIAWIALFCIWVFVLGLPVGPGAPTFYPAPX
           ||||||||||| |||||||||||||||||||||||||||||||||||||||
orf12a     KKDAGVGTLISMMLPYSAFFLIAWIALFCIWVFVLGLPVGPGAPTFYPAPX
              480        490        500        510        520
```

The complete length ORF12a nucleotide sequence (SEQ ID NO: 137) is:

```
   1  ATGAGTCAAA CCGATACGCA ACGGGACGGA CGATTTTTAC GCACAGTCGA
  51  ATGGCTGGGC AATATGTTGC CGCACCCGGT TACGCTTTTT ATTATTTTCA
 101  TTGTGTTATT GCTGATTGCC TCTGCCGCCG GTGCGTATTT CGGACTATCC
 151  GTCCCCGATC CGCGCCCTGT TGGTGCGAAA GGACGTGCCG ATGACGGTTT
 201  GATTCACGTT GTCAGCCTGC TCGATGCTGA CGGTTTGATC AAAATCCTGA
 251  CGCATACCGT TAAAAATTTC ACCGGTTTCG CGCCGTTGGG AACGGTGTTG
 301  GTTTCTTTAT TGGGCGTGGG GATTGCGGAA AAATCGGGCT TGATTTCCGC
 351  ATTAATGCGC TTATTGCTCA CAAAATCTCC ACGCAAACTC ACTACTTTTA
 401  TGGTTGTTTT TACAGGGATT TTATCTAATA CCGCTTCTGA ATTGGGCTAT
 451  GTCGTCCTAA TCCCTTTGTC CGCCATCATC TTTCATTCCC TCGGCCGCCA
 501  TCCGCTTGCC GGTCTGGCTG CGGCTTTCGC CGGCGTTTCG GCGGTTATT
 551  CGGCCAATCT GTTCTTAGGC ACAATCGATC CGCTCTTGGC AGGCATCACC
 601  CAACAGGCGG CGCAAATCAT CCATCCCGAC TACGTCGTAG CCCTGAAGC
 651  CAACTGGTTT TTTATGGTAG CCAGTACGTT TGTGATTGCT TTGATTGGTT
 701  ATTTTGTTAC TGAAAAAATC GTCGAACCGC AATTGGGCCC TTATCAATCA
 751  GATTTGTCAC AAGAAGAAAA AGACATTCGA CATTCCAATG AAATCACGCC
 801  TTTGGAATAT AAAGGATTAA TTTGGGCTGG CGTGGTGTTT GTTGCCTTAT
 851  CCGCCCTATT GGCTTGGAGC ATCGTCCCTG CCGACGGTAT TTTGCGTCAT
 901  CCTGAAACAG GATTGGTTTC CGGTTCGCCG TTTTTAAAAT CAATTGTTGT
 951  TTTTATTTTC TTGTTGTTTG CACTGCCGGG CATTGTTTAT GGCCGGGTAA
1001  CCCGAAGTTT GCGCGGCGAA CAGGAAGTCG TTAATGCGAT GGCCGAATCG
1051  ATGAGTACTC TGGGGCTTTA TTTGGTCATC ATCTTTTTTG CCGCACAGTT
1101  TGTCGCATTT TTTAATTGGA CGAATATTGG GCAATATATT GCCGTTAAAG
1151  GGGCGACGTT CTTAAAAGAA GTCGGCTTGG GCGGCAGCGT GTTGTTTATC
1201  GGTTTTATTT TAATTTGTGC TTTTTATCAAT CTGATGATAG CTCCGCCTC
1251  CGCGCAATGG GCGGTAACTG CGCCGATTTT CGTCCCTATG CTGATGTTGG
1301  CCGGCTACGC GCCCGAAGTC ATTCAAGCCG CTTACCGCAT CGGTGATTCC
1351  GTTACCAATA TTATTACGCC GATGATGAGT TATTTCGGGC TGATTATGGC
1401  GACGGTGATC AAATACAAAA AAGATGCGGG CGTGGGTACG CTGATTTCTA
1451  TGATGTTGCC GTATTCCGCT TTCTTCTTGA TTGCGTGGAT TGCCTTATTC
1501  TGCATTTGGG TATTTGTTTT GGGCCTGCCC GTCGGTCCCG GCGCGCCCAC
1551  ATTCTATCCC GCACCTTAA
```

This encodes a protein having amino acid sequence (SEQ ID NO: 138):

```
  1 MSQTDTQRDG RFLRTVEWLG NMLPHPVTLF IIFIVLLLIA SAAGAYFGLS

51 VPDPRPVGAK GRADDGLIHV VSLLDADGLI KILTHTVKNF TGFAPLGTVL

101 VSLLGVGIAE KSGLISALMR LLLTKSPRKL TTFMVVFTGI LSNTASELGY

151 VVLIPLSAII FHSLGRHPLA GLAAAFAGVS GGYSANLFLG TIDPLLAGIT

201 QQAAQIIHPD YVVGPEANWF FMVASTFVIA LIGYFVTEKI VEPQLGPYQS

251 DLSQEEKDIR HSNEITPLEY KGLIWAGVVF VALSALLAWS IVPADGILRH

301 PETGLVSGSP FLKSIVVFIF LLFALPGIVY GRVTRSLRGE QEVVNAMAES

351 MSTLGLYLVI IFFAAQFVAF FNWTNIGQYI AVKGATFLKE VGLGGSVLFI

401 GFILICAFIN LMIGSASAQW AVTAPIFVPM LMLAGYAPEV IQAAYRIGDS

451 VTNIITPMMS YFGLIMATVI KYKKDAGVGT LISMMLPYSA FFLIAWIALF

501 CIWVFVLGLP VGPGAPTFYP AP*
```

ORF12a (SEQ ID NO: 138) and ORF12-1 (SEQ ID NO: 136) show 99.0% identity in 522 aa overlap:

```
                    10         20         30         40         50         60
orf12a.pep  MSQTDTQRDGRFLRTVEWLGNMLPHPVTLFIIFIVLLLIASAAGAYFGLSVPDPRPVGAK
            ||||||||||||||||||||||||||||||||||||||||:|||||||||||||||||||
orf12-1     MSQTDTQRDGRFLRTVEWLGNMLPHPVTLFIIFIVLLLIASAVGAYFGLSVPDPRPVGAK
                    10         20         30         40         50         60

70         80         90        100        110        120
orf12a.pep  GRADDGLIHVVSLLDADGLIKILTHTVKNFTGFAPLGTVLVSLLGVGIAEKSGLISALMR
            ||||||||::||||:|||:|:|||||||||||||||||||||||||||||||||||||||
orf12-1     GRADDGLIYIVSLLNADGFIKILTHTVKNFTGFAPLGTVLVSLLGVGIAEKSGLISALMR
                    70         80         90        100        110        120

130        140        150        160        170        180
orf12a.pep  LLLTKSPRKLTTFMVVFTGILSNTASELGYVVLIPLSAIIFHSLGRHPLAGLAAAFAGVS
            |||||||||||||:||||||||||||||||||||||||||||||||||||||||||||||
orf12-1     LLLTKSPRKLTTFTVVFTGILSNTASELGYVVLIPLSAIIFHSLGRHPLAGLAAAFAGVS
                   130        140        150        160        170        180

190        200        210        220        230        240
orf12a.pep  GGYSANLFLGTIDPLLAGITQQAAQIIHPDYVVGPEANWFFMVASTFVIALIGYFVTEKI
            ||||||||||||||||||||||||||||||||||||||||||||||||||||||||||||
orf12-1     GGYSANLFLGTIDPLLAGITQQAAQIIHPDYVVGPEANWFFMVASTFVIALIGYFVTEKI
                   190        200        210        220        230        240

250        260        270        280        290        300
orf12a.pep  VEPQLGPYQSDLSQEEKDTRHSNEITPLEYKGLIWAGVVFVALSALLAWSIVPADGILRH
            ||||||||||||||||||| ||||||| ||||||||||||||||||||||||||||||||
orf12-1     VEPQLGPYQSDLSQEEKDIRHSNETTPLEYKGLIWAGVVFVALSALLAWSIVPADGILRH
                   250        260        270        280        290        300

310        320        330        340        350        360
orf12a.pep  PETGLVSGSPFLKSIVVFIFLLFALPGIVYGRVTRSLRGEQEVVNAMAESMSTLGLYLVI
            ||||||||||||||||||||||||||||||||||||||||||||||||||||||||||||
orf12-1     PETGLVSGSPFLKSIVVFIFLLFALPGIVYGRVTRSLRGEQEVVNAMAESMSTLGLYLVI
                   310        320        330        340        350        360

370        380        390        400        410        420
orf12a.pep  IFFAAQFVAFFNWTNIGQYIAVKGATFLKEVGLGGSVLFIGFTLICAFINLMIGSASAQW
            |||||||||||||||||||||||||||||||||||||||||| |||||||||||||||||
orf12-1     IFFAAQFVAFFNWTNIGQYIAVKGATFLKEVGLGGSVLFIGFILICAFINLMIGSASAQW
                   370        380        390        400        410        420

430        440        450        460        470        480
orf12a.pep  AVTAPIFVPMLMLAGYAPEVIQAAYRIGDSVTNIITPMMSYFGLIMATVIKYKKDAGVGT
            ||||||||||||||||||||||||||||||||||||||||||||||||||||||||||||
orf12-1     AVTAPIFVPMLMLAGYAPEVIQAAYRIGDSVTNIITPMMSYFGLIMATVIKYKKDAGVGT
                   430        440        450        460        470        480
```

```
                     -continued
                490       500       510       520
orf12a.pep   LISMMLPYSAFFLIAWIALFCIWVFVLGLPVGPGAPTFYPAPX
             ||||||||||||||||||||||||||||||||||||||||||
orf12-1      LISMMLPYSAFFLIAWIALFCIWVFVLGLPVGPGAPTFYPAPX
                490       500       510       520
```

Homology with a Predicted ORF from *N.gonorrhoeae*
ORF12 (SEQ ID NO: 134) shows 92.5% identity over a 320aa overlap with a predicted ORF (ORF12.ng) (SEQ ID NO: 140) from *N. gonorrhoeae*:

```
orf12.pep                          AXXIIHPXXVVGPEANWFFMVASTFVIALI   30
                                   |  ||||  |||||||||||:||||||||||
orf12ng    AAAFAGVSGGYSANLFLGTIDPLLAGITQQAAQIIHPDYVVGPEANWFFMAASTFVIALI  232 orf12.pep  GYFVTEKIVEPQLGPYQSDLSQEEKDIRHSNEITPLEYKGLIWAGVVFVALSALLAWSIV   90
           ||||||||||||||||||||||||||||||||||||||||||||||||||||||||||||
orf12ng    GYFVTEKIVEPQLGPYQSDLSQEEKDIRHSNEITPLEYKGLIWAGVVFVALSALLAWSIV  292 orf12.pep  PADGILRHPETGLVSGSPFLKSIVVFIFLLFALPGIVYGRVTRSLRGEQEVVNAXAESMS  150
           ||||||||||||||:|||||||||||||||||||||||:|||||||:||||| ||||
orf12ng    PADGILRHPETGLVAGSPFLKSIVVFIFLLFALPGIVYGRITRSLRGEREVVNANAESMS  352 orf12.pep  TLXLXLXXIFFAAQFVAFFNWTNIGQYIAVKGATFLKEVGLGGSVLFIGFILICAFINLM  210
           ||  |  ||||||||||||||||||||||||||:|||:  ||||||||||||||||||||
orf12ng    TLGLYLVIIFFAAQFVAFFNWTNIGQYIAVKGAVFLKKFRLGGSVLFIGFILICAFINLM  412 orf12.pep  IGSASAQWAVTAPIFVPMLMLAGYAPEVIQAAYRIGDSVTNIITPMMSYFGLIMATVXXY  270
           |||||||||||||||||||||||| ||:||||||||||||||||||||||||||||||  |
orf12ng    IGSASAQWAVTAPIFVPMLMLAGNAPQVIQAAYRIGDSVTNIITPMMSYFGLIMATVIKY  472 orf12.pep  KKDAGVGTLIXMMLPYSAFFLIAWIALFCIWVFVLGLPVGPGAPTFYPAP           320
           ||||||||||| |||||||||||||||||||||||||||||||:||||:|
orf12ng    KKDAGVGTLISMMLPYSAFFLIAWIALFCIWVFVLGLPVGPGTPTFYPVP           522
```

The complete length ORF12ng nucleotide sequence (SEQ ID NO: 139) is:

```
  1    ATGAGTCAAA CCGACGCGCG TCGTAGCGGA CGATTTTTAC GCACAGTCGA

51    ATGGCTGGGC AATATGTTGC CGCACCCGGT TACGCTTTTT ATTATTTTCA

101    TTGTGTTATT GCTCATTGcc tctgCCGTCG GTGCGTATTT CGGACTATCC

151    GTCCCCGATC CGCGTCCTGT TGGGGCGAAA GGACGTGCCG ATGACGGTTT

201    GATTCACGTT GTCAGCCTGC TCGATGCCGA CGGTTTGATC AAAATCCTGA

251    CGCATACCGT TAAAAATTTC ACCGGTTTCG CGCCGTTGGG AACGGTGTTG

301    GTTTCTTTAT TGGGCGTGGG GATTGCGGAA AAATCGGGCT TGATTTCCGC

351    ATTAATGCGC TTATTGCTCA CAAAATCCCC ACGCAAACTC ACTACTTTTA

401    TGGTTGTTTT TACAGGGATT TTATCCAATA CGGCTTCTGA ATTGGGCTAT

451    GTCGTCCTAA TCCCTTTGTC CGCCGTCATC TTTCATTCGC TCGGCCGCCA

501    TCCGCTTGCC GGTTTGGCTG CGGCTTTCGC CGGCGTTTCG GGCGGTTATT

551    CGGCCAATCT GTTCTTAGGC ACAATCGATC CGCTCTTGGC AGGCATCACC

601    CAACAGGCGG CGCAAATCAT CCATCCCGAC TACGTCGTAG GCCCTGAAGC

651    CAACTGGTTT TTTATGGCAG CCAGTACGTT TGTGATTGCT TTGATTGGTT

701    ATTTTGTTAC TGAAAAAATC GTCGAACCGC AATTGGGCCC TTATCAATCA

751    GATTTGTCAC AAGAAGAAAA AGACATTCGG CATTCCAATG AAATCACGCC

801    TTTGGAATAT AAAGGATTAA TTTGGGCAGG CGTGGTGTTT GTTGCCTTAT
```

```
 851  CCGCCCTATT GGCTTGGAGC ATCGTCCCTG CCGACGGTAT TTTGCGTCAT
 901  CCTGAAACAG GATTGGTTGC CGGTTCGCCG TTTTTAAAAT CGATTGTTGT
 951  TTTTATTTTC TTGTTGTTTG CGCTGCCGGG CATTGTTTAT GGCCGGATAA
1001  CCCGAAGTTT GCGCGGCGAA CGGGAAGTCG TTAATGCGAT GGCCGAATCG
1051  ATGAGTACTT TGGGACTTTA TTTGGTCATC ATCTTTTTTG CCGCACAGTT
1101  TGTCGCATTT TTTAATTGGA CGAATATTGG GCAATATATT GCCGTTAAAG
1151  GGGCGGTGTT CTTAAAAGAA GTCGGCTTGG GCGGCAGTGT GTTGTTTATC
1201  GGTTTTATTT TAATTTGTGC TTTTATCAAT CTGATGATAG GCTCCGCCTC
1251  CGCGCAATGG GCGGTAACTG CGCCGATTTT CGTCCCTATG CTCATGTTGG
1301  CCGGCTACGC GCCCGAAGTC ATTCAAGCCG CTTACCGCAT CGGTGATTCC
1351  GTTACCAATA TTATTACGCC GATGATGAGT TATTTCGGGC TGATTATGGC
1401  GACGGTAATC AAATACAAAA AGATGCGGG CGTAGGCACG CTGATTTCTA
1451  TGATGTTGCC GTATTCCGCT TTCTTCTTAA TTGCATGGAT CGCCTTATTC
1501  TGCATTTGGG TATTTGTTTT GGGTCTGCCC GTCGGTCCCG GCACACCCAC
1551  ATTCTATCCG GTGCCTTAA
```

This encodes a protein having amino acid sequence (SEQ ID) NO: 140):

```
  1  MSQTDARRSG RFLRTVEWLG NMLPHPVTLF IIFIVLLLIA SAVGAYFGLS
 51  VPDPRPVGAK GRADDGLIHV VSLLDADGLI KILTHTVKNF TGFAPLGTVL
101  VSLLGVGIAE KSGLISALMR LLLTKSPRKL TTFMVVFTGI LSNTASELGY
151  VVLIPLSAVI FHSLGRHPLA GLAAAFAGVS GGYSANLFLG TIDPLLAGIT
201  QQAAQIIHPD YVVGPEANWF FMAASTFVIA LIGYFVTEKI VEPQLGPYQS
251  DLSQEEKDIR HSNEITPLEY KGLIWAGVVF VALSALLAWS IVPADGILRH
301  PETGLVAGSP FLKSIVVFIF LLFALPGIVY GRITRSLRGE REVVNAMAES
351  MSTLGLYLVI IFFAAQFVAF FNWTNIGQYI AVKGAVFLKK FRLGGSVLFI
401  GFILICAFIN LMIGSASAQW AVTAPIFVPM LMLAGNAPQV IQAAYRIGDS
451  VTNIITPMMS YFGLIMATVI KYKKDAGVGT LISMMLPYSA FFLIAWIALF
501  CIWVFVLGLP VGPGTPTFYP VP*
```

ORF12ng (SEQ ID NO: 140) shows 97.1% identity in 522 aa overlap with ORF12-1 (SEQ ID NO: 136):

```
                     10         20         30         40         50         60
orf12-1.pep MSQTDTQRDGRFLRTVEWLGNMLPHPVTLFIIFIVLLLIASAVGAYFGLSVPDPRPVGAK
            |||||::|:||||||||||||||||||||||||||||||||||||||||||||||||||
orf12ng     MSQTDARRSGRFLRTVEWLGNMLPHPVTLFIIFIVLLLIASAVGAYFGLSVPDPRPVGAK
                     10         20         30         40         50         60

70         80         90        100        110        120
orf12-1.pep GRADDGLIYIVSLLNADGFIKILTHTVKNFTGFAPLGTVLVSLLGVGIAEKSGLISALMR
            ||||||||:||||:||||:|||||||||||||||||||||||||||||||||||||||
orf12ng     GRADDGLIHVVSLLDADGLIKILTHTVKNFTGFAPLGTVLVSLLGVGIAEKSGLISALMR
                     70         80         90        100        110        120
```

```
                 130       140       150       160       170       180
orf12-1.pep LLLTKSPRKLTTFMVVFTGILSNTASELGYVVLIPLSAIIFHSLGRHPLAGLAAAFAGVS
            |||||||||||||||||||||||||||||||||||||:||||||||||||||||||||||
orf12ng     LLLTKSPRKLTTFMVVFTGILSNTASELGYVVLIPLSAVIFHSLGRHPLAGLAAAFAGVS
                 130       140       150       160       170       180

190       200       210       220       230       240
orf12-1.pep GGYSANLFLGTIDPLLAGITQQAAQIIHPDYVVGPEANWFFMVASTFVIALIGYFVTEKI
            |||||||||||||||||||||||||||||||||||||:||||||||||||||||||||||
orf12ng     GGYSANLFLGTIDPLLAGITQQAAQIIHPDYVVGPEANWFFMAASTFVIALIGYFVTEKI
                 190       200       210       220       230       240

250       260       270       280       290       300
orf12-1.pep VEPQLGPYQSDLSQEEKDIRHSNEITPLEYKGLIWAGVVFVALSALLAWSIVPADGILRH
            ||||||||||||||||||||||||||||||||||||||||||||||||||||||||||||
orf12ng     VEPQLGPYQSDLSQEEKDIRHSNEITPLEYKGLIWAGVVFVALSALLAWSIVPADGILRH
                 250       260       270       280       290       300

310       320       330       340       350       360
orf12-1.pep PETGLVSGSPFLKSIVVFIFLLFALPGIVYGRVTRSLRGEQEVVNAMAESMSTLGLYLVI
            ||||||:|||||||||||||||||||||||||:|||||||:|||||||||||||||||||
orf12ng     PETGLVAGSPFLKSIVVFIFLLFALPGIVYGRITRSLRGEREVVNAMAESMSTLGLYLVI
                 310       320       330       340       350       360

370       380       390       400       410       420
orf12-1.pep IFFAAQFVAFFNWTNIGQYIAVKGATFLKEVGLGGSVLFIGFILICAFINLMIGSASAQW
            |||||||||||||||||||||||||:||||||||||||||||||||||||||||||||||
orf12ng     IFFAAQFVAFFNWTNIGQYIAVKGAVFLKEVGLGGSVLFIGFILICAFINLMIGSASAQW
                 370       380       390       400       410       420

430       440       450       460       470       480
orf12-1.pep AVTAPIFVPMLMLAGYAPEVIQAAYRIGDSVTNIITPMMSYFGLIMATVIKYKKDAGVGT
            ||||||||||||||||||||||||||||||||||||||||||||||||||||||||||||
orf12ng     AVTAPIFVPMLMLAGYAPEVIQAAYRIGDSVTNIITPMMSYFGLIMATVIKYKKDAGVGT
                 430       440       450       460       470       480

490       500       510       520
orf12-1.pep LISMMLPYSAFFLIAWIALFCIWVFVLGLPVGPAPTFYPAPX
            |||||||||||||||||||||||||||||||||:|||||:||
orf12ng     LISMMLPYSAFFLIAWIALFCIWVFVLGLPVGPGTPTFYPVPX
                 490       500       510       520
```

In addition, ORF12ng (SEQ ID NO: 140) shows significant homology with a hypotehtical protein (SEQ ID NO: 1124) from *E.coli*:

```
sp|P46133|YDAH_ECOLI HYPOTHETICAL 55.1 KD PROTEIN IN OGT-DBPA INTERGENIC
REGION
)gi|1787597 (AE000231) hypothetical protein in ogt 5'region [Escherichia coli]
Length = 510
Score = 329 bits (835), Expect = 2e-89
Identities = 178/507 (35%), Positives 281/507 (55%) Gaps = 15/507 (2%)

Query:    8 RSGRFLRTVEWLGNMLPHPVTXXXXXXXXXXXASAVGAYFGLSVPDPRPVGAKGRADDGL    67
            +SG+    VE +GN +PHP             +A+ + FG+S  +P         D
Sbjct:   13 QSGKLYGWVERIGNKVPHPFLLFIYLIIVLMVTTAILSAFGVSAKNP---------TDGTP   64

Query:   68 IHVVSLLDADGLIKILTHTVKNFTGFAPXXXXXXXXXXXXIAEKSGLISALMRLLLTKSP   127
            + V +LL +GL  L + +KNF GFAP            +AE+ GL+ ALM  + +
Sbjct:   65 VVVKNLLSVEGLHWFLPNVIKNFSGFAPLGAILALVLGAGLAERVGLLPALMVKMASHVN   124

Query:  128 RKLTTFMVVFTGTLSNTASELGYVVLIPLSAVIFHSLGRHPLAGLAAAFAGVSGGYSANL   187
            +   ++MV+F    S+  +S+    V++ P+ A+IF  ++GRHP+AGL AA AGV  G++ANL
Sbjct:  125 ARYASYMVLFIAFFSHISSDAALVIMPPMGALIFLAVGRHPVAGLLAAIAGVGCGFTANL   184

Query:  188 FLGTIDPLLAGITQQAAQIIHPDYVVGPEANWFFMAASTFVIALIGYFVTEKIVEPQLGP   247
            + T D LL+GI+  +AA  +P V    NW+FMA+S V+ ++G +T+KI+EP+LG
Sbjct:  185 LIVTTDVLLSGISTEAAAAFNPQMHVSVIDNWYFMASSVVVLTIVGGLITDKIIEPRLGQ   244

Query:  248 YQSDLSQEEKDIRHSNEITPLEYKGLIWAGVVFVALSALLAWSIVPADGILRHPETGLVA   307
            +Q +  ++ + +          S       GL  AGVV +   A +A   ++P +GILR P     V
Sbjct:  245 WQGNSDEKLQTLTESQRF------GLRIAGVVSLLFIAAIALMVIPQNGILRDPINHTVM   298

Query:  308 GSPFLKSIVVFIFLLFALPGIVYGRITRSLRGEREVVNAMAESMSTLGLYLXXXXXXXXX   367
              SPF+K IV  I L F + + +YG  TR++R + +++ + M E M   + ++
```

-continued

```
sp|P46133|YDAH_ECOLI HYPOTHETICAL 55.1 KD PROTEIN IN OGT-DBPA INTERGENIC
REGION
)gi|1787597 (AE000231) hypothetical protein in ogt 5'region [Escherichia coli]
Length = 510
Score = 329 bits (835), Expect = 2e-89
Identities = 178/507 (35%), Positives 281/507 (55%) Gaps = 15/507 (2%)

Sbjct: 299 PSPFIKGIVPLIILFFFVVSLAYGIATRTIRRQADLPHLMIEPMKEMAGFIVMVFPLAQF   358

Query: 368 XXXXNWTNIGQYIAVKGAVFLKEVGLGGSVLFIGFILICAFINLMIGSASAQWAVTAPIF   427
               NW+N+G++IAV    L+  GL G   F+G  L+ +F+ +  I S SA W++ APIF
Sbjct: 359 VAMFNWSNMGKFIAVGLTDILESSGLSGIPAFVGLALLSSFLCMFIASGSAIWSILAPIF   418

Query: 428 VPMLMLAGYAPEVIQAAYRIGDSVTNIITPMMSYFGLIMATVIKYKKDAGVGTLISMMLP   487
           VPM ML G+  P   Q  +RI DS    + P+   L +   +YK DA +GT  S++LP
Sbjct: 419 VPMFMLLGFHPAFAQILFRIADSSVLPLAPVSPFVPLFLGFLQRYKPDAKLGTYYSLVLP   478

Query: 488 YSAFFLIAWIALFCIWVFVLGLPVGPG                                   514
           Y   FL+ W+ +   W +++GLP+GPG
Sbjct: 479 YPLIFLVVWLLMLLAW-YLVGLPIGPG                                   504
```

Based on this analysis, including the presence of several putative transmembrane domains and the predicted actinin-type actin-binding domain signature (shown in bold) in the gonococcal protein, it is predicted that the proteins from N.meningitidis and N.gonorrhoeae, and their epitopes, could be useful antigens for vaccines or diagnostics, or for raising antibodies.

Example 17

The following partial DNA sequence was identified in N.meningitidis (SEQ ID NO: 141):

```
  1  ..ACAGCCGGCG CAGCAGGTTn CnCGGTCTTC GTTTTCGTAA CGGACAGTCA
 51    GGTGGAGGTG TTCGGGAACA TCCAGACCGC AGTGGAAACA GGTTTTTTTC
101    ATGGCATTTC GGTTTCGTCT GTGTTTGGTG CGGCGGCACA AGACTCGGCA
151    ATgGCTTCGC GCAGTGCGTC TATACCGGTA TTTTCAGCAA CGGAAATGCG
201    GACGGcGgCA ATTTTTCCCG CAGCGTCGCG CCATATGCCC GTGTTTTgTT
251    CTTCAGACGG CAGCAGGTCG GTTTTGTTGT ACACCTTgAT GCACGGAaTA
301    TCGCCGGCAT GGATTTCTTG CAGTACGTTT TCCACGTCTT CAATCTGCTG
351    TCCGCTGGTC GGAGCGGCGG CATCGACGAC GTGCAGCAGC ACATCgGcTT
401    gCGCGGTTTC TTCCAGCGTG GCgGAAAAGG CGGAAATCAG TTTgTGCGGC
451    agATyGCTnA CGAATCCGAC GGTATCGGTC AGGATAATGC TGCATTCGGG
501    ACT..
```

This corresponds to the amino acid sequence (SEQ ID NO: 142; ORF14):

```
  1  ..TAGAAGXXVF VPVTDSQVEV FGNIQTAVET GFFHGISVSS VFGAAAQDSA
 51    MASRSASIPV FSATEMRTAA IFPAASRHMP VFCSSDGSRS VLLYTLMHGI
101    SPAWISCSTF STSSICCPLF GAAASTTCSS TSACAVSSSV AEKAEISLCG
151    RXLTNPTVSV RIMLHSG..
```

Computer analysis of this amino acid sequence gave the following results:
Homology with a Predicted ORF from *N.meningitidis* (Strain A)
ORF14 (SEQ ID NO: 142) shows 94.0% identity over a 167aa overlap with an ORF (ORF14a) (SEQ ID NO: 144) from strain A of *N. meningitidis*:

```
                                  10        20        30
orf14.pep                   TAGAAGXXVFVFVTDSQVEVFGNIQTAVET
                            |:||||  ||||||:|::||||:| ||||
orf14a      GRQLGFLRVGGALFVITAQARVNNALCDCLTTGAAGFAVFVFVTDGQMQVFGNVQPAVET
                    150       160       170       180       190       200

40        50        60        70        80        90
orf14.pep   GFFHGISVSSVFGAAAQDSAMASRSASIPVFSATEMRTAAIFPAASRHMPVFCSSDGSRS
            ||||||||||||||||| |||||||||||||||||||||||||||||||||||||||||
orf14a      GFFHGISVSSVFGAAAQYSAMASRSASIPVFSATEMRTAAIFPAASRHMPVFCSSDGSRS
                    210       220       230       240       250       260

100       110       120       130       140       150
orf14.pep   VLLYTLMHGISPAWISCSTFSTSSICCPLFGAAASTTCSSTSACAVSSSVAEKAEISLCG
            ||||||||||||||||||||||||||||||||||||||||||||||||||||||||||||
orf14a      VLLYTLMHGISPAWISCSTFSTSSICCPLFGAAASTTCSSTSACAVSSSVAEKAEISLCG
                    270       280       290       300       310       320

160
orf14.pep   RXLTNPTVSVRIMLHSG
            | |||||||||||||||
orf14a      RSLTNPTVSVRIMLHSGLMYSRRAVVSSVAKSWSFAYMPDLVSRLNRLDLPTLVX
                    330       340       350       360       370       380
```

This complete length ORF14a nucleotide sequence (SEQ ID NO: 143) is:

```
   1    ATGGAGGATT TGCAGGAAAT CGGGTTCGAT GTCGCCGCCG TAAAGGTAGG
  51    TCGGCAGCGC GAACATCATC GTCTGCATCA TCCCCAGCCC GGCAACGGCG
 101    AGGCGGACGA TGTATTGTTT GCGTTCTTTT TGGTTGGCGG CTTCGATTTT
 151    TTGCGCGTCA TAGGGTGCGG CGGTGTAGCC TATCTGCCTG ATTTTCAACA
 201    GAATGTCGGA AAGGCGGATT TTGCCGTCGT CCCAGACGAC GCGGCAGCGG
 251    TGCGTGCTGT AATTGAGGTC GATGCGGACG ATGCCGTCTG TACGCAAAAG
 301    CTGCTGTTCG ATCAGCCAGA CGCAGGCGGC GCAGGTGATG CCGCCGAGCA
 351    TTAAAACCGC CTCGCGCGTG CCGCCGTGGG TTTCCACAAA GTCGGACTGG
 401    ACTTCGGGCA GGTCGTACAG GCGGATTTGG TCGAGGATTT CTTGGGGCGG
 451    CAGCTCGGTT TTTTGCGCGT CGGCGGTGCG TTGTTTGTAA TAACTGCCCA
 501    AGCCCGCGTC AATAATGCTT TGTGCGACTG CCTGACAACC GGCGCAGCAG
 551    GTTTCGCGGT CTTCGTTTTC GTAACGGACG GTCAGATGCA GGTTTTCGGG
 601    AACGTCCAGC CCGCAGTGGA AACAGGTTTT TTTCATGGCA TTTCGGTTTC
 651    GTCTGTGTTT GGTGCGGCGG CACAATACTC GGCAATGGCT TCGCGCAGTG
 701    CGTCTATACC GGTATTTTCA GCAACGGAAA TGCGGACGGC GGCAATTTTT
 751    CCCGCAGCGT CGCGCCATAT GCCCGTGTTT TGTTCTTCAG ACGGCAGCAG
 801    GTCGGTTTTG TTGTACACCT TGATGCACGG AATATCGCCG GCATGGATTT
 851    CTTGCAGTAC GTTTTCCACG TCTTCAATCT GCTGTCCGCT GTTCGGAGCG
 901    GCGGCATCGA CGACGTGCAG CAGCACATCG GCTTGCGCGG TTTCTTCCAG
 951    CGTGGCGGAA AAGGCGGAAA TCAGTTTGTG CGGCAGATCG CTGACGAATC
```

```
-continued
1001  CGACGGTATC GGTCAGGATA ATGCTGCATT CGGGACTGAT GTACAGCCGC

1051  CGCGCCGTCG TGTCGAGTGT GGCGAAAAGC TGGTCTTTCG CATATATGCC

1101  CGACTTGGTC AGCCGGTTGA ACAGACTGGA TTTGCCGACA TTGGTATAG
```

This encodes a protein having amino acid sequence (SEQ ID NO: 144):

```
  1  MEDLQEIGFD VAAVKVGRQR EHHRLHHPQP GNGEADDVLF AFFLVGGFDF

51  LRVIGCGGVA YLPDFQQNVG KADFAVVPDD AAAVRAVIEV DADDAVCTQK

101  LLFDQPDAGG AGDAAEH*NR LARAAVGFHK VGLDFGQVVQ ADLVEDFLGR

151  QLGFLRVGGA LFVITAQARV NNALCDCLTT GAAGFAVFVF VTDGQMQVFG

201  NVQPAVETGF FHGISVSSVF GAAAQYSAMA SRSASIPVFS ATEMRTAAIF

251  PAASRHMPVF CSSDGSRSVL LYTLMHGISP AWISCSTFST SSICCPLFGA

301  AASTTCSSTS ACAVSSSVAE KAEISLCGRS LTNPTVSVRI MLHSGLMYSR

351  RAVVSSVAKS WSFAYMPDLV SRLNRLDLPT LV*
```

It should be noted that this sequence includes a stop codon at position 118.

Homology with a Predicted ORF from *N.gonorrhoeae*

ORF14 (SEQ ID NO: 142) shows 89.8% identity over a 167aa overlap with a predicted ORF (ORF14.ng) (SEQ ID NO: 146) from *N. gonorrhoeae*:

```
orf14.pep                     TAGAAGXXVFVFVTDSQVEVFGNIQTAVET   30
                              ||  |||   ||:||:|:|::|||:| ||||
orf14ng    GRQFGFFRVGGASFVITAQAGIDDALCDCLTADAAGFAVFAFVADGQMQVFGNVQPAVET  208 orf14.pep  GFFHGISVSSVFGAAAQDSAMASRSASIPVFSATEMRTAAIFPAASRHMPVFCSSDGSRS
           |||||||||||||| ||||||||||||||||||||||||||||||||||||||||||||   90
orf14ng    GFFHGISVSSVFGAAAQYSAMASRSASIPVFSATEMRTAAIFPAASRHMPVFCSSDGSRS  268 orf14.pep  VLLYTLMHGISPAWISCSTFSTSSICCPLFGAAASTTCSSTSACAVSSSVAEKAEISLCG
           ||||||||||| |||||||||||||||||||| ||||||||||:|||:||||||||||   150
orf14ng    VLLYTLMHGISWAWISCSTFSTSSICCPLFRAAASTTCSSTSACTVSSKVAEKAEISLCG  328 orf14.pep  RXLTNPTVSVRIMLHSG
           |  ||||||||||||:|                                             167
orf14ng    RSLTNPTVSVRIMLHSGLMYSRRAVVSRVAKSWSFAYMPDLVSRLNRLDLPTLV         382
```

The complete length ORF14ng nucleotide sequence (SEQ ID NO: 145) is predicted to encode a protein having amino acid sequence (SEQ ID NO: 146):

```
  1  MEDLQEIGFD VAAVKVGRQR EHHRLHHTQS GNGKADDVLF AFFLVGGFDF

51  LRVIGCGGVA CLPDFQQNVG EADFAVVPDD AAAVRAVIEV DADDAVCAQK

101  LLFDQPDAGG AGNAAEHQHC FVRAIMGFHK VGLDFGQVVQ ADLVEDFLGR

151  QFGFFRVGGA SFVITAQAGI DDALCDCLTA DAAGFAVFAF VADGQMQVFG

201  NVQPAVETGF FHGISVSSVF GAAAQYSAMA SRSASIPVFS ATEMRTAAIF

251  PAASRHMPVF CSSDGSRSVL LYTLMHGISW AWISCSTFST SSICCPLFRA

301  AASTTCSSTS ACTVSSKVAE KAEISLCGRS LTNPTVSVRI MLHAGLMYSR

351  RAVVSRVAKS WSFAYMPDLV SRLNRLDLPT LV*
```

Based on the putative transmembrane domain in the gonococcal protein, it is predicted that the proteins from *N.meningitidis* and *N.gonorrhoeae*, and their epitopes, could be useful antigens for vaccines or diagnostics, or for raising antibodies.

Example 18

The following partial DNA sequence was identified in *N.meningitidis* (SEQ ID NO: 147):

```
  1  ..GGCCATTACT CCGACCGCAC TTGGAAGCCG CGTTTGGNCG GCCGCCGTCT
 51    GCCGTATCTG CTTTATGGCA CGCTGATTGC GGTTATTGTG ATGATTTTGA
101    TGCCGAACTC GGGCAGCTTC GGTTTCGGCT ATGCGTCGCT GGCGGCTTTG
151    TCGTTCGGCG CGCTGATGAT TGCGCTGTTA GACCTGTCGT CAAATATGGC
201    GATGCAGCCG TTTAAGATGA TGGTCGGCGA CATGGTCAAC GAGGAGCAGA
251    AAA.NTACGC CTACGGGATT CAAAGTTTCT TAGCAAATAC GGGCGCGGTC
301    GTGGCGGCGA TTCTGCCGTT TGTGTTTGCG TATATCGGTT TGGCGAACAC
351    CGCCGANAAA GGCGTTGTGC CGCAGACCGT GGTCGTGGCG TTTTATGTGG
401    GTGCGGCGTT GCTGGTGATT ACCAGCGCGT TCACGATTTT CAAAGTGGAG
451    GAATACGANC CGGAAACCTA CGCCCGTTAC CACGGCATCG ATGTCGCCGC
501    GAATCAGGAA AAAGCCAACT GGATCGCACT CTTAAAA.CC GCGC..
```

This corresponds to the amino acid sequence (SEQ ID NO: 148; ORF16):

```
  1  ..GHYSDRTWKP RLXGRRLPYL LYGTLIAVIV MILMPNSGSF GFGYASLAAL
 51    SFGALMIALL DVSSNMAMQP FKMMVGDMVN EEQKXYAYGI QSFLANTGAV
101    VAAILPFVFA YIGLANTAXK GVVPQTVVVA FYVGAALLVI TSAFTIFKVK
151    EYXPETYARY HGIDVAANQE KANWIALLKX A..
```

Further work revealed the complete nucleotide sequence (SEQ ID NO: 149):

```
  1    ATGTCGGAAT ATACGCCTCA AACAGCAAAA CAAGGTTTGC CCGCGCTGGC
 51    AAAAAGCACG ATTTGGATGC TCAGTTTCGG CTTTCTCGGC GTTCAGACGG
101    CCTTTACCCT GCAAAGCTCG CAAATGAGCC GCATTTTTCA AACGCTAGGC
151    GCAGACCCGC ACAATTTGGG CTGGTTTTTC ATCCTGCCGC CGCTGGCGGG
201    GATGCTGGTG CAGCCGATTG TCGGCCATTA CTCCGACCGC ACTTGGAAGC
251    CGCGTTTGGG CGGCCGCCGT CTGCCGTATC TGCTTTATGG CACGCTGATT
301    GCGGTTATTG TGATGATTTT GATGCCGAAC TCGGGCAGCT TCGGTTTCGG
351    CTATGCGTCG CTGGCGGCTT TGTCGTTCGG CGCGCTGATG ATTGCGCTGT
401    TAGACGTGTC GTCAAATATG GCGATGCAGC CGTTTAAGAT GATGGTCGGC
451    GACATGGTCA ACGAGGAGCA GAAAGGCTAC GCCTACGGGA TTCAAAGTTT
501    CTTAGCAAAT ACGGGCGCGG TCGTGGCGGC GATTCTGCCG TTTGTGTTTG
551    CGTATATCGG TTTGGCGAAC ACCGCCGAGA AAGGCGTTGT GCCGCAGACC
601    GTGGTCGTGG CGTTTTATGT GGGTGCGGCG TTGCTGGTGA TTACCAGCGC
651    GTTCACGATT TTCAAAGTGA AGGAATACGA TCCGGAAACC TACGCCCGTT
701    ACCACGGCAT CGATGTCGCC GCGAATCAGG AAAAAGCCAA CTGGATCGAA
```

```
 751   CTCTTGAAAA  CCGCGCCTAA  GGCGTTTTGG  ACGGTTACTT  TGGTGCAATT

801   CTTCTGCTGG  TTCGCCTTCC  AATATATGTG  GACTTACTCG  GCAGGCGCGA

851   TTGCGGAAAA  CGTCTGGCAC  ACCACCGATG  CGTCTTCCGT  AGGTTATCAG

901   GAGGCGGGTA  ACTGGTACGG  CGTTTTGGCG  GCGGTGCAGT  CGGTTGCGGC

951   GGTGATTTGT  TCGTTTGTAT  TGGCGAAAGT  GCCGAATAAA  TACCATAAGG

1001   CGGGTTATTT  CGGCTGTTTG  GCTTTGGGCG  CGCTCGGCTT  TTTCTCCGTT

1051   TTCTTCATCG  GCAACCAATA  CGCGCTGGTG  TTGTCTTATA  CCTTAATCGG

1101   CATCGCTTGG  GCGGGCATTA  TCACTTATCC  GCTGACGATT  GTGACCAACG

1151   CCTTGTCGGG  CAAGCATATG  GGCACTTACT  TGGGCTTCTT  TAACGGCTCT

1201   ATCTGTATGC  CTCAAATCGT  CGCTTCGCTG  TTGAGTTTCG  TGCTTTTCCC

1251   TATGCTGGGC  GGCTTGCAGG  CCACTATGTT  CTTGGTAGGG  GGCGTCGTCC

1301   TGCTGCTGGG  CGGGTTTTCC  GTGTTCCTGA  TTAAAGAAAC  ACACGGCGGG

1351   GTTTGA
```

This corresponds to the amino acid sequence (SEQ ID NO: 150; ORF16-1):

```
  1   MSEYTPQTAK  QGLPALAKST  IWMLSFGFLG  VQTAFTLQSS  QMSRIFQTLG

51   ADPHNLGWFF  ILPPLAGMLV  QPIVGHYSDR  TWKPRLGGRR  LPYLLYGTLI

101   AVIVMILMPN  SGSFGFGYAS  LAALSFGALM  IALLDVSSNM  AMQPFKMMVG

151   DMVNEEQKGY  AYGIQSFLAN  TGAVVAAILP  FVFAYIGLAN  TAEKGVVPQT

201   VVVAFYVGAA  LLVITSAFTI  FKVKEYDPET  YARYHGIDVA  ANQEKANWIE

251   LLKTAPKAFW  TVTLVQFFCW  FAFQYMWTYS  AGAIAENVWH  TTDASSVGYQ

301   EAGNWYGVLA  AVQSVAAVIC  SFVLAKVPNK  YHKAGYFGCL  ALGALGFFSV

351   FFIGNQYALV  LSYTLIGIAW  AGIITYPLTI  VTNALSGKHM  GTYLGLFNGS

401   ICMPQIVASL  LSFVLFPMLG  GLQATMFLVG  GVVLLLGAFS  VFLIKETHGG

451   V*
```

Computer analysis of this amino acid sequence gave the following results:
Homology with a Predicted ORF from *N.meningitidis* (Strain A)

ORF16 (SEQ ID NO: 148) shows 96.7% identity over a 181aa overlap with an ORF (ORF16a) (SEQ ID NO: 152) from strain A of *N. meningitidis*:

```
                              10         20         30
orf16.pep                     GHYSDRTWKPRLXGRRLPYLLYGTLIAVIV
                              ||||||||||||  |||||||||||||||
orf16a     IFQTLGADPHSLGWFFILPPLAGMLVQPIVGHYSDRTWKPRLGGRRLPYLLYGTLIAVIV
                 50         60         70         80         90        100

40         50         60         70         80         90
orf16.pep    MILMPNSGSFGFGYASLAALSFGALMIALLDVSSNMAMQPFKMMVGDMVNEEQKXYAYGI
             |||||||||||||||||||||||||||||||||||||||||||||||||||||| |||||
orf16a       MILMPNSGSFGFGYASLAALSFGALMIALLDVSSNMAMQPFKMMVGDMVNEEQKGYAYGI
               110        120        130        140        150        160

100        110        120        130        140        150
orf16.pep    QSFLANTGAVVAAILPFVFAYIGLANTAXKGVVPQTVVVAFYVGAALLVITSAFTIFKVK
             |||||||||||||||||||||||||||||| |||||||||||||||||||||||||||||
orf16a       QSFLANTGAVVAAILPFVFAYIGLANTAEKGVVPQTVVVAFYVGAALLVITSAFTIFKVK
               170        180        190        200        210        220
```

```
                      -continued
                160       170       180
orf16.pep  EYXPETYARYHGIDVAANQEKANWIALLKXA
           ||  |||||||||||||||||||||| |||:|
orf16a     EYNPETYARYHGIDVAANQEKANWIELLKTAPKAFWTVTLVQFFCWFAFQYMWTYSAGAI
                230       240       250       260       270       280 orf16a     AENVWHTTDASSVGYQEAGNWYGVLAAVQSVAAVICSFVLAKVPNKYHKAGYFGCLALGA
                290       300       310       320       330       340
```

The complete length ORF16a nucleotide sequence (SEQ ID NO: 151) is:

```
   1  ATGTCGGAAT ATACGCCTCA AACAGCAAAA CAAGGTTTGC CCGCGCTGGC
  51  AAAAAGCACG ATTTGGATGC TCAGTTTCGG CTTTCTCGGC GTTCAGACGG
 101  CCTTTACCCT GCAAAGCTCG CAGATGAGCC GCATCTTCCA GACGCTCGGT
 151  GCCGATCCGC ACAGCCTCGG CTGGTTCTTT ATCCTGCCGC CGCTGGCGGG
 201  GATGCTGGTG CAGCCGATTG TCGGCCATTA CTCCGACCGC ACTTGGAAGC
 251  CGCGTTTGGG CGGCCGCCGT CTGCCGTATC TGCTTTATGG CACGCTGATT
 301  GCGGTTATTG TGATGATTTT GATGCCGAAC TCGCGCAGCT TCGGTTTCGG
 351  CTATGCGTCG CTGGCGGCTT TGTCGTTCGG CGCGCTGATG ATTGCGCTGT
 401  TAGACGTGTC GTCAAATATG GCGATGCAGC CGTTTAAGAT GATGGTCGGC
 451  GACATGGTCA ACGAGGAGCA GAAAGGCTAC GCCTACGGGA TTCAAAGTTT
 501  CTTAGCGAAT ACGGGCGCGG TCGTGGCGGC GATTCTGCCG TTTGTGTTTG
 551  CGTATATCGG TTTGGCGAAC ACCGCCGAGA AAGGCGTTGT GCCGCAGACC
 601  GTGGTCGTGG CGTTTTATGT GGGTGCGGCG TTGCTGGTGA TTACCAGCGC
 651  GTTCACGATT TTCAAAGTGA AGGAATACAA TCCGGAAACC TACGCCCGTT
 701  ACCACGGCAT CGATGTCGCC GCGAATCAGG AAAAAGCCAA CTGGATCGAA
 751  CTCTTGAAAA CCGCGCCTAA GGCGTTTTGG ACGGTTACTT TGGTGCAATT
 801  CTTCTGCTGG TTCGCCTTCC AATATATGTG GACTTACTCG GCAGGCGCGA
 851  TTGCGGAAAA CGTCTGGCAC ACCACCGATG CGTCTTCCGT AGGTTATCAG
 901  GAGGCGGGTA ACTGGTACGG CGTTTTGGCG GCGGTGCAGT CGGTTGCGGC
 951  GGTGATTTGT TCGTTTGTAT TGGCGAAAGT GCCGAATAAA TACCATAAGG
1001  CGGGTTATTT CGGCTGTTTG GCTTTGGGCG CGCTCGGCTT TTTCTCCGTT
1051  TTCTTCATCG GCAACCAATA CGCGCTGGTG TTGTCTTATA CCTTAATCGG
1101  CATCGCTTGG GCGGGCATTA TCACTTATCC GCTGACGATT GTGACCAACG
1151  CCTTGTCGGG CAAGCATATG GGCACTTACT TGGGCCTGTT TAACGGCTCT
1201  ATCTGTATGC CGCAAATCGT CGCTTCGCTG TTGAGTTTCG TGCTTTTCCC
1251  TATGCTGGGC GGCTTGCAGG CCACTATGTT CTTGGTAGGG GGCGTCGTCC
1301  TGCTGCTGGG CGCGTTTTCC GTGTTCCTGA TTAAAGAAAC ACACGGCGGG
1351  GTTTGA
```

This encodes a protein having amino acid sequence (SEQ ID NO: 152):

```
  1  MSEYTPQTAK QGLPALAKST IWMLSFGFLG VQTAFTLQSS QMSRIFQTLG

51  ADPHSLGWFF ILPPLAGMLV QPIVGHYSDR TWKPRLGGRR LPYLLYGTLI
```

```
101 AVIVMILMPN SGSFGFGYAS LALLSFGALM IALLDVSSNM AMQPFKMMVG

151 DMVNEEQKGY AYGIQSFLAN TGAVVAAILP FVFAYIGLAN TAEKGVVPQT

201 VVVAFYVGAA LLVITSAFTI FKVKEYNPET YARYMGIDVA ANQEKANWIE

251 LLKTAPKAFW TVTLVQFFCW FAFQYMWTYS AGAIAENVWH TTDASSVGYQ

301 EAGNWYGVLA AVQSVAAVIC SFVLAKVPNK YHKAGYFGCL ALGALGFFSV

351 FFIGNQYALV LSYTLIGIAW AGIITYPLTI VTNALSGKHM GTYLGLFNGS

401 ICMPQIVASL LSFVLFPMLG GLQATMFLVG GVVLLLGAFS VFLIKETHGG

451 V*
```

ORF16a (SEQ ID NO: 152) and ORF16-1 (SEQ ID NO: 150) show 99.6% identity in 451 aa overlap:

```
                   10         20         30         40         50         60
orf16a.pep  MSEYTPQTAKQGLPALAKSTIWMLSFGFLGVQTAFTLQSSQMSRIFQTLGADPHSLGWFF
            ||||||||||||||||||||||||||||||||||||||||||||||||||||:|||||
orf16-1     MSEYTPQTAKQGLPALAKSTIWMLSFGFLGVQTAFTLQSSQMSRIFQTLGADPHNLGWFF
                   10         20         30         40         50         60

70         80         90        100        110        120
orf16a.pep  ILPPLAGMLVQPIVGHYSDRTWKPRLGGRRLPYLLYGTLIAVIVMILMPNSGSFGFGYAS
            ||||||||||||||||||||||||||||||||||||||||||||||||||||||||||||
orf16-1     ILPPLAGMLVQPIVGHYSDRTWKPRLGGRRLPYLLYGTLIAVIVMILMPNSGSFGFGYAS
                   70         80         90        100        110        120

130        140        150        160        170        180
orf16a.pep  LAALSFGALMIALLDVSSNMAMQPFKMMVGDMVNEEQKGYAYGIQSFLANTGAVVAAILP
            ||||||||||||||||||||||||||||||||||||||||||||||||||||||||||||
orf16-1     LAALSFGALMIALLDVSSNMAMQPFKMMVGDMVNEEQKGYAYGIQSFLANTGAVVAAILP
                  130        140        150        160        170        180

190        200        210        220        230        240
orf16a.pep  FVFAYIGLANTAEKGVVPQTVVVAFYVGAALLVITSAFTIFKVKEYNPETYARYHGIDVA
            |||||||||||||||||||||||||||||||||||||||||||:||||||||||||||
orf16-1     FVFAYIGLANTAEKGVVPQTVVVAFYVGAALLVITSAFTIFKVKEYDPETYARYHGIDVA
                  190        200        210        220        230        240

250        260        270        280        290        300
orf16a.pep  ANQEKANWIELLKTAPKAFWTVTLVQFFCWFAFQYMWTYSAGAIAENVWHTTDASSVGYQ
            ||||||||||||||||||||||||||||||||||||||||||||||||||||||||||||
orf16-1     ANQEKANWIELLKTAPKAFWTVTLVQFFCWFAFQYMWTYSAGAIAENVWHTTDASSVGYQ
                  250        260        270        280        290        300

310        320        330        340        350        360
orf16a.pep  EAGNWYGVLAAVQSVAAVICSFVLAKVPNKYHKAGYFGCLALGALGFFSVFFIGNQYALV
            ||||||||||||||||||||||||||||||||||||||||||||||||||||||||||||
orf16-1     EAGNWYGVLAAVQSVAAVICSFVLAKVPNKYHKAGYFGCLALGALGFFSVFFIGNQYALV
                  310        320        330        340        350        360

370        380        390        400        410        420
orf16a.pep  LSYTLIGIAWAGIITYPLTIVTNALSGKHMGTYLGLFNGSICMPQIVASLLSFVLFPMLG
            ||||||||||||||||||||||||||||||||||||||||||||||||||||||||||||
orf16-1     LSYTLIGIAWAGIITYPLTIVTNALSGKHMGTYLGLFNGSICMPQIVASLLSFVLFPMLG
                  370        380        390        400        410        420

430        440        450
orf16a.pep  GLQATMFLVGGVVLLLGAFSVFLIKETHGGVX
            |||||||||||||||||||||||||||||||
orf16-1     GLQATMFLVGGVVLLLGAFSVFLIKETHGGVX
                  430        440        450
```

Homology with a Predicted ORF from *N.gonorrhoeae*
ORF16 (SEQ ID NO: 148) shows 93.9% identity over a 181aa overlap with a predicted ORF (ORF16.ng) (SEQ ID NO: 154) from *N. gonorrhoeae*:

```
orf16.pep                             GHYSDRTWKPRLXGRRLPYLLYGTLIAVIV   30
                                      |:||||||||||  ||||||||||||||||
orf16ng     HFSNARRRPAQFGLVFHPAAAGGDAGSADSGYYSDRTWKPRLGGRRLPYLLYGTLIAVIV  131 orf16.pep   MILMPNSGSFGFGYASLAALSFGALMIALLDVSSNMAMQPFKMMVGDMVNEEQKXYAYGI   90
            ||||||||||||||||||||||||||||||||||||||||||||||||||||||| ||||
orf16ng     MILMPNSGSFGFGYASLAALSFGALMIALLDVSSNMAMQPFKMMVGDMVNEEQKSYAYGI  191 orf16pep    QSFLANTGAVVAAILPFVFAYIGLANTAXKGVVPQTVVVAFYVGAALLVITSAFTIFKVK  150
            ||||||| |||||||||||||||||||| ||||||||||||||||||:|||||| |||
orf16ng     QSFLANTDAVVAAILPFVFAYIGLANTAEKGVVPQTVVVAFYVGAALLTITSAFTTSKVK  251 orf16.pep   EYXPETYARYHGIDVAANQEKANWIALLKXA                               181
            || |||||||||||||||||||||||||:| |||:|
orf16ng     EYDPETYARYHGTDVAANQEKANWFELLKTAPKVFWTVTPVQFFCWFAFRYMWTYSAGAI  311
```

The complete length ORF16ng nucleotide sequence (SEQ ID NO: 153) is:

```
   1    ATGATAGGGG ATCGCCGCGC CGGCAACCAT TTCGGATTTT CCAAAGCAAA
  51    TACTTTTCAA ATCAAAAAAA AGGATTTACT TTATGTCGGA ATATACGCCT
 101    CAAACAGCAA AACAAGGTTT GCCCGCGCCG GCAAAAAGCA CGATTTGGAT
 151    GTTGAGCTTC GGCTATCTCG GCGTTCAGAC GGCCTTTACC CTGCAAAGCT
 201    CGCAGATGAG CCGCATTTTT CAAACGCTAG GCGCAGACCC GCACAATTTG
 251    GGCTGGTTTT TCATCCTGCC GCCGCTGGCG GGGATGCTGG TTCAGCCGAT
 301    AGTGGCTACT ACTCAGACCG CACTTGGAAG CCGCGCTTGG GCGGCCGCCG
 351    CCTGCCGTAT CTGCTTTACG GCACGCTGAT TGCGGTCATC GTGATGATTT
 401    TGATGCCGAA CTCGGGCAGC TTCGGTTTCG GCTATGCGTC GCTGGCGGCC
 451    TTGTCGTTCG GCGCGCTGAT GATTGCGCTG TTGGACGTGT CGTCGAATAT
 501    GGCGATGCAG CCGTTTAAGA TGATGGTCGG CGATATGGTC AACGAGGAGC
 551    AGAAAAGCTA CGCCTACGGG ATTCAAAGTT TCTTAGCGAA TACGGACGCG
 601    GTTGTGGCAG CGATTCTGCC GTTTGTGTTC GCGTATATCG GTTTGGCGAA
 651    CACTGCCGAG AAAGGCGTTG TGCCACAAAC CGTGGTCGTA GCATTCTATG
 701    TGGGTGCGGC GTTACTGATT ATTACCAGTG CGTTCACAAT CTCCAAAGTC
 751    AAAGAATACG ACCCGGAAAC CTACGCCCGT TACCACGGCA TCGATGTCGC
 801    CGCGAATCAG GAAAAAGCCA ACTGGTTCGA ACTCTTAAAA ACCGCGCCTA
 851    AAGTGTTTTG GACGGTTACT CCGGTACAGT TTTTCTGCTG GTTCGCCTTC
 901    CGGTATATGT GGACTTACTC GGCAGGCGCG ATTGCAGAAA ACGTCTGGCA
 951    CACTACCGAT GCGTCTTCCG TAGGCCATCA GGAGGCGGGC AACCGGTACG
1001    GCGTTTTGGC GGCGGTGTAG
```

This encodes a protein having amino acid sequence (SEQ ID NO: 154):

```
  1    MIGDRRAGNH FGFSKANTFQ IKKKDLLYVG IYASNSKTRF ARAGKKHDLD
 51    VELRLSRRSD GLYPAKLADE PHFSNARRRP AQFGLVFHPA AAGGDAGSAD
```

-continued
```
101  SGYYSDRTWK  PRLGGRRLPY LLYGTLIAVI VMILMPNSGS  FGFGYASLAA

151  ISFGALMIAL  LDVSSNMAMQ  PFKMMVGDMV  NEEQKSYAYG  IQSFLANTDA

201  VVAAILPFVF  AYIGLANTAE  KGVVPQTVVV  AFYVGAALLI  ITSAFTISKV

251  KEYDPETYAR  YHGIDVAANQ  EKANWFELLK  TAPKVFWTVT  PVQFFCWFAF

301  RYMWTYSAGA  IAENVWHTTD  ASSVGHQEAG  NRYGVLAAV*
```

ORF16ng (SEQ ID NO: 154) and ORF16-1 (SEQ ID NO: 150) show 89.3% identity in 261 aa overlap:

```
                    30        40        50        60        70        80
orf16-1.pep  MLSFGFLGVQTAFTLQSSQMSRIFQTLGADPHNLGWFFILPPLAGMLVQPI-VGHYSDRT
                      |  ::|    |    |    ||     :     |:|||||
orf16ng      DVELRLSRRSDGLYPAKLADEPHFSNARRRPAQFGLVF-HPAAAGGDAGSADSGYYSDRT
                  50        60        70        80        90       100

90       100       110       120       130       140
orf16-1.pep  WKPRLGGRRLPYLLYGTLIAVIVMILMPNSGSFGFGYASLAALSFGALMIALLDVSSNMA
             ||||||||||||||||||||||||||||||||||||||||||||||||||||||||||||
orf16ng      WKPRLGGRRLPYLLYGTLIAVIVMILMPNSGSFGFGYASLAALSFGALMIALLDVSSNMA
                 110       120       130       140       150       160

150       160       170       180       190       200
orf16-1.pep  MQPFKMMVGDMVNEEQKGYAYGIQSFLANTGAVVAAILPFVFAYIGLANTAEKGVVPQTV
             ||||||||||||||||:|||||||||||||  ||||||||||||||||||||||||||||
orf16ng      MQPFKMMVGDMVNEEQKSYAYGIQSFLANTDAVVAAILPFVFAYIGLANTAEKGVVPQTV
                 170       180       190       200       210       220

210       220       230       240       250       260
orf16-1.pep  VVAFYVGAALLVITSAFTIFKVKEYDPETYARYHGIDVAANQEKANWIELLKTAPKAFWT
             ||||||||||:|||||||  ||||||||||||||||||||||||||||:|||||||:|||
orf16ng      VVAFYVGAALLIITSAFTISKVKEYDPETYARYHGIDVAANQEKANWFELLKTAPKVFWT
                 230       240       250       260       270       280

270       280       290       300       310       320
orf16-1.pep  VTLVQFFCWFAFQYMWTYSAGAIAENVWHTTDASSVGYQEAGNWYGVLAAVQSVAAVICS
             || ||||||||||:||||||||||||||||||||||||:|||||   ||||||||
orf16ng      VTPVQFFCWFAFRYMWTYSAGAIAENVWHTTDASSVGHQEAGNRYGVLAAVX
                 290       300       310       320       330       340
```

Based on this analysis, including the presence of several putative transmembrane domains in the gonococcal protein, it is predicted that the proteins from *N.meningitidis* and *N.gonorrhoeae*, and their epitopes, could be useful antigens for vaccines or diagnostics, or for raising antibodies.

Example 19

The following partial DNA sequence was identified in *N.meningitidis* (SEQ ID NO: 155):

```
  1  ATGTTGTTCC GTAAAACGAC CGCCGCCGTT TTGGCGCATA CCTTGATGCT

51  GAACGGCTGT ACGTTGATGT TGTGGGGAAT GAACAACCCG GTCAGCGAAA

101  CAATCACCCG NAAACACGTT GNCAAAGACC AAATCCGNGN CTTCGGTGTG

151  GTTGCCGAAG ACAATGCCCA ATTGGAAAAG GGCAGCCTGG TGATGATGGG

201  CGGAAAATAC TGGTTCGTCG TCAATCCCGA AGATTCGGCG AA.NTGACGG

251  GNATTTTGAN GGCAGGGCTG GACAAACCCT TCCAAATAGT TNAGGATACC

301  CCGAGCTATG C.TGCCACCA AGCCCTGCCG GTCAAACTCG GATCGNCTGG

351  CAGCCAGAAT...
```

This corresponds to the amino acid sequence (SEQ ID NO: 156; ORF28):

```
  1  MLFRKTTAAV LAHTLMLNGC TLMLWGMNNP VSETITRKHV XKDQIRXFGV
 51  VAEDNAQLEK GSLVMMGGKY WFVVNPEDSA XXTGILXAGL DKPFQIVXDT
101  PSYXCHQALP VKLGSXGSQN...
```

Further work revealed the complete nucleotide sequence (SEQ ID NO: 157):

```
  1  ATGTTGTTCC GTAAAACGAC CGCCGCCGTT TTGGCGGCAA CCTTGATGCT
 51  GAACGGCTGT ACGTTGATGT TGTGGGGAAT GAACAACCCG GTCAGCGAAA
101  CAATCACCCG CAAACACGTT GACAAAGACC AAATCCGCGC CTTCGGTGTG
151  GTTGCCGAAG ACAATGCCCA ATTGGAAAAG GGCAGCCTGG TGATGATGGG
201  CGGAAAATAC TGGTTCGTCG TCAATCCCGA AGATTCGGCG AAGCTGACGG
251  GCATTTTGAA GGCAGGGCTG GACAAACCCT TCCAAATAGT TGAGGATACC
301  CCGAGCTATG CTCGCCACCA AGCCCTGCCG GTCAAACTCG AATCGCCTGG
351  CAGCCAGAAT TCAGTACCG AAGGCCTTTG CCTGCGCTAC GATACCGACA
401  AGCCTGCCGA CATCGCCAAG CTGAAACAGC TCGGGTTTGA AGCGGTCAAA
451  CTCGACAATC GGACCATTTA CACGCGCTGC GTATCCGCCA AAGGCAAATA
501  CTACGCCACA CCGCAAAAAC TGAACGCCGA TTACCATTTT GAGCAAAGTG
551  TGCCTGCCGA TATTTATTAC ACGGTTACTG AAGAACATAC CGACAAATCC
601  AAGCTGTTTG CAAATATCTT ATATACGCCC CCCTTTTTGA TACTGGATGC
651  GGCGGGCGCG GTACTGGCCT TGCCTGCGGC GGCTCTGGGT GCGGTCGTGG
701  ATGCCGCCCG CAAATGA
```

This corresponds to the amino acid sequence (SEQ ID NO: 158; ORF28-1):

```
  1  MLFRKTTAAV LAATLMLNGC TLMLWGMNNP VSETITRKHV DKDQIRAFGV
 51  VAEDNAQLEK GSLVMMGGKY WFVVNPEDSA KLTGILKAGL DKPFQIVEDT
101  PSYARHQALP VKLESPGSQN FSTEGLCLRY DTDKPADIAK LKQLGFEAVK
151  LDNRTIYTRC VSAKGKYYAT PQKLNADYHF EQSVPADIYY TVTEEHTDKS
201  KLFANILYTP PFLILDAAGA VLALPAAALG AVVDAARK*
```

Computer analysis of this amino acid sequence gave the following results:
Homology with a Predicted ORF from N.meningitidis (Strain A)

ORF28 (SEQ ID NO: 156) shows 79.2% identity over a 120aa overlap with an ORF (ORF28a) (SEQ ID NO: 160) from strain A of N. meningitidis:

```
                         10         20         30         40         50         60
            orf28.pep    MLFRKTTAAVLAHTLMLNGCTLMLWGMNNPVSETITRKVVXKDQIRXFGVVAEDNAQLEK
                         ||||||||||| |||||||:|:|||:| ||| :|||| ||||| ||||||||||||
            orf28a       MLFRKTTAAVLAATLMLNGCTVMMWGMNSPFSETTARKHVDKDQIRAFGVVAEDNAQLEK
                         10         20         30         40         50         60
```

```
                      -continued
                 70         80         90        100        110        120
orf28.pep    GSLVMMGGKYWFVVNPEDSAXXTGILXAGLDKPFQIVXDTPSYXCHQALPVKLGSXGSQN
             ||||||||||||||||||||  ||||  |||||  ||:|   :|  :   :||||||  |  :|||
orf28a       GSLVMMGGKYWFVVNPEDSAKLTGILKAGLDKQFQMVEPNPRFA-YQALPVKLESPASQN
                 70         80         90        100        110 orf28a       FSTEGLCLRYDTDRPADIAKLKQLEFEAVELDNRTIYTRCVSAKGKYYATPQKLNADYHF
                120        130        140        150        160        170
```

The complete length ORF28a nucleotide sequence (SEQ ID NO: 159) is:

```
  1  ATGTTGTTCC GTAAAACGAC CGCCGCCGTT TTGGCGGCAA CCTTGATGTT
 51  GAACGGCTGT ACGGTAATGA TGTGGGGTAT GAACAGCCCG TTCAGCGAAA
101  CGACCGCCCG CAAACACGTT GACAAGGACC AAATCCGCGC CTTCGGTGTG
151  GTTGCCGAAG ACAATGCCCA ATTGGAAAAG GGCAGCCTGG TGATGATGGG
201  CGGGAAATAC TGGTTCGTCG TCAATCCTGA AGATTCGGCG AAGCTGACGG
251  GCATTTTGAA GGCCGGGTTG GACAAGCAGT TCAAATGGT TGAGCCCAAC
301  CCGCGCTTTG CCTACCAAGC CCTGCCGGTC AAACTCGAAT CGCCCGCCAG
351  CCAGAATTTC AGTACCGAAG GCCTTTGCCT GCGCTACGAT ACCGACAGAC
401  CTGCCGACAT CGCCAAGCTG AAACAGCTTG AGTTTGAAGC GGTCGAACTC
451  GACAATCGGA CCATTTACAC GCGCTGCGTC TCCGCCAAAG GCAAATACTA
501  CGCCACACCG CAAAAACTGA ACGCCGATTA TCATTTTGAG CAAAGTGTGC
551  CTGCCGATAT TTATTACACG GTTACGAAAA AACATACCGA CAAATCCAAG
601  TTGTTTGAAA ATATTGCATA TACGCCCACC ACGTTGATAC TGGATGCGGT
651  GGGCGCGGTG CTGGCCTTGC CTGTCGCGGC GTTGATTGCA GCCACGAATT
701  CCTCAGACAA ATGA
```

This encodes a protein having amino acid sequence (SEQ ID NO: 160):

```
  1  MLFRKTTAAV LAATLMLNGC TVMMWGMNSP FSETTARKHV DKDQIRAFGV
 51  VAEDNAQLEK GSLVMMGGKY WFVVNPEDSA KLTGILKAGL DKQFQMVEPN
101  PRFAYQALPV KLESPASQNF STEGLCLRYD TDRPADIAKL KQLEFEAVEL
151  DNRTIYTRCV SAKGKYYATP QKLNADYHFE QSVPADIYYT VTKKHTDKSK
201  LFENIAYTPT TLILDAVGAV LALPVAALIA ATNSSDK*
```

ORF28a (SEQ ID NO: 160) and ORF28-1 (SEQ ID NO: 158) show 86.1% identity in 238 aa overlap:

```
                 10         20         30         40         50         60
orf28a.pep   MLFRKTTAAVLAATLMLNGCTVMMWGMNSPFSETTARKHVDKDQIRAFGVVAEDNAQLEK
             ||||||||||||||||||||:|:||||:| |||  :||||||||||||||||||||||||
orf28-1      MLFRKTTAAVLAATLMLNGCTLMLwGMNNPVSETITRKHVDKDQIRAFGVVAEDNAQLEK
                 10         20         30         40         50         60

70         80         90        100        110       119
orf28a.pep   GSLVMMGGKYWFVVNPEDSAKLTGILKAGLDKQFQMVEPNPRFA-YQALPVKLESPASQN
             |||||||||||||||||||||||||||||||||  ||:||   :|   :|   :||||||||:|||
orf28-1      GSLVMMGGKYWFVVNPEDSAKLTGILKAGLDKPFQIVEDTPSYARHQALPVKLESPGSQN
                 70         80         90        100        110        120
```

```
                 120        130        140        150        160        170       179
orf28a.pep   FSTEGLCLRYDTDRPADIAKLKQLEFEAVELDNRTIYTRCVSAKGKYYATPQKLNADYHF
             |||||||||||:||||||||||  ||||:|||||||||||||||||||||||||||||||
orf28-1      FSTEGLCLRYDTDKPADIAKLKQLGFEAVKLDNRTIYTRCVSAKGKYYATPQKLNADYHF
                    130        140        150        160        170        180

180        190        200        210        220        230
orf28a.pep   EQSVPADIYYTVTKKHTDKSKLFENIAYTPTTLILDAVGAVLALPVAALIAATNSSDKX
             ||||||||||||||::||||||||||  ||  |||  |||||:|||||||:||| |:::::  ||
orf28-1      EQSVPADIYYTVTEEHTDKSKLFANILYTPPFLILDAAGAVLALPAAALGAVVDAARKX
                    190        200        210        220        230
```

Homology with a Predicted ORF from *N.gonorrhoeae*

ORF28 (SEQ ID NO: 156) shows 84.2% identity over a 120aa overlap with a predicted ORF (ORF28.ng) (SEQ ID NO: 162) from *N. gonorrhoeae*:

```
orf28.pep  MLFRKTTAAVLAHTLMLNGCTLMLWGMNNPVSETITRKHVXKDQIRXFGVVARDNAQLEK   60
           |||||||||||||| ||:|||||:|| |||||||:|||||| ||||| ||||||||||||
orf28ng    MLFRKTTAAVLAATLILNGCTMMLRGMNNPVSQTITRKHVDKDQIRAFGVVAEDNAQLEK   60 orf28.pep  GSLVMMGGKYWFVVNPEDSAXXTGILXAGLDKPFQIVXDTPSYXCHQALPVKLGSXGSQN  120
           |||||||||||||:|||||||    ||:| |||||||||||||    |||||||: : ||||
orf28ng    GSLVMMGGKYWFAVNPEDSAKLTGLLKAGLDKPFQIVEDTPSYARHQALPVKFEAPGSQN  120
```

The complete length ORF28ng nucleotide sequence (SEQ ID NO: 161) is

```
  1  ATGTTGTTCC GTAAAACGAC CGCCGCCGTT TTGGCGGCAA CCTTGATACT
 51  GAACGGCTGT ACGATGATGT TGCGGGGGAT GAACAACCCG GTCAGCCAAA
101  CAATCACCCG CAAACACGTT GACAAAGACC AAATCCGCGC CTTCGGTGTG
151  GTTGCCGAAG ACAATGCCCA ATTGGAAAAG GGCAGCCTGG TGATGATGGG
201  CGGGAAATAC TGGTTCGCCG TCAATCCCGA AGATTCGGCG AAGCTGACGG
251  GCCTTTTGAA GGCCGGGTTG GACAAGCCCT TCCAAATAGT TGAGGATACC
301  CCGAGCTATG CCCGCCACCA AGCCCTGCCG GTCAAATTCG AAGCGCCCGG
351  CAGCCAGAAT TTCAGTACCG GAGGTCTTTG CCTGCGCTAT GATACCGGCA
401  GACCTGACGA CATCGCCAAG CTGAAACAGC TTGAGTTTAA AGCGGTCAAA
451  CTCGACAATC GGACCATTTA CACGCGCTGC GTATCCGCCA AAGGCAAATA
501  CTACGCCACG CCGCAAAAAC TGAACGCCGA TTATCATTTT GAGCAAAGTG
551  TGCCCGCCGA TATTTATTAT ACGGTTACTG AAAAACATAC CGACAAATCC
601  AAGCTGTTTG GAAATATCTT ATATACGCCC CCCTTGTTGA TATTGGATGC
651  GGCGGCCGCG GTGCTGGTCT TGCCTATGGC TCTGATTGCA GCCGCGAATT
701  CCTCAGACAA ATGA
```

This encodes a protein having amino acid sequence (SEQ ID NO: 162):

```
  1  MLFRKTTAAV LAATLILNGC TMMLRGMNNP VSQTITRKHV DKDQIRAFGV
 51  VAEDNAQLEK GSLVMMGGKY WFAVNPEDSA KLTGLLKAGL DKPFQIVEDT
101  PSYARHQALP VKFEAPGSQN FSTGGLCLRY DTGRPDDIAK LKQLEFKAVK
151  LDNRTIYTRC VSAKGKYYAT PQKLNADYHF EQSVPADIYY TVTEKHTDKS
201  KLFGNILYTP PLLILDAAAA VLVLPMALIA AANSSDK*
```

ORF28NG (SEQ ID NO: 162) and ORF28-1 (SEQ ID NO: 158) share 90.0% identity in 231 aa overlap:

```
                       10        20        30        40        50        60
orf28-1.pep   MLFRKTTAAVLAATLMLNGCTLMLWGMNNPVSETITRKHVDKDQIRAFGVVAEDNAQLEK
              ||||||||||||||:|||||:|| ||||||||:|||||||||||||||||||||||||||
orf28ng       MLFRKTTAAVLAATLILNGCTMMLRGMNNPVSQTITRKHVDKDQIRAFGVVAEDNAQLEK
                       10        20        30        40        50        60

70        80        90       100       110       120
orf28-1.pep   GSLVMMGGKYWFVVNPEDSAKLTGILKAGLDKPFQIVEDTPSYARHQALPVKLESPGSQN
              |||||||||||||:||||||||||||||:|||||||||||||||||||||||:|:|||||
orf28ng       GSLVMMGGKYWFAVNPEDSAKLTGLLKAGLDKPFQIVEDTPSYARHQALPVKFEAPGSQN
                       70        80        90       100       110       120

130       140       150       160       170       180
orf28-1.pep   FSTEGLCLRYDTDKPADIAKLKQLGFEAVKLDNRTIYTRCVSAKGKYYATPQKLNADYHF
              ||| |||||||| :| ||||||| |:|||||||||||||||||||||||||||||||||
orf28ng       FSTGGLCLRYDTGRPDDIAKLKQLEFKAVKLDNRTIYTRCVSAKGKYYATPQKLNADYHF
                      130       140       150       160       170       180

190       200       210       220       230       239
orf28-1.pep   EQSVPADIYYTVTEEHTDKSKLFANILYTPPFLILDAAGAVLALPAAALGAVVDAARKX
              ||||||||||||||:||||||||:|||||||:||||||:|||:|| | ::|:
orf28ng       EQSVPADIYYTVTEKHTDKSKLFGNILYTPPLLILDAAAAVLVLPMALIAAANSSDKX
                      190       200       210       220       230
```

Based on this analysis, including the presence of a putative transmembrane domain in the gonococcal protein, it was predicted that the proteins from N.meningitidis and N.gonorrhoeae, and their epitopes, could be useful antigens, for vaccines or diagnostics, or for raising antibodies.

Figure 6A:
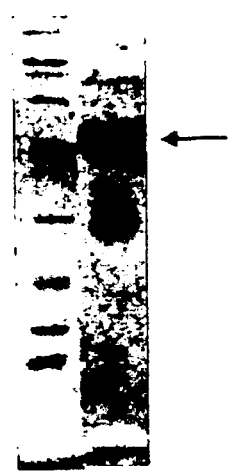
Figure 6B:
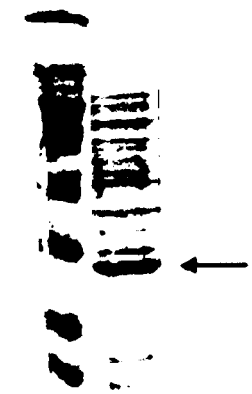

ORF281 (SEQ ID NO: 158) (24 kDa) was cloned in pET and pGex vectors and expressed in E.coli, as described above. The products of protein expression and purification were analyzed by SDS-PAGE. FIG. 6A shows the results of affinity purification of the GST-fusion protein, and FIG. 6B shows the results of expression of the His-fusion in E.coli.

Purified GST-fusion protein was used to immunise mice, whose sera were used for ELISA, which gave a positive result. These experiments confirm that ORF28-1 (SEQ ID NO: 158) is a surface-exposed protein, and that it may be a useful immunogen.

Example 20

The following partial DNA sequence was identified in N.meningitidis (SEQ ID NO: 163):

```
  1 ..GTCAGTCCTG TACTGCCTAT TACACACGAA CGGACAGGGT TTGAAGGTGT
 51   TATCGGTTAT GAAACCCATT TTTCAGGGCA CGGACATGAA GTACACAGTC
101   CGTTCGATCA TCATGATTCA AAAAGCACTT CTGATTTCAG CGGCGGTGTA
151   GACGGCGGTT TTACTGTTTA CCAACTTCAT CGAACATGGT CGGAAATCCA
201   TCCGGAGGAT GAATATGACG GGCCGCAAGC AGCG.ATTAT CCGCCCCCCG
251   GAGGAGCAAG GGATATATAC AGCTATTATG TCAAAGGAAC TTCAACAAAA
301   ACAAAGACTA GTATTGTCCC TCAAGCCCCA TTTTCAGACC GTTGGCTAGA
351   AGAAAATGCC GGTGCCGCCT CTGGT..
```

This corresponds to the amino acid sequence (SEQ ID NO: 164; ORF29):

```
  1 ..VSPVLPITHE RTGFEGVIGY ETHFSGHGHE VHSPFDHHDS KSTSDFSGGV
 51   DGGFTVYQLH RTWSEIHPED EYDGPQAAXY PPPGGARDIY SYYVKGTSTK
101   TKTSIVPQAP FSDRWLEENA GAASG..
```

Further work revealed the complete nucleotide sequence (SEQ ID NO: 165):

```
   1   ATGAATTTGC CTATTCAAAA ATTCATGATG CTGTTTGCAG CAGCAATATC

51   GTTGCTGCAA ATCCCCATTA GTCATGCGAA CGGTTTGGAT GCCCGTTTGC

101   GCGATGATAT GCAGGCAAAA CACTACGAAC CGGGTGGTAA ATACCATCTG

151   TTTGGTAATG CTCGCGGCAG TGTTAAAAAG CGGGTTTACG CCGTCCAGAC

201   ATTTGATGCA ACTGCGGTCA GTCCTGTACT GCCTATTACA CACGAACGGA

251   CAGGGTTTGA AGGTGTTATC GGTTATGAAA CCCATTTTTC AGGGCACGGA

301   CATGAAGTAC ACAGTCCGTT CGATCATCAT GATTCAAAAA GCACTTCTGA

351   TTTCAGCGGC GGTGTAGACG GCGGTTTTAC TGTTTACCAA CTTCATCGAA

401   CAGGGTCGGA AATCCATCCG GAGGATGGAT ATGACGGGCC GCAAGGCAGC

451   GATTATCCGC CCCCCGGAGG AGCAAGGGAT ATATACAGCT ATTATGTCAA

501   AGGAACTTCA ACAAAAACAA AGACTAATAT TGTCCCTCAA GCCCCATTTT

551   CAGACCGTTG GCTAAAAGAA AATGCCGGTG CCGCCTCTGG TTTTTTCAGC

601   CGTGCGGATG AAGCAGGAAA ACTGATATGG GAAAGCGACC CCAATAAAAA

651   TTGGTGGGCT AACCGTATGG ATGATGTTCG CGGCATCGTC CAAGGTGCGG

701   TTAATCCTTT TTTAATGGGT TTTCAAGGAG TAGGGATTGG GGCAATTACA

751   GACAGTGCAG TAAGCCCGGT CACAGATACA GCCGCGCAGC AGACTCTACA

801   AGGTATTAAT GATTTAGGAA AATTAAGTCC GGAAGCACAA CTTGCTGCCG

851   CGAGCCTATT ACAGGACAGT GCTTTTGCGG TAAAAGACGG TATCAACTCT

901   GCCAAACAAT GGGCTGATGC CCATCCAAAT ATAACAGCTA CTGCCCAAAC

951   TGCCCTTTCC GCAGCAGAGG CCGCAGGTAC GGTTTGGAGA GGTAAAAAAG

1001   TAGAACTTAA CCCGACTAAA TGGGATTGGG TTAAAAATAC CGGTTATAAA

1051   AAACCTGCTG CCCGCCATAT GCAGACTTTA GATGGGGAGA TGGCAGGTGG

1101   GAATAAACCT ATTAAATCTT TACCAAACAG TGCCGCTGAA AAAGAAAAC

1151   AAAATTTTGA GAAGTTTAAT AGTAACTGGA GTTCAGCAAG TTTTGATTCA

1201   GTGCACAAAA CACTAACTCC CAATGCACCT GGTATTTTAA GTCCTGATAA

1251   AGTTAAAACT CGATACACTA GTTTAGATGG AAAAATTACA ATTATAAAAG

1301   ATAACGAAAA CAACTATTTT AGAATCCATG ATAATTCACG AAAACAGTAT

1351   CTTGATTCAA ATGGTAATGC TGTGAAAACC GGTAATTTAC AAGGTAAGCA

1401   AGCAAAAGAT TATTTACAAC AACAAACTCA TATCAGGAAC TTAGACAAAT

1451   GA
```

This corresponds to the amino acid sequence (SEQ ID NO: 166; ORF29-1):

```
   1   MNLPIQKFMM LFAAAISLLQ IPISHANGLD ARLRDDMQAK HYEPGGKYHL

51   FGNARGSVKK RVYAVQTFDA TAVSPVLPIT HERTGFEGVI GYETHFSGHG

101   HEVHSPFDHH DSKSTSDFSG GVDGGFTVYQ LHRTGSEIHP EDGYDGPQGS

151   DYPPPGGARD IYSYYVKGTS TKTKTNIVPQ APFSDRWLKE NAGAASGFFS

201   RADEAGKLIW ESDPNKNWWA NRMDDVRGIV QGAVNPFLMG FQGVGIGAIT
```

-continued

```
251  DSAVSPVTDT AAQQTLQGIN DLGKLSPEAQ LAAASLLQDS AFAVKDGINS

301  AKQWADAHPN ITATAQTALS AAEAAGTVWR GKKVELNPTK WDWVKNTGYK

351  KPAARHMQTL DGEMAGGNKP IKSLPNSAAE KRKQNFEKFN SNWSSASFDS

401  VHKTLTPNAP GILSPDKVKT RYTSLDGKIT IIKDNENNYF RIHDNSRKQY

451  LDSNGNAVKT GNLQGKQAKD YLQQQTHIRN LDK*
```

Computer analysis of this amino acid sequence gave the following results:
Homology with a Predicted ORF from N.meningitidis (Strain A)

ORF29 (SEQ ID NO: 164) shows 88.0% identity over a 125aa overlap with an ORF (ORF29a) (SEQ ID NO: 168) from strain A of N. meningitidis:

```
                                                    10         20         30
orf29.pep                                  VSPVLPITHERTGFEGVIGYETHFSGHGHE
                                           |:|:||||||||||||:|||||||||||||
orf29a    EPGGKYHLFGNARGSVKNRVYAVQTFDATAVGPILPITHERTGFEGIIGYETHFSGHGHE
                    50         60         70         80         90        100

40         50         60         70         80         90
orf29.pep  VHSPFDHHDSKSTSDFSGGVDGGFTVYQLHRTWSEIHPEDEYDGPQAAXYPPPGGARDIY
           ||||||:||||||||||||||||||||||||| |||||||| |||||::||||||||||
orf29a     VHSPFDNHDSKSTSDFSGGVDGGFTVYQLHRTGSEIHPEDGYDGPQGSDYPPPGGARDIY
                   110        120        130        140        150        160

100        110        120
orf29.pep  SYYVKGTSTKTKTSIVPQAPFSDRWLEENAGAASG
           ||||||||||||::|||:|||||||:||||||||
orf29a     XXYVKGTSTKTKSNIVPRAPFSDRWLKENAGAASGFFSRADEAGKLIWESDPNKNWWANR
                   170        180        190        200        210        220 orf29a     MDDIRGIVQGAVNPFLMGFQGVGIGAITDSAVSPVTDTAAQQTLQGXNHLGXLSPEAQLA
                   230        240        250        260        270        280
```

The complete length ORF29a nucleotide sequence (SEQ ID NO: 167) is:

```
  1  ATGAATTNGC CTATTCAAAA ATTCATGATG CTGTTTGCAG CAGCAATATC
 51  GTNGCTGCAA ATCCCNATTA GTCATGCGAA CGGTTTGGAT GCCCGTTTGC
101  GCGATGATAT GCAGGCAAAA CACTACGAAC CGGGTGGTAA ATACCATCTG
151  TTTGGTAATG CTCGCGGCAG TGTTAAAAAT CGGGTTTACG CCGTCCAAAC
201  ATTTGATGCA ACTGCGGTCG GCCCCATACT GCCTATTACA CACGAACGGA
251  CAGGATTTGA AGGCATTATC GGTTATGAAA CCCATTTTTC AGGACATGGA
301  CATGAAGTAC ACAGTCCGTT CGATAATCAT GATTCAAAAA GCACTTCTGA
351  TTTCAGCGGC GGCGTAGACG GTGGTTTTAC CGTTTACCAA CTTCATCGGA
401  CAGGGTCGGA AATCCATCCG GAGGATGGAT ATGACGGGCC GCAAGGCAGC
451  GATTATCCGC CCCCCGGAGG AGCAAGGGAT ATATACANNT ANTATGTCAA
501  AGGAACTTCA ACAAAAACAA AGAGTAATAT TGTTCCCCGA GCCCCATTTT
551  CAGACCGCTG GCTAAAAGAA AATGCCGGTG CCGCCTCTGG TTTTTTCAGC
601  CGTGCTGATG AAGCAGGAAA ACTGATATGG GAAAGCGACC CAATAAAAA
651  TTGCTGGGCT AACCGTATGG ATGATATTCG CGGCATCGTC AAGGTGCGG
701  TTAATCCTTT TTTAATGGGT TTTCAAGGAG TAGGGATTGG GGCAATTACA
751  GACAGTGCAG TAAGCCCGGT CACAGATACA GCCGCGCAGC AGACTCTACA
801  AGGTATNAAT CATTTAGGAA ANTTAAGTCC CGAAGCACAA CTTGCGGCTG
```

```
                         -continued
 851     CAACCGCATT ACAAGACAGT GCTTTTGCGG TAAAAGACGG TATCAATTCC

901     GCCAGACAAT GGGCTGATGC CCATCCGAAT ATAACTGCAA CAGCCCAAAC

951     TGCCCTTGCC GTAGCAGANG CCGCAACTAC GGTTTGGGGC GGTAAAAAAG

1001     TAGAACTTAA CCCGACCAAA TGGGATTGGG TTAAAAATAC NGGCTATAAN

1051     ACACCTGCTG TTCGCACCAT GCATACTTTG GATGGGCAAA TGGCCGGTGG

1101     GAATAGACCG CCTAAATCTA TAACGTCCAA CAGCAAAGCA GATGCTTCCA

1151     CACAACCGTC TTTACAAGCG CAACTAATTG GAGAACAAAT TANNNNNGGG

1201     CATGCTTATA ACAAGCATGT CATAAGACAA CAAGAATTTA CGGATTTAAA

1251     TATCAATTCA CCAGCAGATT TTGCTCGGCA TATTGAAAAT ATTGTTAGCC

1301     ATCCANCAAA TATGAAAGAG TTACCTCGCG GTAGAACTGC GTATTGGGAT

1351     NATAAAACAG GGACNATAGT TATCCGAGAT AAAAATTCTG ACGATGGAGG

1401     TACAGCATTT AGACCAACAT CAGCTAAAAA ATATTATGAT GATTTATAG
```

This encodes a protein having amino acid sequence (SEQ ID NO: 168):

```
  1  MNXPIQKFMM LFAAAISXLQ IPISHANGLD ARLRDDMQAK HYEPGGKYHL

51  FGNARGSVKN RVYAVQTFDA TAVGPILPIT HERTGFEGII GYETHFSGHG

101  HEVHSPFDNH DSKSTSDFSG GVDGGFTVYQ LHRTGSEIHP EDGYDGPQGS

151  DYPPPGGARD IYXXYVKGTS TKTKSNIVPR APFSDRWLKE NAGAASGFFS

201  RADEAGKLIW ESDPNKNWWA NRMDDIRGIV QGAVNPFLMG FQGVGIGAIT

251  DSAVSPVTDT AAQQTLQGXN HLGXLSPEAQ LAAATALQDS AFAVKDGINS

301  ARQWADAHPN ITATAQTALA VAXAATTVWG GKKVELNPTK WDWVKNTGYX

351  TPAVRTMHTL DGEMAGGNRP PKSITSNSKA DASTQPSLQA QLIGEQIXXG

401  HAYNKHVIRQ QEFTDLNINS PADFARHIEN IVSHPXNMKE LPRGRTAYWD

451  XKTGTIVIRD KNSDDGGTAF RPTSGKKYYD DL*
```

ORF29a (SEQ ID NO: 168) and ORF29-1 (SEQ ID NO: 166) show 90.1% identity in 385 aa overlap:

```
                    10         20         30         40         50         60
orf29a.pep  MNXPIQKFMMLFAAAISXLQIPISHANGLDARLRDDMQAKHYEPGGKYHLFGNARGSVKN
            ||  |||||||||||||| ||||||||||||||||||||:|||||||||||||||||||:
orf29-1     MNLPIQKFMMLFAAAISLLQIPISHANGLDARLRDDMQAKHYEPGGKYHLFGNARGSVKK
                    10         20         30         40         50         60

70         80         90        100        110        120
orf29a.pep  RVYAVQTFDATAVGPILPITHERTGFEGIIGYETHFSGHGHEVHSPFDNHDSKSTSDFSG
            ||||||||||||| :|:|||||||||||| ||||||||||||||||||:|||||||||||
orf29-1     RVYAVQTFDATAVSPVLPITHERTGFEGVIGYETHFSGHGHEVHSPFDHHDSKSTSDFSG
                    70         80         90        100        110        120

130        140        150        160        170        180
orf29a.pep  GVDGGFTVYQLHRTGSEIHPEDGYDGPQGSDYPPPGGARDIYXXYVKGTSTKTKSNIVPR
            |||||||||||||||||||||||||||||||||||||||||| ||||||||||:||||:
orf29-1     GVDGGFTVYQLHRTGSEIHPEDGYDGPQGSDYPPPGGARDIYSYYVKGTSTKTKTNIVPQ
                   130        140        150        160        170        180

190        200        210        220        230        240
orf29a.pep  APFSDRWLKENAGAASGFFSRADEAGKLIWESDPNKNWWANRMDDIRGIVQGAVNPFLMG
            |||||||||||||||||||||||||||||||||||||||||||||:|||||||||||||
orf29-1     APFSDRWLKENAGAASGFFSRADEAGKLIWESDPNKNWWANRMDDVRGIVQGAVNPFLMG
                   190        200        210        220        230        240
```

```
                 250        260        270        280        290        300
orf29a.pep  FQGVGIGAITDSAVSPVTDTAAQQTLQGXNHLGXLSPEAQLAAATALQDSAFAVKDGINS
            ||||||||||||||||||||||||||||| | || |||||||||: ||||||||||||||
orf29-1     FQGVGIGAITDSAVSPVTDTAAQQTLQGINDLGKLSPEAQLAAASLLQDSAFAVKDGINS
                 250        260        270        280        290        300

310        320        330        340        350        360
orf29a.pep  ARQWADAHPNITATAQTALAVAXAATTVWGGKKVELNPTKWDWVKNTGYXTPAVRTMHTL
            |:||||||||||||||::| || ||| ||||||||||||||||||||||   ||: |:||
orf29-1     AKQWADAHPNITATAQTALSAAEAAGTVWRGKKVELNPTKWDWVKNTGYKKPAARHMQTL
                 310        320        330        340        350        360

370        380        390        400        410        420
orf29a.pep  DGEMAGGNRPPKSITSNSKADASTQPSLQAQLIGEQIXXGHAYNKHVIRQQEFTDLNINS
            |||||||:| ||:   || |:     |
orf29-1     DGEMAGGNKPIKSLP-NSAAEKRKQNFEKFNSNWSSASFDSVHKTLTPNAPGILSPDKVK
                 370        380        390        400        410
```

Homology with a Predicted ORF from *N.gonorrhoeae*

ORF29 (SEQ ID NO: 164) shows 88.8% identity over a 125aa overlap with a predicted ORF (ORF29.ng) (SEQ ID NO: 170) from *N. gonorrhoeae*:

```
orf29.pep                          VSPVLPITHERTGFEGVIGYETHFSGHGHE   30
                                   |:|:||||||||||||||||||||||||||
orf29ng    EPGGKYHLFGNARGSVKNRVCAVQTFDATAVGPILPITHERTGFEGVIGYETHFSGHGHE  102 orf29.pep  VHSPFDHHDSKSTSDFSGGVDGGFTVYQLHRTWSEIHPEDEYDGPQAAXYPPPGGARDIY   90
           ||||||:|||||||||||||||||||||||||| |||||||| |||||::|||||||||||
orf29ng    VHSPFDNHDSKSTSDFSGGVDGGFTVYQLHRTGSEIHPEDGYDGPQGGGYPPPGGARDIY  162 orf29.pep  SYYVKGTSTKTKTSIVPQAPFSDRWLEENAGAASG                           125
           ||::|||||||| : ||||||||||||||:||||||
orf29ng    SYHIKGTSTKTKINTVPQAPFSDRWLKENAGAASGFLSRADEAGKLIWENDPDKNWRANR  222
```

The complete length ORF29ng nucleotide sequence (SEQ ID NO: 169) is predicted to encode a protein having amino acid sequence (SEQ ID NO: 170):

```
  1    MNLPIQKFMM LFAAAISLLQ IPISHANGLD ARLRDDMQAK HYEPGGKYHL

51    FGNARGSVKN RVCAVQTFDA TAVGPILPIT HERTGFEGVI GYETHFSGHG

101    HEVHSPFDNH DSKSTSDFSG GVDGGFTVYQ LHRTGSEIHP EDGYDGPQGG

151    GYPPPGGARD IYSYHIKGTS TKTKINTVPQ APFSDRWLKE NAGAASGFLS

201    RADEAGKLIW ENDPDKNWRA NRMDDIRGIV QGAVNPFLTG FQGLGVGAIT

251    DSAVSPVTYA AARKTLQGIH NLGNLSPEAQ LAAATALQDS AFAVKDSINS

301    ARQWADAHPN ITATAQTALA VTEAATTVWG GKKVELNPAK WDWVKNTGYK

351    KPAARHMQTV DGEMAGGNKP LESKNTVTTN NFFENTGYTE KVLRQASNGD

401    YHGFPQSVDA FSENGTVIQI VGGDNIVRHK LYIPGSYKGK DGNFEYIREA

451    DGKINHRLFV PNQQLPEK*
```

In a second experiment, the following DNA sequence (SEQ ID NO: 171) was identified:

```
  1    atgAATTTGC CTATTCAAAA ATTCATGATG ctgttggcAg cggcaatatc 51    gatgctGCat ATCCCCATTA GTCATGCGAA CGGTTTGGAT GCCCGTTTGC

101    GCGATGATAT GCAGGCAAAA CACTACGAAC CGGGTGGCAA ATACCATCTG
```

-continued

```
 151    TTTGGTAATG CTCGCGGCAG TGTTAAAAAT CGGGTTTGCG CCGTCCAAAC
 201    ATTTGATGCA ACTGCGGTCG GCCCCATACT GCCTATTACA CACGAACGGA
 251    CAGGATTTGA AGGTGTTATC GGCTATGAAA CCCATTTTTC AGGACACGGA
 301    CACGAAGTAC ACAGTCCGTT CGATAATCAT GATTCAAAAA GCACTTCTGA
 351    TTTCAGCGGC GGCGTAGACG GCGGTTTTAC CGTTTACCAA CTTCATCGGA
 401    CAGGGTCGGA ATACATCCC GCAGACGGAT ATGACGGGCC TCAAGGCGGC
 451    GGTTATCCGG AACCACAAGG GGCAAGGGAT ATATACAGCT ACCATATCAA
 501    AGGAACTTCA ACCAAAACAA AGATAAACAC TGTTCCGCAA GCCCCTTTTT
 551    CAGACCGCTG GCTAAAAGAA AATGCCGGTG CCGCTTCCGG TTTTCTCAGC
 601    CGTGCGGATG AAGCAGGAAA ACTGATATGG GAAAACGACC CCGATAAAAA
 651    TTGGCGGGCT AACCGTATGG ATGATATTCG CGGCATCGTC CAAGGTGCGG
 701    TTAATCCTTT TTTAACGGGT TTTCAAGGGG TAGGGATTGG GGCAATTACA
 751    GACAGTGCGG TAAGCCCGGT CACAGATACA GCCGCTCAGC AGACTCTACA
 801    AGGTATTAAT GATTTAGGAA ATTTAAGTCC GGAAGCACAA CTTGCCGCCG
 851    CGAGCCTATT ACAGGACAGT GCCTTTGCGG TAAAAGACGG CATCAATTCC
 901    GCCAGACAAT GGGCTGATGC CCATCCGAAT ATAACAGCAA CAGCCCAAAC
 951    TGCCCTTGCC GTAGCAGAGG CCGCAGGTAC GGTTTGGCGC GGTAAAAAAG
1001    TAGAACTTAA CCCGACCAAA TGGGATTGGG TTAAAAATAC CGGCTATAAA
1051    AAACCTGCTG CCCGCCATAT GCAGACTGTA GATGGGGAGA TGGCAGGGGG
1101    GAATAGACCG CCTAAATCTA TAACGTCGGA AGGAAAAGCT AATGCTGCAA
1151    CCTATCCTAA GTTGGTTAAT CAGCTAAATG AGCAAAACTT AAATAACATT
1201    GCGGCTCAAG ATCCAAGATT GAGTCTAGCT ATTCATGAGG GTAAAAAAAA
1251    TTTTCCAATA GGAACTGCAA CTTATGAAGA GGCAGATAGA CTAGGTAAAA
1301    TTTGGGTTGG TGAGGGTGCA AGACAAACTA GTGGAGGCGG ATGGTTAAGT
1351    AGAGATGGCA CTCGACAATA TCGGCCACCA ACAGAAAAAA AATCACAATT
1401    TGCAACTACA GGTATTCAAG CAAATTTTGA AACTTATACT ATTGATTCAA
1451    ATGAAAAAAG AAATAAAATT AAAAATGGAC ATTTAAATAT TAGGTAA
```

This encodes a protein having amino acid sequence (SEQ ID NO: 172; ORF29ng-1):

```
  1    MNLPIQKFMM LLAAAISMLH IPISHANGLD ARLRDDMQAK HYEPGGKYHL
 51    FGNARGSVKN RVCAVQTFDA TAVGPILPIT HERTGFEGVI GYETHFSGHG
101    HEVHSPFDNH DSKSTSDFSG GVDGGFTVYQ LHRTGSEIHP ADGYDGPQGG
151    GYPEPQGARD IYSYHIKGTS TKTKINTVPQ APFSDRWLKE NAGAASGFLS
201    RADEAGKLIW ENDPDKNWRA NRMDDIRGIV QGAVNPFLTG FQGVGTGAIT
251    DSAVSPVTDT AAQQTLQGIN DLGNLSPEAQ LAAASLLQDS AFAVKDGINS
301    ARQWADAHPN ITATAQTALA VAEAAGTVWR GKKVELNPTK WDWVKNTGYK
351    KPAARAMQTV DGEMAGGNRP PKSITSEGKA NAATYPKLVN QLNEQNLNNI
401    AAQDPRLSLA IHEGKKNFPI GTATYEEADR LGKIWVGEGA RQTSGGGWLS
451    RDGTRQYRPP TEKKSQFATT GIQANFETYT IDSNEKRNKI KNGHLNIR*
```

ORF29ng-1 (SEQ ID NO: 172) and ORF29-1 (SEQ ID NO: 166) show 86.0% identity in 401 aa overlap:

```
                       10        20        30        40        50        60
orf29ng-1.pep  MNLPIQKFMMLLAAAISMLHIPISHANGLDARLRDDMQAKHYEPGGKYHLFGNARGSVKN
               ||||||||||:|||||:|:|||||||||||||||||||||||||||||||||||||||:
orf29-1        MNLPIQKFMMLFAAAISLLQIPISHANGLDARLRDDMQAKHYEPGGKYHLFGNARGSVKK
                       10        20        30        40        50        60

70        80        90       100       110       120
orf29ng-1.pep  RVCAVQTFDATAVGPILPITHERTGFEGVIGYETHFSGHGHEVHSPFDNHDSKSTSDFSG
               || |||||||||||:|:|||||||||||||||||||||||||||||:|||||||||||||
orf29-1        RVYAVQTFDATAVSPVLPITHERTGFEGVIGYETHFSGHGHEVHSPFDHHDSKSTSDFSG
                       70        80        90       100       110       120

130       140       150       160       170       180
orf29ng-1.pep  GVDGGFTVYQLHRTGSEIHPADGYDGPQGGGYPEPQGARDIYSYHIKGTSTKTKINTVPQ
               |||||||||||||||||||||:|||||||||: || | ||||||||::||||||||:|||
orf29-1        GVDGGFTVYQLHRTGSEIHPEDGYDGPQGSDYPPPGGARDIYSYYVKGTSTKTKTNIVPQ
                      130       140       150       160       170       180

190       200       210       220       230       240
orf29ng-1.pep  APFSDRWLKENAGAASGFLSRADEAGKLIWENDPDKNWRANRMDDIRGIVQGAVNPFLTG
               |||||||||||||||||:||||||||||||:||:|||||||:||||||||||||||| |
orf29-1        APFSDRWLKENAGAASGFFSRADEAGKLIWESDPNKNWWANRMDDVRGIVQGAVNPFLMG
                      190       200       210       220       230       240

250       260       270       280       290       300
orf29ng-1.pep  FQGVGIGAITDSAVSPVTDTAAQQTLQGINDLGNLSPEAQLAAASLLQDSAFAVKDGINS
               |||||||||||||||||||||||||||||||||:|||||||||||||||||||||||||
orf29-1        FQGVGIGAITDSAVSPVTDTAAQQTLQGINDLGKLSPEAQLAAASLLQDSAFAVKDGINS
                      250       260       270       280       290       300

310       320       330       340       350       360
orf29ng-1.pep  ARQWADAHPNITATAQTALAVAEAAGTVWRGKKVELNPTKWDWVKNTGYKKPAARHMQTV
               |:|||||||||||||||||::||||||||||||||||||||||||||||||||||||||:
orf29-1        AKQWADAHPNITATAQTALSAAEAAGTVWRGKKVELNPTKWDWVKNTGYKKPAARHMQTL
                      310       320       330       340       350       360

370       380       390       400       410      419
orf29ng-1.pep  DGEMAGGNRPPKSI-TSEGKANAATYPKLVNQLNEQNLNNIAAQDPRLSLAIHEGKKNFP
               ||||||||:|  ||: :|  ::     ::  |:  ::  :     :::::
orf29-1        DGEMAGGNKPIKSLPNSAAEKRKQNFEKFNSNWSSASFDSVHKTLTPNAPGILSPDKVKT
                      370       380       390       400       410       420

420       430       440       450       460       470      479
orf29ng-1.pep  IGTATYEEADRLGKIWVGEGARQTSGGGWLSRDGTRQYRPPTEKKSQFATTGIQANFETY orf29-1        RYTSLDGKITIIKDNENNYFRIHDNSRKQYLDSNGNAVKTGNLQGKQAKDYLQQQTHIRN
                       430       440       450       460       470       480
```

Based on this analysis, including the presence of a putative leader sequence in the gonococcal protein, it is predicted that the proteins from *N.meningitidis* and *N.gonorrhoeae*, and their epitopes, could be useful antigens for vaccines or diagnostics, or for raising antibodies.

Example 21

The following partial DNA sequence was identified in *N.meningitidis* (SEQ ID NO: 173):

```
  1  ATGAAAAAAC AAATCACCGC AGCCGTAATG ATGCTGTCTA TGATTGCCCC
 51  CGCAATGGCA AACGGCTTGG ACAATCAGGC ATTTGAAGAC CAAATGTTCC
101  ACACGCGGGC AGATGCACCG ATGCAG...
```

This corresponds to the amino acid sequence (SEQ ID NO: 174; ORF30):

Further work revealed the complete nucleotide sequence (SEQ ID NO: 175):

```
  1  ATGAAAAAAC AAATCACCGC AGCCGTAATG ATGCTGTCTA TGATTGCCCC
 51  CGCAATGGCA AACGGCTTGG ACAATCAGGC ATTTGAAGAC CAAGTGTTCC
```

```
                      -continued
101  ACACGCGGGC AGATGCACCG ATGCAGTTGG CGGAGCTTTC TCAAAAGGAG

151  ATGAAGGAGA CAGAGGGGGC GTTTCTTCCA TTGGCTATCT TGGGTGGTGC

201  TGCCATTGGT ATGTGGACAC AGCATGGTTT TAGTTATGCA ACGACAGGCA

251  GACCAGCTTC TGTTAGAGAT GTTGCTATTG CTGGCGGATT AGGCGCAATT

301  CCTGGTGGTG TAGGCGCCGC AGGAAAGGTT GTTTCCTTTG CTAAATATGG

351  ACGTGAGATT AAAATCGGCA ATAATATGCG GATAGCCCCT TTCGGTAATA

401  GAACAGGTCA TCCTATTGGA AAATTTCCCC ATTATCATCG TCGAGTTACG

451  GATAATACGG GCAAGACTTT GCCTGGACAG GGAATTGGTC GTCATCGCCC

501  TTGGGAATCA AAATCTACGG ACAGATCATG GAAAAACCGC TTCTAA
```

This corresponds to the amino acid sequence (SEQ ID NO: 176; ORF30-1):

```
  1  MKKQITAAVM MLSMIAPAMA NGLDNQAFED QVFHTRADAP MQLAELSQKE

51  MKETEGAFLP LAILGGAAIG MWTQHGFSYA TTGRPASVRD VAIAGGLGAI

101  PGGVGAAGKV VSFAKYGREI KIGNNMRIAP FGNRTGHPIG KFPHYHRRVT

151  DNTGKTLPGQ GIGRHRPWES KSTDRSWKNR F*
```

Computer analysis of this amino acid sequence gave the following results:
Homology with a Predicted ORF from *N.meningitidis* (Strain A)
ORF30 (SEQ ID NO: 174) shows 97.6% identity over a 42aa overlap with an ORF (ORF30a) (SEQ ID NO: 178) from strain A of *N. meningitidis*:

```
                    10        20        30        40
orf30.pep  MKKQITAAVMMLSMIAPAMANGLDNQAFEDQMFHTRADAPMQ
           |||||||||||||||||||||||||||||:|||||||||||
orf30a     MKKQITAAVMMLSMIAPAMANGLDNQAFEDQVFHTRADAPMQLAELSQKEMKXTXGAFLP
                    10        20        30        40        50        60 orf30a     LXILGGAAIGMWTQHGFSYATTGRPASVRDVAIAGGLGAIPGXVGAAGKVVSFAKYGREI
                    70        80        90       100       110       120
```

The complete length ORF30a nucleotide sequence (SEQ ID NO: 177) is:

```
1  MKKQITAAVM MLSMIAPAMA NGLDNQAFED QMFHTRADAP
   MQ..
```

This encodes a protein having amino acid sequence (SEQ El) NO: 178):

```
  1  MKKQITAAVM MLSMIAPAMA NGLDNQAFED QVFHTRADAP MQLAELSQKE

51  MKXTXGAFLP LXILGGAAIG MWTQHGFSYA TTGRPASVRD VAIAGGLGAI

101  PGXVGAAGKV VSFAKYGREI KIGNNMRIAP FGNRTGHPIG KFPHYHRRVT

151  DNTGKTLPGQ GIGRHRPWES KSTDRSWKNR F*
```

ORF30a (SEQ HD NO: 178) and ORF30-1 (SEQ ID NO: 176) show 97.8% identity in 181 aa overlap:

```
orf30a.pep  MKKQITAAVMMLSMIAPAMANGLDNQAFEDQVFHTRADAPMQLAELSQKEMKXTXGAFLP   60
            |||||||||||||||||||||||||||||||||||||||||||||||||| | |||||
orf30-1     MKKQITAAVMMLSMIAPAMANGLDNQAFEDQVFHTRADAPMQLAELSQKEMKETEGAFLP   60
```

```
                                  -continued
orf30a.pep   LXILGGAAIGMWTQHGFSYATTGRPASVRDVAIAGGLGAIPGXVGAAGKVVSFAKYGREI   120
             | |||||||||||||||||||||||||||||||||||| |||||||||||||||||||||
orf30-1      LAILGGAAIGMWTQHGFSYATTGRPASVRDVAIAGGLGAIPGGVGAAGKVVSFAKYGREI   120 orf30a.pep   KIGNNMRIAPFGNRTGHPIGKFPHYHRRVTDNTGKTLPGQGIGRHRPWESKSTDRSWKNR   180
             ||||||||||||||||||||||||||||||||||||||||||||||||||||||||||||
orf30-1      KIGNNMRIAPFGNRTGHPIGKFPHYHRRVTDNTGKTLPGQGIGRHRPWESKSTDRSWKNR   180 orf30a.pep   FX
             ||
orf30-1      FX
```

Homology with a Predicted ORF from *N. gonorrhoeae*

ORF30 (SEQ ID NO: 174) shows 97.6% identity over a 42aa overlap with a predicted ORF (ORF30.ng) (SEQ ID NO: 180) from *N. gonorrhoeae*:

```
orf30.pep   MKKQITAAVMMLSMIAPAMANGLDNQAFEDQMFHTRADAPMQ                     42
            |||||||||||||||||||||||||||||||||:||||||||
orf30ng     MKKQITAAVMMLSMIAPAMANGLDNQAFEDQVFHTRADAPMQLAELSQKEMKETEGAFLP   60
```

The complete length ORF30ng nucleotide sequence (SEQ ID NO: 179) is

```
  1  ATGAAAAAAC AAATCACCGC AGCCGTAATG ATGCTGTCTA TGATCGCCCC

51  CGCAATGGCA AACGGATTGG ACAATCAGGC ATTTGAAGAC CAAGTGTTCC

101  ACACGCGGGC AGATGCGCCG ATGCAGTTGG CGGAGCTTTC TCAGAAGGAG

151  ATGAAGGAGA CTGAAGGGGC TTTTCTTCCA TTGGCTATCT TGGGTGGTGC

201  TGCCATTGGT ATGTGGACAC AGCATGGTTT TAGTTATGCA ACGACAGGCA

251  GACCAGCTTC TGTTAGAGAT GTTGCTGGCG GATTAGGCGC AATTCCTGGT

301  GATGTAGGTG CTGCAGGAAA GGTTGTTTCC TTTGCTAAAT ATGGACGTGA

351  GATTAAAATC GGCAATAATA TGCGGATAGC CCCTTTCGGT AATAGAACAG

401  GTCATCCTAT TGGAAAATTT CCCCATTATC ATCGTCGAGT TACGGATAAT

451  ACGGGCAAGA CTTTGCCTGG ACAGGGAATT GGTCGTCATC GCCCTTGGGA

501  ATCAAAATCT ACGGACAGAT CATGGAAAAA CCGCTTCTAA
```

This encodes a protein having amino acid sequence (SEQ ID NO: 180):

```
  1  MKKQITAAVM MLSMIAPAMA NGLDNQAFED QVFHTRADAP MQLAELSQKE

51  MKETEGAFLP LAILGGAAIG MWTQHGFSYA TTGRPASVRD VAGGLGAIPG

101  DVGAAGKVVS FAKYGREIKI GNNMRIAPFG NRTGHPIGKF PHYHRRVTDN

151  TGKTLPGQGI GRHRPWESKS TDRSWKNRF*
```

ORF30ng (SEQ ID NO: 180) and ORF30-1 (SEQ ID NO: 176) show 98.3% identity in 181 aa overlap:

```
                   10         20         30         40         50         60
orf30ng.pep   MKKQITAAVMMLSMIAPAMANGLDNQAFEDQVFHTRADAPMQLAELSQKEMKETEGAFLP
              ||||||||||||||||||||||||||||||||||||||||||||||||||||||||||||
orf30-1       MKKQITAAVMMLSMIAPAMANGLDNQAFEDQVFHTRADAPMQLAELSQKEMKETEGAFLP
                   10         20         30         40         50         60
```

```
                    -continued
                   70        80        90       100       110
orf30ng.pep  LAILGGAAIGMWTQHGFSYATTGRPASVRDVA--GGLGAIPGDVGAAGKVVSFAKYGREI
             |||||||||||||||||||||||||||||||  ||||||||| |||||||||||||||||
orf30-1      LAILGGAAIGMWTQHGFSYATTGRPASVRDVAIAGGLGAIPGGVGAAGKVVSFAKYGREI
                   70        80        90       100       110       120

120       130       140       150       160       170
orf30ng.pep KIGNNMRIAPFGNRTGHPIGKFPHYHRRVTDNTGKTLPGQGIGRHRPWESKSTDRSWKNR
            ||||||||||||||||||||||||||||||||||||||||||||||||||||||||||||
orf30-1     KIGNNMRIAPFGNRTGHPIGKFPHYHRRVTDNTGKTLPGQGIGRHRPWESKSTDRSWKNR
                  130       140       150       160       170       180
            180
orf30ng.pep FX
            ||
orf30-1     FX
```

Based on this analysis, including the presence of a putative leader sequence in the gonococcal protein, it is predicted that the proteins from N.meningitidis and N.gonorrhoeae, and their epitopes, could be useful antigens for vaccines or diagnostics, or for raising antibodies.

Example 22

The following partial DNA sequence was identified in N.meningitidis (SEQ ID NO: 181):

```
  1  ATGAATAAAA CTCTCTATCG TGTAATTTTC AACCGCAAAC GTGGGGCTGT

51  GrTAGCCGTT GCTGAAACTA CCAAGCGCGA AGGTAAAAGC TGTGCCGATA

101  GTGATTCAGG CAGCGCTCAT GTGAAATCTG TTCCTTTTGG TACTACTCAT

151  GCACCTGTTT GTg.CGTTaC AAATATCTTT TCTTTTTCTT TATTGGGCTT

201  TTCTTTATGT TTGGCTGTAG GtacGGyCAA TATTGCTTTT GCTGATGGCA

251  TT..
```

This corresponds to the amino acid sequence (SEQ ID NO: 182; ORE31):

```
  1  MNKTLYRVIF NRKRGAVXAV AETTKREGKS CADSDSGSAH VKSVPFGTTH

51  APVCXVTNIF SFSLLGFSLC LAVGTXNIAF ADGI..
```

Further work revealed a further partial nucleotide sequence (SEQ ID NO: 183):

```
  1  ATGAATAAAA CTCTCTATCG TGTAATTTTC AACCGCAAAC GTGGGGCTGT

51  GGTAGCCGTT GCTGAAACTA CCAAGCGCGA AGGTAAAAGC TGTGCCGATA

101  GTGATTCAGG CAGCGCTCAT GTGAAATCTG TTCCTTTTGG TACTACTCAT

151  GCACCTGTTT GTCGTTCAAA TATCTTTTCT TTTCTTTAT TGGGCTTTTC

201  TTTATGTTTG GCTGTAGGTA CGGCCAATAT TGCTTTTGCT GATGGCATT..
```

This corresponds to the amino acid sequence (SEQ ID NO: 184; ORF31-1):

```
  1  MNKTLYRVIF NRKRGAVVAV AETTKREGKS CADSDSGSAH VKSVPFGTTH

51  APVCRSNIFS FSLLGFSLCL AVGTANIAFA DGI..
```

Computer analysis of this amino acid sequence gave the following results:

Homology with a Predicted ORF from *N.gonorrhoeae*

ORF31 (SEQ ID NO: 182) shows 76.2% identity over a 84aa overlap with a predicted ORF (ORF31.ng) (SEQ ID NO: 186) from *N. gonorrhoeae*:

```
orf31.pep  MNKTLYRVIFNRKRGAVXAVAETTKREGKSCADSDSGSAHVKSVPFGTTHAPVCXVTNIF   60
           |||||||||||||||||| |||||||||||||||||| |::|||| | ||      ::  |
orf31ng    MNKTLYRVIFNRKRGAVVAVAETTKREGKSCADSGSGSVYVKSVSFIPTH------SKAF   54 orf31.pep  SFSLLGFSLCLAVGTXNIAFADGI                                       84
           || ||||||||:|| ||||||||
orf31ng    CFSALGFSLCLALGTVNIAFADGIITDKAAPKTQQATILQTGNGIPQVNIQTPTSAGVSV  114
```

The complete length ORF31ng nucleotide sequence (SEQ ID NO: 185) is:

```
  1  ATGAACAAAA CCCTCTATCG TGTGATTTTC AACCGCAAAC GCGGTGCTGT
 51  GGTAGCTGTT GCCGAAACCA CCAAGCGCGA AGGTAAAAGC TGTGCCGATA
101  GTGGTTCGGG CAGCGTTTAT GTGAAATCCG TTTCTTTCAT TCCTACTCAT
151  TCCAAAGCCT TTTGTTTTTC TGCATTAGGC TTTTCTTTAT GTTTGGCTTT
201  GGGTACGGTC AATATTGCTT TTGCTGACGG CATTATTACT GATAAAGCTG
251  CTCCTAAAAC CCAACAAGCC ACGATTCTGC AAACAGGTaa cGGCATACCG
301  CAAGTCAATA TTCAAACCCC TACTTCGGCA GGGGTTTCTG TTAATCAATA
351  TGCCCAGTTT GATGTGGGTA ATCGCGGGGC GATTTTAAAC AACAGTCGCA
401  GCAACACCCA AACACAGCTA GGCGGTTGGA TTCAAGGCAA TCCTTGGTTG
451  ACAAGGGGCG AAGCACGTGT GGTTGTAAAC CAAATCAACA GCAGCCATCC
501  TTCACAACTG AATGGCTATA TTGAAGTGGG TGGACGACGT GCAGAAGTCG
551  TTATTGCCAA TCCGGCAGGG ATTGCAGTCA ATGGTGGTGG TTTTATCAAT
601  GCTTCCCGTG CCACTTTGAC GACAGGCCAA CCGCAATATC AAGCAGGAGA
651  CTTTAGCGGC TTTAAGATAA GGCAAGGCAA TGCTGTAATC GCCGGACACG
701  GTTTGGATGC CCGTGATACC GATTTCACAC GTATTCTTGT ATGCCAACAA
751  AATCACCTTG ATCAGTACGG CCGAACAAGC AGGCATTCGT AA
```

This encodes a protein having amino acid sequence (SEQ ID NO: 186):

```
  1  MNKTLYRVIF NRKRGAVVAV AETTKREGKS CADSGSGSVY VKSVSFIPTH
 51  SKAFCFSALG FSLCLALGTV NIAFADGIIT DKAAPKTQQA TILQTGNGIP
101  QVNIQTPTSA GVSVNQYAQF DVGNRGAILN NSRSNTQTQL GGWIQGNPWL
151  TRGEARVVVN QINSSHPSQL NGYIEVGGRR AEVVIANPAG IAVNGGGFIN
201  ASRATLTTGQ PQYQAGDFSG FKIRQGNAVI AGHGLDARDT DFTRILVCQQ
251  NHLDQYGRTS RHS*
```

This gonococcal protein shares 50% identity over a 149aa overlap with the pore-forming hemolysins-like HecA protein (SEQ ID NO: 1125) from *Erwinia chrysanthemi* (accession number L39897):

```
orf31ng  96 GNGIPQVNIQTPTSAGVSVNQYAQFDVGNRGAILNNSRSN-TQTQLGGWIQGNPWLTRGE  154
            GNP+P VNI TP ++G+S N+Y  F+V NRG ILNN  +  T  +QLGG IQ NP L
HecA     45 GNGVPVVNIATPDASGLSHNRYHDFNVDNRGLILNNGTARLTPSQLGGLIQNNPNLNGRA  104
```

```
                        -continued
Orf31ng    155 ARVVVNQINSSHPSQLNGYIEVGGRRAEVVIANPAGIAVNGGGFINASRATLTTGQPQYQ    214
                A  ++N++  S  +  S+L GY+EV G+ A VV+ANP GI   +G GF+N   R TLTTG PQ+
HecA       105 AAAILNEVVSPNRSRLAGYLEVAGQAANVVVANPYGITCSGCGFLNTPRLTLTTGTPQFD    164

Orf31ng    215 -AGDFSGFKIRQGNAVIAGHGLDARDTDF                                  242
                 AG  SG  +R G+ +I G GLDA   +D+
HecA       165 AAGGLSGLDVRGGDILIDGAGLDASRSDY                                  193
```

Furthermore, ORF31ng (SEQ ID NO: 186) and ORF31-1 (SEQ ID NO: 184) show 79.5% identity in 83 aa overlap:

```
                     10         20         30         40         50         60
orf31-1.pep MNKTLYRVIFNRKRGAVVAVAETTKREGKSCADSDSGSAHVKSVPFGTTHAPVCRSNIFS
            ||||||||||||||||||||||||||||||||| |||::|||| |  ||     |: |
orf31ng     MNKTLYRVIFNRKRGAVVAVAETTKREGKSCADSGSGSVYVKSVSFIPTH-----SKAFC
                     10         20         30         40         50

70         80
orf31-1.pep FSLLGFSLCLAVGTANIAFADGI
            || ||||||||:||:||||||||
orf31ng     FSALGFSLCLALGTVNIAFADGIITDKAAPKTQQATILQTGNGIPQVNIQTPTSAGVSVN
                     60         70         80         90         100        110
```

On this basis, including the homology with hemolysins, and also with adhesins, it is predicted that the proteins from *N.meningitidis* and *N.gonorrhoeae*, and their epitopes, could be useful antigens for vaccines or diagnostics, or for raising antibodies.

Example 23

The following partial DNA sequence was identified in *N.meningitidis* (SEQ ID NO: 187):

```
  1  ATGAATACTC CTCCTTTTGT CTGTTGGATT TTTTGCAAGG TCATCGACAA
 51  TTTCGGCGAC ATCGGCGTTT CGTGGCGGCT CGCCCGTGTT TTGCACCGCG
101  AACTCGGTTG GCAGGTGCAT TTGTGGACGG ACGATGTGTC CGCCTTGCGT
151  GCGCTTTGCC CTGATTTGCC CGATGTTCCC TGCGTTCATC AGGATATTCA
201  TGTCCGCACT TGGCATTCCG ATGCGGCAGA TATTGATACC GCG..
 40
```

This corresponds to the amino acid sequence (SEQ ID NO: 188; ORF32):

```
  1  MNTPPFVCWI FCKVIDNFGD IGVSWRLARV LHRELGWQVH LWTDDVSALR
 51  ALCPDLPDVP CVHQDIHVRT WHSDAADIDT A..
```

Further work revealed the complete nucleotide sequence (SEQ ID NO: 189):

```
  1  ATGAATACTC CTCCTTTTGT CTGTTGGATT TTTTGCAAGG TCATCGACAA
 51  TTTCGGCGAC ATCGGCGTTT CGTGGCGGCT CGCCCGTGTT TTGCACCGCG
101  AACTCGGTTG GCAGGTGCAT TTGTGGACGG ACGATGTGTC CGCCTTGCGT
151  GCGCTTTGCC CTGATTTGCC CGATGTTCCC TGCGTTCATC AGGATATTCA
201  TGTCCGCACT TGGCATTCCG ATGCGGCAGA TATTGATACC GCGCCTGTTC
251  CCGATGTCGT CATCGAAACT TTTGCCTGCG ACCTGCCCGA AAATGTGCTG
301  CACATTATCC GCCGACACAA GCCGCTTTGG CTGAATTGGG AATATTTGAG
351  CGCGGAGGAA AGCAATGAAA GGCTGCATCT GATGCCTTCG CCGCAGGAGG
```

-continued

```
 401  GTGTTCAAAA ATATTTTTGG TTTATGGGTT TCAGCGAAAA AAGCGGCGGG
 451  TTGATACGCG AACGTGATTA CTGCGAAGCC GTCCGTTTCG ATACTGAAGC
 501  CCTGCGAGAG CGGCTGATGC TGCCCGAAAA AAACGCCTCC GAATGGCTGC
 551  TTTTCGGCTA TCGGAGCGAT GTTTGGGCAA AGTGGCTGGA AATGTGGCGA
 601  CAGGCAGGCA GCCCGATGAC ACTGTTGCTG GCGGGACGC AAATCATCGA
 651  CAGCCTCAAA CAAAGCGGCG TTATTCCGCA AGATGCCCTG CAAAACGACG
 701  GCGATGTTTT TCAGACGGCA TCCGTCCGCC TCGTCAAAAT CCCTTTCGTG
 751  CCGCAACAGG ACTTCGACCA ACTGCTGCAC CTTGCCGACT GCGCCGTCAT
 801  CCGCGGCGAA GACAGTTTCG TGCGCGCCCA GCTTGCGGGC AAACCCTTCT
 851  TTTGGCACAT CTACCCGCAA GACGAGAATG TCCATCTCGA CAAACTCCAC
 901  GCCTTTTGGG ATAAGGCACA CGGTTTCTAC ACGCCCGAAA CCGTGTCGGC
 951  ACACCGCCGT CTTTCGGACG ACCTCAACGG CGGAGAGGCT TTATCCGCAA
1001  CACAACGCCT CGAATGTTGG CAAACCCTGC AACAACATCA AAACGGCTGG
1051  CGGCAAGGCG CGGAGGATTG GAGCCGTTAT CTTTTCGGGC AGCCGTCAGC
1101  TCCTGAAAAA CTCGCTGCCT TTGTTTCAAA GCATCAAAAA ATACGCTAG
```

This corresponds to the amino acid sequence (SEQ ID NO: 190; ORF32-1):

```
  1  MNTPPFVCWI FCKVIDNFGD IGVSWRLARV LHRELGWQVH LWTDDVSALR
 51  ALCPDLPDVP CVHQDIHVRT WHSDAADIDT APVPDVVIET FACDLPENVL
101  HIIRRHKPLW LNWEYLSAEE SNERLHLMPS PQEGVQKYFW FMGFSEKSGG
151  LIRERDYCEA VRFDTEALRE RLMLPEKNAS EWLLFGYRSD VWAKWLEMWR
201  QAGSPMTLLL AGTQIIDSLK QSGVIPQDAL QNDGDVFQTA SVRLVKIPFV
251  PQQDFDQLLH LADCAVIRGE DSFVRAQLAG KPFFWHIYPQ DENVHLDKLH
301  AFWDKAHGFY TPETVSAHRR LSDDLNGGEA LSATQRLECW QTLQQHQNGW
351  RQGAEDWSRY LFGQPSAPEK LAAFVSKHQK IR*w
```

Computer analysis of this amino acid sequence gave the following results:
Homology with a Predicted ORF from *N.meningitidis* (Strain A)

ORF32 (SEQ ID NO: 188) shows 93.8% identity over a 81aa overlap with an ORF (ORF32a) (SEQ ID NO: 192) from strain A of *N. meningitidis*:

```
                    10         20         30         40         50         60
orf32.pep  MNTPPFVCWIFCKVIDNFGDIGVSWRLARVLHRELGWQVHLWTDDVSALRALCPDLPDVP
           ||||||  ||||||||||||||||||||||||||||||||||||||||||||||||||||
orf32a     MNTPPFSAGXFCKVIDNFGDIGVSWRLARVLHRELGWQVHLWTDDVSALRALCPDLPDVX
                    10         20         30         40         50         60

70         80
orf32.pep  CVHQDIHVRTWHSDAADIDTA
           |||||||||||||||||||||
orf32a     CVHQDIHVRTWHSDAADIDTAPVXDVVIETFACDLPENVLHIIRRHKPLWLXWEYLSAEX
                    70         80         90        100        110        120
```

The complete length ORF32a nucleotide sequence (SEQ ID NO: 191) is:

```
   1  ATGAATACTC CTCCTTTTTC TGCTGGANTT TTTTGCAAGG TCATCGACAA
  51  TTTCGGCGAC ATCGGCGTTT CGTGGCGGCT TGCCCGTGTT TTGCACCGCG
 101  AACTCGGTTG GCAGGTGCAT TTGTGGACGG ACGATGTGTC CGCCTTGCGT
 151  GCGCTTTGCC CTGATTTGCC CGATGTTCNC TGCGTTCATC AGGATATTCA
 201  TGTCCGCACT TGGCATTCCG ATGCGGCAGA TATTGATACC GCGCCTGTTC
 251  NCGATGTCGT CATCGAAACT TTTGCCTGCG ACCTGCCCGA AAATGTGCTG
 301  CACATCATCC GCCGACACAA GCCGCTTTGG CTGAANTGGG AATATTTGAG
 351  CGCGGAGGAN AGCAATGAAA GGCTGCACNT GATGCCTTCG CCGCAGGAGA
 401  GTGTTCNAAA ATANTTTTGG TTTATGGGTT TCAGCGAANN NAGCGGCGGA
 451  CTGATACGCG AACGCGATTA CTGCGAAGCC GTCCGTTTCG ATAGCGGAGC
 501  CTTGCGCAAG AGGCTGATGC TTCCCGAAAA AAACGNCCCC GAATGGCTGC
 551  TTTTCGGCTA TCGGAGCGAT GTTTGGGCAA AGTGGCTGGA AATGTGGCGA
 601  CAGGCAGGCA GTCCGTTGAC ACTTTTGCTG GCNGGGGCGC ANATTATCGA
 651  CAGCCTCAAA CAAAACGGCG TTATTCCGCA AGATGCCCTG CAAAACGACG
 701  GCGATGTTTT TCAGACGGCA TCCGTCCGCC TCGTCAAAAT CCCTTTCGTG
 751  CCGCAACAGG ACTTCGACAA ACTGCTGCAC CTTGCCGACT GCGCCGTCAT
 801  CCGCGGCGAA GACAGTTTCG TGCGCGCCCA GCTTGCGGGC AAACCCTTCT
 851  TTTGGCACAT CTACCCGCAA GATGAGAATG TCCATCTCGA CAAACTCCAC
 901  GCCTTTTGGG ATAAGGCACA CGGTTTCTAC ACGCCCGAAA CCGCATCGGC
 951  ACACCGCCGC CTTTCAGACG ACCTCAACGG CGGAGAGGCT TTATCCGCAA
1001  CACAACGCCT CGAATGTTGG CAAATCCTGC AACAACATCA AAACGGCTGG
1051  CGGCAAGGCG CGGAGGATTG GAGCCGTTAT CTTTTTGGGC AGCCTTCCGC
1101  ATCCGAAAAA CTCGCCGCCT TTGTTTCAAA GCATCAAAAA ATACGCTAG
```

This encodes a protein having amino acid sequence (SEQ ID NO: 192):

```
  1  MNTPPFSAGX FCKVIDNFGD IGVSWRLARV LHRELGWQVH LWTDDVSALR
 51  ALCPDLPDVX CVHQDIHVRT WHSDAADIDT APVXDVVIET FACDLPENVL
101  HIIRRHKPLW LXWEYLSAEX SNERLHXMPS PQESVXKXFW FMGFSEXSGG
151  LIRERDYCEA VRFDSGALRK RLMLPEKNXP EWLLFGYRSD VWAKWLEMWR
201  QAGSPLTLLL AGAXIIDSLK QNGVIPQDAL QNDGDVFQTA SVRLVKIPFV
251  PQQDFDKLLH LADCAVIRGE DSFVRAQLAG KPFFWHIYPQ DENVHLDKLH
301  AFWDKAHGFY TPETASAHRR LSDDLNGGEA LSATQRLECW QILQQHQNGW
351  RQGAEDWSRY LFGQPSASEK LAAFVSKHQK IR*
```

ORF32a (SEQ ID NO: 192) and ORF32-1 (SEQ ID NO: 190) show 93.2% identity in 382 aa overlap:

```
                    10        20        30        40        50        60
orf32-1.pep MNTPPFVCWIFCKVIDNFGDIGVSWRLARVLHRELGWQVHLWTDDVSALRALCPDLPDVP
            ||||||    ||||||||||||||||||||||||||||||||||||||||||||||||||
orf32a      MNTPPFSAGXFCKVIDNFGDIGVSWRLARVLHRELGWQVHLWTDDVSALRALCPDLPDVX
                    10        20        30        40        50        60
```

```
                    70        80        90       100       110       120
orf32-1.pep CVHQDIHVRTWHSDAADIDTAPVPDVVIETFACDLPENVLHIIRRHKPLWLNWEYLSAEE
            ||||||||||||||||||||||||| |||||||||||||||||||||||||| ||||||
orf32a      CVHQDIHVRTWHSDAADIDTAPVXDVVIETFACDLPENVLHIIRRHKPLWLXWEYLSAEX
                    70        80        90       100       110       120

130       140       150       160       170       180
orf32-1.pep SNERLHLMPSPQEGVQKYFWFMGFSEKSGGLIRERDYCEAVRFDTEALRERLMLPEKNAS
            ||||||  ||||||| :| |  ||||||| |||||||||||||||| : ||| :|||||
orf32a      SNERLHXMPSPQESVXKXFWFMGFSEXSGGLIRERDYCEAVRFDSGALRKRLMLPEKNXP
                   130       140       150       160       170       180

190       200       210       220       230       240
orf32-1.pep EWLLFGYRSDVWAKWLEMWRQAGSPMTLLLAGTQIIDSLKQSGVIPQDALQNDGDVFQTA
            |||||||||||||||||||||||| ||||| |||||| ||||||:|||||||||||||||
orf32a      EWLLFGYRSDVWAKWLEMWRQAGSPLTLLLAGAXIIDSLKQNGVIPQDALQNDGDVFQTA
                   190       200       210       220       230       240

250       260       270       280       290       300
orf32-1.pep SVRLVKIPFVPQQDFDQLLHLADCAVIRGEDSFVRAQLAGKPFFWHIYPQDENVHLDKLH
            ||||||||||||||||:|||||||||||||||||||||||||||||||||||||||||||
orf32a      SVRLVKIPFVPQQDFDKLLHLADCAVIRGEDSFVRAQLAGKPFFWHIYPQDENVHLDKLH
                   250       260       270       280       290       300

310       320       330       340       350       360
orf32-1.pep AFWDKAHGFYTPETVSAHRRLSDDLNGGEALSATQRLECWQTLQQHQNGWRQGAEDWSRY
            ||||||||||||||:|||||||||||||||||||||||||||| |||||||||||||||
orf32a      AFWDKAHGFYTPETASAHRRLSDDLNGGEALSATQRLECWQILQQHQNGWRQGAEDWSRY
                   310       320       330       340       350       360

370       380
orf32-1.pep LFGQPSAPEKLAAFVSKHQKIRX
            ||||||| |||||||||||||||
orf32a      LFGQPSASEKLAAFVSKHQKIRX
                   370       380
```

Homology with a Predicted ORF from *N.gonorrhoeae*

ORF32 (SEQ D NO: 188) shows 95.1% identity over a 82aa overlap with a predicted ORF (ORF32.ng) (SEQ ID NO: 194) from *N. gonorrhoeae*:

```
orf32.pep   MNTPPF-VCWIFCKVIDNFGDIGVSWRLARVLHRELGWQVHLWTDDVSALRALCPDLP    57
            |||  | ||||||||||||||||||||||||||||||||||||||||||||||||||
orf32ng     MVMNTYAFPVCWIFCKVIDNFGDIGVSWRLARVLHRELGWQVHLWTDDVSALRALCPDLP   60 orf32.pep   DVPCVHQDIHVRTWHSDAADIDTA                                      81
            ||| ||||||||||||||||||||
orf32ng     DVPFVHQDIHVRTWHSDAADIDTAPVPDAVIETFACDLPENVLNIIRRHKPLWLNWEYLS  120
```

An ORF32ng nucleotide sequence (SEQ ID NO: 193) was predicted to encode a protein having amino acid sequence (SEQ ID NO: 194):

```
  1  MVMNTYAFPV CWIFCKVIDN FGDIGVSWRL ARVLHRELGW QVHLWTDDVS

51  ALRALCPDLP DVPFVHQDIH VRTWHSDAAD IDTAPVPDAV IETFACDLPE

101  NVLNIIRRHK PLWLNWEYLS AEESNERLHL MPSPQEGVQK YFWFMGFSEK

151  SGGLIRERDY REAVRFDTEA LRRRLVLPEK NAPEWLLFGY RGDVWAKWLD

201  MWQQAGSLMT LLLAGAQIID SLKQSGVIPQ NALQNEGGVF QTASVRLVKI

251  PFVPQQDFDK LLHLADCAVI RGEDSFVRTQ LAGKPFFWHI YPQDENVHLD

301  KLHAFWDKAY GFYTPETASV HRLLSDDLNG GEALSATQRL ECGVL*
```

Further sequencing revealed the following DNA sequence (SEQ ID NO: 195):

```
   1  ATGAATACAT ACGCTTTTCC TGTCTGTTGG ATTTTTTGCA AGGTCATCGA
  51  CAATTTCGGC GACATCGGCG TTTCGTGGCG GCTCGCCCGT GTTTTGCACC
 101  GCGAACTCGG TTGGCAGGTG CATTTGTGGA CGGACGACGT GTCCGCCTTG
 151  CGCGCGCTTT GTCCCGATTT GCCCGATGTT CCCTTCGTTC ATCAGGATAT
 201  TCATGTCCGC ACTTGGCATT CCGATGCGGC AGACATTGAT ACCGCGCCCG
 251  TTCCCGATGC CGTTATCGAA ACTTTTGCCT GCGACCTGCC CGAAAATGTG
 301  CTGAACATCA TCCGCCGACA CAAACCGCTT TGGCTGAATT GGGAATATTT
 351  GAGCGCGGAG GAAAGCAATG AAAGGCTGCA CCTGATGCCT TCGCCGCAGG
 401  AGGGCGTTCA AAAATATTTT TGGTTTATGG GTTTCAGCGA AAAAAGCGGC
 451  GGGTTGATAC GCGAACGCGA TTACCGCGAA GCCGTCCGTT TCGATACCGA
 501  AGCCCTGCGC CGGCGGCTGG TGCTGCCCGA AAAAAACGCC CCCGAATGGC
 551  TGCTTTTCGG CTATCGGGGC GATGTTTGGG CAAAGTGGCT GGACATGTGG
 601  CAACAGGCAG GCAGCCTGAT GACCCTACTG CTGGCGGGGG CGCAAATTAT
 651  CGACAGCCTC AAACAAAGCG GCGTTATTCC GCAAAACGCC CTGCAAAAtg
 701  aaggcgGTGT CTTTCagacG gcatccgTcC gccttGTCAA AAtcCCGTTC
 751  GTGCcGCAAC AGGAcTTCGA CAAATTGCTG CAcctcgcCG ACTGCGCCGT
 801  GATACGCGGC GAAGACAGTT TCGTGCGTAC CCAGCTTGCC GGAAAACCCT
 851  TTTTTTGGCA CATCTACCCG CAAGACGAGA ATGTCCATCT CGACAAACTC
 901  CACGCCTTTT GGGATAAGGC ATACGGCTTC TACACGCCCG AAACCGCATC
 951  GGTGCACCGC CTCCTTTCGG ACGACCTCAA CGGCGGAGAG GCTTTATCCG
1001  CAACACAACG CCTCGAATGT TGGCAAACCC TGCAACAACA TCAAAACGGC
1051  TGGCGGCAAG GCGCGGAGGA TTGGAGCCGT TATCTTTTCG GGCAGCCTTC
1101  CGCATCCGAA AAACTCGCCG CCTTTGTTTC AAAGCATCAA AAAATACGCT
1151  AG
```

This encodes a protein having amino acid sequence (SEQ ID NO: 196; ORF32ng-1):

```
   1  MNTYAFPVCW IFCKVIDNFG DIGVSWRLAR VLHRELGWQV HLWTDDVSAL
  51  RALCPDLPDV PFVHQDIHVR TWHSDAADID TAPVPDAVIE TFACDLPENV
 101  LNIIRRHKPL WLNWEYLSAE ESNERLHLMP SPQEGVQKYF WFMGFSEKSG
 151  GLIRERDYRE AVRFDTEALR RRLVLPEKNA PEWLLFGYRG DVWAKWLDMW
 201  QQAGSLMTLL LAGAQIIDSL KQSGVIPQNA LQNEGGVFQT ASVRLVKIPF
 251  VPQQDFDKLL HLADCAVIRG EDSFVRTQLA GKPFFWHIYP QDENVHLDKL
 301  HAFWDKAYGF YTPETASVHR LLSDDLNGGE ALSATQRLEC WQTLQQHQNG
 351  WRQGAEDWSR YLFGQPSASE KLAAFVSKHQ KIR*
```

ORF32ng-1 (SEQ ID NO: 196) and ORF32-1 (SEQ ID NO: 190) show 93.5% identity in 383 aa overlap:

```
                       10        20        30        40        50      59
orf32-1.pep    MNTPPF-VCWIFCKVIDNFGDIGVSWRLARVLHRELGWQVHLWTDDVSALRALCPDLPDV
               ||| | ||||||||||||||||||||||||||||||||||||||||||||||||||||
orf32ng-1      MNTYAFPVCWIFCKVIDNFGDIGVSWRLARVLHRELGWQVHLWTDDVSALRALCPDLPDV
                       10        20        30        40        50        60

60        70        80        90       100       110      119
orf32-1.pep    PCVHQDIHVRTWHSDAADIDTAPVPDVVIETFACDLPENVLHIIRRHKPLWLNWEYLSAE
                |||||||||||||||||||||||||||:|||||||||||||:||||||||||||||||
orf32ng-1      PFVHQDIHVRTWHSDAADIDTAPVPDAVIETFACDLPENVLNIIRRHKPLWLNWEYLSAE
                       70        80        90       100       110       120

120       130       140       150       160       170      179
orf32-1.pep    ESNERLHLMPSPQEGVQKYFWFMGFSEKSGGLIRERDYCEAVRFDTEALRERLMLPEKNA
               |||||||||||||||||||||||||||||||||||||:||||||||||:||:||||||
orf32ng-1      ESNERLHLMPSPQEGVQKYFWFMGFSEKSGGLIRERDYREAVRFDTEALRRRLVLPEKNA
                      130       140       150       160       170       180

180       190       200       210       220       230      239
orf32-1.pep    SEWLLFGYRSDVWAKWLEMWRQAGSPMTLLLAGTQIIDSLKQSGVIPQDALQNDGDVFQT
               |||||||:|||||||:||:|||| ||||||:||||||||||||||||:||||:| ||||
orf32ng-1      PEWLLFGYRGDVWAKWLDMWQQAGSLMTLLLAGAQIIDSLKQSGVIPQNALQNEGGVFQT
                      190       200       210       220       230       240

240       250       260       270       280       290      299
orf32-1.pep    ASVRLVKIPFVPQQDFDQLLHLADCAVIRGEDSFVRAQLAGKPFFWHIYPQDENVHLDKL
               |||||||||||||||||:||||||||||||||||||:|||||||||||||||||||||||
orf32ng-1      ASVRLVKIPFVPQQDFDKLLHLADCAVIRGEDSFVRTQLAGKPFFWHIYPQDENVHLDKL
                      250       260       270       280       290       300

300       310       320       330       340       350      359
orf32-1.pep    HAFWDKAHGFYTPETVSAHRRLSDDLNGGEALSATQRLECWQTLQQHQNGWRQGAEDWSR
               |||||||:||||||:|:|| ||||||||||||||||||||||||||||||||||||||
orf32ng-1      HAFWDKAYGFYTPETASVHRLLSDDLNGGEALSATQRLECWQTLQQHQNGWRQGAEDWSR
                      310       320       330       340       350       360

360       370       380
orf32-1.pep    YLFGQPSAPEKLAAFVSKHQKIRX
               |||||||| |||||||||||||||
orf32ng-1      YLFGQPSASEKLAAFVSKHQKIRX
                      370       380
```

On this basis, including the RGD sequence in the gonococcal protein, characteristic of adhesins, it is predicted that the proteins from *N.meningitidis* and *N.gonorrhoeae*, and their epitopes, could be useful antigens for vaccines or diagnostics, or for raising antibodies.

Figure 7A:
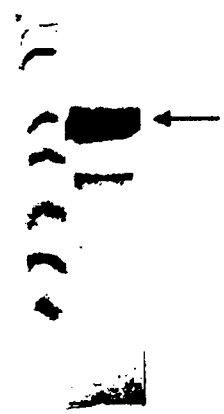
Figure 7B:
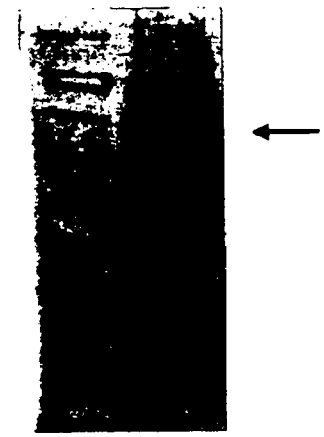

ORF32-1 (SEQ ID NO: 190) (42 kDa) was cloned in pET and pGex vectors and expressed in *E.coli*, as described above. The products of protein expression and purification were analyzed by SDS-PAGE. FIG. 7A shows the results of affinity purification of the His-fusion protein, and FIG. 7B shows the results of expression of the GST-fusion in *E.coli*. Purified His-fusion protein was used to immunise mice, whose sera were used for ELISA, giving a positive result. These experiment confirm that ORF32-1 (SEQ ID NO: 190) is a surface-exposed protein, and that it is a useful immunogen.

Example 24

The following partial DNA sequence was identified in *N.meningitidis* (SEQ ID NO: 197):

```
  1 ..TTGTTCCTGC GTGTNAAAGT GGGGCGTTTT TTCAGCAGTC CGGCGACGTG
 51   GTTTCGGGNC AAAGACCCTG TAAATCAGGC GGTGTTGCGG CTGTATNCGG
101   ACGAGTGGCG GCA.ACTTCG GTACGTTGGA AAATAGNCGC AACGTCGCAC
151   AGCCTGTGGC TCTGCACGCT GCTCGGAATG CTGGTGTCGG TATTGTTGCT
201   GCTTTTGGTG CGGCAATATA CGTTCAACTG GGAAAGCACG CTGTTGAGCA
251   ATGCCGCTTC GGTACGCGCG GTGGAAATGT TGGCATGGCT GCCGTCGAAA
301   CTCGGTTTCC CTGTCCCCGA TGCGCGGTCG GTCATCGAAG GCCGTCTGAA
351   CGGCAATATT GCCGATGCGC GGGCTTGGTC GGGGCTGCTG GTCGNCAGTA
401   TCGCCTGCTA NGGCATCCTG CCGCGCCTG..
```

This corresponds to the amino acid sequence (SEQ ID NO: 198; ORF33):

```
  1  ..LFLRVXVGRF FSSPATWFRX KDPVNQAVLR LYXDEWRXTS VRWKIXATSH
 51    SLWLCTLLGM LVSVLLLLLV RQYTFNWEST LLSNAASVRA VEMLAWLPSK
101    LGFPVPDARS VIEGRLNGNI ADARAWSGLL VXSIACXGIL PRL..
```

Further work revealed the complete nucleotide sequence (SEQ ID NO: 199):

```
   1  ATGTTGAATC CATCCCGAAA ACTGGTTGAG CTGGTCCGTA TTTTGGACGA
  51  AGGCGGTTTT ATTTTCAGCG GCGATCCCGT ACAGGCGACG GAGGCTTTGC
 101  GCCGCGTGGA CGGCAGTACG GAGGAAAAAA TCATCCGTCG GGCGGAGATG
 151  ATTGACAGGA ACCGTATGCT GCGGCAGACG TTGGAACGTG TGCGTGCGGG
 201  GTCGTTCTGG TTGTGGGTGG TGGCGGCGAC GTTTGCATTT TTTACCGGTT
 251  TTTCAGTCAC TTATCTTCTA ATGGACAATC AGGGTCTGAA TTTCTTTTTG
 301  GTTTTGGCGG GCGTGTTGGG CATGAATACG CTGATGCTGG CAGTATGGTT
 351  GGCAATGTTG TTCCTGCGTG TGAAAGTGGG GCGTTTTTTC AGCAGTCCGG
 401  CGACGTGGTT TCGGGCAAA GACCCTGTAA ATCAGGCGGT GTTGCGGCTG
 451  TATGCGGACG AGTGGCGGCA ACCTTCGGTA CGTTGGAAAA TAGGCGCAAC
 501  GTCGCACAGC CTGTGGCTCT GCACGCTGCT CGGAATGCTG GTGTCGGTAT
 551  TGTTGCTGCT TTTGGTGCGG CAATATACGT TCAACTGGGA AAGCACGCTG
 601  TTGAGCAATG CCGCTTCGGT ACGCGCGGTG GAAATGTTGG CATGGCTGCC
 651  GTCGAAACTC GGTTTCCCTG TCCCCGATGC GCGGGCGGTC ATCGAAGGCC
 701  GTCTGAACGG CAATATTGCC GATGCGCGGG CTTGGTCGGG GCTGCTGGTC
 751  GGCAGTATCG CCTGCTACGG CATCCTGCCG CGCCTGCTGG CTTGGGTAGT
 801  GTGTAAAATC CTTTTGAAAA CAAGCGAAAA CGGATTGGAT TTGGAAAAGC
 851  CCTATTATCA GGCGGTCATC CGCCGCTGGC AGAACAAAAT CACCGATGCG
 901  GATACGCGTC GGGAAACCGT GTCCGCCGTT TCACCGAAAA TCATCTTGAA
 951  CGATGCGCCG AAATGGGCGG TCATGCTGGA GACCGAGTGG CAGGACGGCG
1001  AATGGTTCGA GGGCAGGCTG GCGCAGGAAT GGCTGGATAA GGGCGTTGCC
1051  ACCAATCGGG AACAGGTTGC CGCGCTGGAG ACAGAGCTGA AGCAGAAACC
1101  GGCGCAACTG CTTATCGGCG TGCGCGCCCA AACTGTGCCG GACCGCGGCG
1151  TGTTGCGGCA GATTGTCCGA CTCTCGGAAG CGGCGCAGGG CGGCGCGGTG
1201  GTGCAGCTTT TGGCGGAACA GGGGCTTTCA GACGACCTTT CGGAAAAGCT
1251  GGAACATTGG CGTAACGCGC TGGCCGAATG CGGCGCGGCG TGGCTTGAGC
1301  CTGACAGGGC GGCGCAGGAA GGGCGTTTGA AGACCAATA A
```

This corresponds to the amino acid sequence (SEQ ID NO: 200; ORF33-1):

```
  1  MLNPSRKLVE LVRILDEGGF IFSGDPVQAT EALRRVDGST EEKIIRRAEM
 51  IDRNRMLRET LERVRAGSFW LWVVAATFAF FTGFSVTYLL MDNQGLNFFL
```

-continued

```
101  VLAGVLGMNT LMLAVWLAML FLRVKVGRFF SSPATWFRGK DPVNQAVLRL

151  YADEWRQPSV RWKIGATSHS LWLCTLLGML VSVLLLLLVR QYTFNWESTL

201  LSNAASVRAV EMLAWLPSKL GFPVPDARAV IEGRLNGNIA DARAWSGLLV

251  GSIACYGILP RLLAWVVCKI LLKTSENGLD LEKPYYQAVI RRWQNKITDA

301  DTRRETVSAV SPKIILNDAP KWAVMLETEW QDGEWFEGRL AQEWLDKGVA

351  TNREQVAALE TELKQKPAQL LIGVRAQTVP DRGVLRQIVR LSEAAQGGAV

401  VQLLAEGGLS DDLSEKLEHW RNALAECGAA WLEPDRAAQE GRLKDQ*
```

Computer analysis of this amino acid sequence gave the following results:
Homology with a Predicted ORF from *N.meningitidis* (Strain A)

ORF33 (SEQ ID NO: 198) shows 90.9% identity over a 143aa overlap with an ORF (ORF33a) (SEQ ID NO: 202) from strain A of *N. meningitidis*:

```
                                          10         20         30
orf33.pep                            LFLRVKVGRFFSSPATWFRXKDPVNQAVLR
                                     |||||||||||||||||| ||||||||||
orf33a    LMDNQGLNFFLVLAGVXGMNTLMLAVWLAMLFLRVKVGRFFSSPATWFRGKDPVNQAVLR
                90        100       110       120       130       140

40         50         60         70         80         90
orf33.pep   LYXDEWRXTSVRWKIXATSHSLWLCTLLGMLVSVLLLLLVRQYTFNWESTLLSNAASVRA
            || |||||  |||||| |||||||||||||||||||||||||||||||||||::::|||
orf33a      LYADEWRXPSVRWKIGATSHSLWLCTLLGMLVSVLLLLLVRQYTFNWESTLLGDSSSVRL
                150       160       170       180       190       200

100        110        120        130        140
orf33.pep   VEMLAWLPSKLGFPVPDARSVIRGRLNGNIADARAWSGLLVXSIACXGILPRL
            |||||||| :||||||||||: |||||||||||||||||||| ||||| ||||
orf33a      VEMLAWLPAKLGFPVPDARAVIEGRLNGNIADARAWSGLLVGSIACYGILPRLLAWAVCK
                210       220       230       240       250       260 orf33a      ILXXTSENGLDLEKXXXXXXXIRRWQNKITDADTRRETVSAVSPKIVLNDAPKWAVMLETE
                270       280       290       300       310       320
```

The complete length ORF33a nucleotide sequence (SEQ ID NO: 201) is:

```
  1  ATGTTGAATC CATCCCGAAA ACTGGTTGAG CTGGTCCGTA TTTTGGAAGA

51  AGGCGGCTTT ATTTTCAGCG GCGATCCCGT GCAGGCGACG GAGGCTTTGC

101  GCCGCGTGGA CGGCAGTACG GAGGAAAAAA TCATCCGTCG GGCGAAGATG

151  ATCGACAGGA ACCGTATGCT GCGGGAGACG TTGGAACGTG TGCGTGCGGG

201  GTCGTTCTGG TTGTGGGTGG CGGCGGCGAC GTTTGCGTTT NTTACCGNTT

251  TTTCAGTTAC TTATCTTCTA ATGGACAATC AGGGTCTGAA TTTCTTTTTG

301  GTTTTGGCGG GCGTGNTGGG CATGAATACG CTGATGCTGG CAGTATGGTT

351  GGCAATGTTG TTCCTGCGCG TGAAAGTGGG GCGTTTTTTC AGCAGTCCGG

401  CGACGTGGTT TCGGGGCAAA GACCCTGTCA ATCAGGCGGT GTTGCGGCTG

451  TATGCGGACG AGTGGCGGCN ACCTTCGGTA CGTTGGAAAA TAGGCGCAAC

501  GTCGCACAGC CTGTGGCTCT GCACGCTGCT CGGAATGCTG GTGTCGGTAT

551  TGTTGCTGCT TTTGGTGCGG CAATATACGT TCAACTGGGA AAGCACGCTG

601  TTGGGCGATT CGTCTTCGGT ACGGCTGGTG GAAATGTTGG CATGGCTGCC

651  TGCGAAACTG GGTTTTCCCG TGCCTGATGC GCGGGCGGTC ATCGAAGGTC

701  GTCTGAACGG CAATATTGCC GATGCGCGGG CTTGGTCGGG GCTGCTGGTC
```

```
                         -continued
  751   GGCAGTATCG CCTGCTACGG CATCCTGCCG CGCCTCTTGG CTTGGGCGGT

801   ATGCAAAATC CTTNTGNAAA CAAGCGAAAA CGGCTTGGAT TTGGAAAAGC

851   NCNNNNNTCN NNCGNTCATC CGCCGCTGGC AGAACAAAAT CACCGATGCG

901   GATACGCGTC GGGAAACCGT GTCCGCCGTT TCGCCGAAAA TCGTCTTGAA

951   CGATGCGCCG AAATGGGCGG TCATGCTGGA GACCGAATGG CAGGACGGCG

1001   AATGGTTCGA GGGCAGGCTG GCGCAGGAAT GGCTGGATAA GGGCGTTGCC

1051   GCCAATCGGG AACAGGTTGC CGCGCTGGAG ACAGAGCTGA AGCAGAAACC

1101   GGCGCAACTG CTTATCGGCG TGCGCGCCCA AACTGTGCCC GACCGCGGCG

1151   TGTTGCGGCA GATCGTCCGA CTTTCGGAAG CGGCGCAGGG CGGCGCGGTG

1201   GTGCANCTTT TGGCGGAACA GGGGCTTTCA GACGACCTTT CGGAAAAGCT

1251   GGAACATTGG CGTAACGCGC TGACCGAATG CGGCGCGGCG TGGCTGGAAC

1301   CCGACAGAGC GGCGCAGGAA GGCCGTCTGA AAACCAACGA CCGCACTTGA
```

This encodes a protein having amino acid sequence (SEQ ID NO: 202):

```
   1  MLNPSRKLVE LVRILEEGGF IFSGDPVQAT EALRRVDGST EEKIIRRAKM

51  IDRNRMLRET LERVRAGSFW LWVAAATFAF XTXFSVTYLL MDNQGLNFFL

101  VLAGVXGMNT LMLAVWLAML FLRVKVGRFF SSPATWFRGK DPVNQAVLRL

151  YADEWRXPSV RWKIGATSHS LWLCTLLGML VSVLLLLLVR QYTFNWESTL

201  LGDSSSVRLV EMLAWLPAKL GFPVPDARAV IEGRLNGNIA DARAWSGLLV

251  GSIACYGILPRLLAWAVCKI LXXTSENGLD LEKXXXXXXI RRWQNKITDA

301  DTRRETVSAV SPKIVLNDAP KWAVMLETEW QDGEWFEGRL AQEWLDKGVA

351  ANREQVAALE TELKQKPAQL LIGVRAQTVP DRGVLRQIVR LSEAAQGGAV

401  VXLLAEQGLS DDLSEKLEHW RNALTECGAA WLEPDRAAQE GRLKTNDRT*
```

ORF33a (SEQ ID NO: 202) and ORF33-1 (SEQ ID NO: 200) show 94.1% identity in 444 aa overlap:

```
                   10         20         30         40         50         60
orf33a.pep  MLNPSRKLVELVRILEEGGFIFSGDPVQATEALRRVDGSTEEKIIRRAKMIDRNRMLRET
            ||||||||||||||||:|||||||||||||||||||||||||||||||:|||||||||||
orf33-1     MLNPSRKLVELVRILDEGGFIFSGDPVQATEALRRVDGSTEEKIIRRAEMIDRNRMLRET
                   10         20         30         40         50         60

70         80         90        100        110        120
orf33a.pep  LERVRAGSFWLWVAAATFAFXTXFSVTYLLMDNQGLNFFLVLAGVXGMNTLMLAVWLAML
            ||||||||||||||:|||||| | |||||||||||||||||||||| |||||||||||||
orf33-1     LERVRAGSFWLWVVAATFAFFTGFSVTYLLMDNQGLNFFLVLAGVLGMNTLMLAVWLAML
                   70         80         90        100        110        120

130        140        150        160        170        180
orf33a.pep  FLRVKVGRFFSSPATWFRGKDPVNQAVLRLYADEWRXPSVRWKIGATSHSLWLCTLLGML
            |||||||||||||||||||||||||||||||||||| |||||||||||||||||||||||
orf33-1     FLRVKVGRFFSSPATWFRGKDPVNQAVLRLYADEWRQPSVRWKIGATSHSLWLCTLLGML
                  130        140        150        160        170        180

190        200        210        220        230        240
orf33a.pep  VSVLLLLLVRQYTFNWESTLLGDSSSVRLVEMLAWLPAKLGFPVPDARAVIEGRLNGNIA
            ||||||||||||||||||||||::::|||||||||||:||||||||||||||||||||||
orf33-1     VSVLLLLLVRQYTFNWESTLLSNAASVRAVEMLAWLPSKLGFPVPDARAVIEGRLNGNIA
                  190        200        210        220        230        240
```

```
                                       -continued
                250       260       270       280       290       300
orf33a.pep  DARAWSGLLVGSTACYGILPRLLAWAVCKILXXTSENGLDLEKXXXXXXIRRWQNKITDA
            ||||||||||||||||||||||||:||||  ||||||||||       ||||||||||||
orf33-1     DARAWSGLLVGSIACYGTLPRLLAWVVCKTLLKTSENGLDLEKPYYQAVIRRWQNKITDA
                250       260       270       280       290       300

310       320       330       340       350       360
orf33a.pep  DTRRETVSAVSPKIVLNDAPKWAVKLETEWQDGEWFEGRLAQEWLDKGVAANREQVAALE
            ||||||||||||||:|||||||||| |||||||||||||||||||||||:||||||||||
orf33-1     DTRRETVSAVSPKIILNDAPKWAVMLETEWQDGEWFEGRLAQEWLDKGVATNREQVAALE
                310       320       330       340       350       360

370       380       390       400       410       420
orf33a.pep  TELKQKPAQLLIGVRAQTVPDRGVLRQIVRLSEAAQGGAVVXLAAEQGLSDDLSEKLEHW
            |||||||||||||||||||||||||||||||||||||| |||  ||||||||||||||||
orf33-1     TELKQKPAQLLIGVRAQTVPDRGVLRQIVRLSEAAQGCAVVQLLAEQGLSDDLSEKLEHW
                370       380       390       400       410       420

430       440       450
orf33a.pep  RNALTECGAAWLEPDRAAQEGRLKTNDRTX
            ||||:|||||||||||||||||||||
orf33-1     RNALAECGAAWLEPDRAAQEGRLKDQX
                430       440
```

Homology with a Predicted ORF from *N.gonorrhoeae*

ORF33 (SEQ ID NO: 198) shows 91.6% identity over a 143aa overlap with a predicted ORF (ORF33.ng) (SEQ ID NO: 204) from *N. gonorrhoeae*:

```
orf33.pep                                     LFLRVKVGRFFSSPATWFRXKDPVNQAVLR    30
                                              |||||||||||||||||||||| | ||||||
orf33ng    LMDNQGLNFFLVLAGVLGMNTLMLAVWLATLFLRVKVGRFFSSPATWFRGKGPVNQAVLR   100 orf33.pep  LYXDEWRXTSVRWKIXATSHSLWLCTLLGMLVSVLLLLLVRQYTFNWESTLLSNAASVRA    90
           || |:||  |||||| |:||||||||||||||||||||||||||||||||||||||||||
orf33ng    LYADQWRQPSVRWKIGATAHSLWLCTLLGMLVSVLLLLLVRQYTFNWESTLLSNAASVRA   160 orf33.pep  VEMLAWLPSKLGFPVPDARSVIEGRLNGNIADARAWSGLLVXSIACXGILPRL           143
           |||||||||||||||||||||:|||||||||||||||||||| |:| |||||
orf33ng    VEMLAWLPSKLGFPVPDARAVIEGRLNGNIADARAWSGLLVGSIVCYGILPRLLAWVVCK   220
```

An ORF33ng nucleotide sequence (SEQ ID NO: 203) was predicted to encode a protein having amino acid sequence (SEQ ID NO: 204):

```
  1  MIDRDRMLRD  TLERVRAGSF WLWVVVASMM FTAGFSGTYL LMDNQGLNFF

51  LVLAGVLGMN TLMLAVWLAT LFLRVKVGRF FSSPATWFRG KGPVNQAVLR

101  LYADQWRQPS VRWKIGATAH SLWLCTLLGM LVSVLLLLLV RQYTFNWEST

151  LLSNAASVRA VEMLAWLPSK LGFPVPDARA VIEGRLNGNI ADARAWSGLL

201  VGSIVCYGIL PRLLAWVVCK ILLKTSENGL DLEKTYYQAV IRRWQNKITD

251  ADTRRETVSA VSPKIVLNDA PKWALMLETE WQDGQWFEGR LAQEWLDKGV

301  AANREQVAAL ETELKQKPAQ LLIGVRAQTV PDRGVLRQIV RLSEAAQGGA

351  VVQLLAEQGL SDDLSEKLEH WRNALTECGA AWLEPDRVAQ EGRLKDQ*
```

Further sequence analysis revealed the following DNA sequence (SEQ ID NO: 205):

```
  1  ATGTTGaatC CATCCCgaAA ACTGgttgag ctGgTCCgtA Ttttgaataa 51  aggggggtTTT attttcagcg gcgatcctgt gcaggcgacg gaggctttgc 101  gccgcgtgga cggCAGTACG GAggAaaaaa tcttccgtcg GGCGGAGAtg 151  atcgACAGGg accgtatgtt gcgggAcaCg TtggaacGTG TGCGTGCggg
```

```
                  -continued
 201   gtcgtTctgG TTATGGGTGG TggtggCAtC gATGATGTtt aCCGCCGGAT
 251   TTTCAGgcac ttatCttCTG ATGGACaatC AGGGGCtGAA TtTCTTTTTA
 301   GTTTTggcgG GAGTGTtggG CATGaatacG ctgATGCTGG CAGTATGGtt
 351   gGCAACGTTG TTCCTGCGCG TGAAAGTGGG ACGGTTTTTC AGCAGTCCGG
 401   CGACGTGGTT TCGGGGCAAA GGCCCTGTAA ATCAGGCGGT GTTGCGGCTG
 451   TATGCGGACC AGTGGCGGCA ACCTTCGGTA CGATGGAAAA TAGGCGCAAC
 501   GGCGCACAGC TTGTGGCTCT GCACGCTGCT CGGAATGCTG GTGTCGGTAT
 551   TGCTGCTGCT TTTGGTGCGG CAATATACGT TCAACTGGGA AAGCACGCTG
 601   TTGAGCAATG CCGCTTCGGT ACGCGCGGTG GAAATGTTGG CATGGCTGCC
 651   GTCGAAACTC GGTTTCCCTG TCCCCGATGC GCGGGCGGTC ATCGAAGGTC
 701   GTCTGAACGG CAATATTGCC GATGCGCGGG CTTGGTCGGG GCTGCTGGTC
 751   GGCAGTATCG TCTGCTACGG CATCCTGCCG CGCCTCTTGG CTTGGGTAGT
 801   GTGTAAAATC CTTTTGAAAA CAAGCGAAAA CGGattgGAT TTGGAAAAAA
 851   CCTATTATCA GGCGGTCATC CGCCGCTGGC AGAACAAAAT CACCGATGCG
 901   GATACGCGTC GGGAAACCGT GTCCGCCGTT TCGCcgaAAA TCGTCTTGAA
 951   CGATGCGCCG AAATGGGCGC TCATGCTGGA GACCGAGTGG CAGGACGGCC
1001   AATGGTTCGA GGGCAGGCTG GCGCAGGAAT GGCTGGATAA GGGCGTTGCC
1051   GCCAATCGGG AACAGGTTGC CGCGCTGGAG ACAGAGCTGA AGCAGAAACC
1101   GGCGCAACTG CTTATCGGCG TACGCGCCCA AACTGTGCCG GACCGGGGCG
1151   TGCTGCGGCA GATTGTGCGG CTTTCGGAAG CGGCGCAGGG CGGCGCGGTG
1201   GTGCAGCTTT TGGCGGAACA GGGGCTTTCA GACGACCTTT CGGAAAAGCT
1251   GGAACATTGG CGTAACGCGC TGACCGAATG CGGCGCGGCG TGGCTTGAGC
1301   CTGACAGGGT GGCGCAGGAA GGCCGTTTGA AGACCAATA A
```

This encodes a protein having amino acid sequence (SEQ ID NO: 206; ORF33ng-1):

```
  1  MLNPSRKLVE LVRILNKGGF IFSGDPVQAT EALRRVDGST EEKIFRRAEM
 51  IDRDRMLRDT LERVRAGSFW LWVVVASMMF TAGFSGTYLL MDNQGLNFFL
101  VLAGVLGMNT LMLAVWLATL FLRVKVGRFF SSPATWFRGK GPVNQAVLRL
151  YADQWRQPSV RWKIGATAHS LWLCTLLGML VSVLLLLLVR QYTFNWESTL
201  LSNAASVRAV EMLAWLPSKL GFPVPDARAV IEGRLNGNIA DARAWSGLLV
251  GSIVCYGILP RLLAWVVCKI LLKTSENGLD LEKTYYQAVI RRWQNKITDA
301  DTRRETVSAV SPKIVLNDAP KWALMLETEW QDGQWFEGRL AQEWLDKGVA
351  ANREQVAALE TELKQKPAQL LIGVRAQTVP DRGVLRQIVR LSEAAQGGAV
401  VQLLAEQGLS DDLSEKLEHW RNALTECGAA WLEPDRVAQE GRLKDQ*
```

ORF33ng-1 (SEQ ID NO: 206) and ORF33-1 (SEQ ID NO: 200) show 94.6% identity in 446 aa overlap:

```
                   10         20         30         40         50         60
orf33-1.pep MLNPSRKLVELVRILDEGGFIFSGDPVQATEALRRVDGSTEEKIIRRAEMIDRNRMLRET
            ||||||||||||||||::||||||||||||||||||||||||||:||||||||:||||:
orf33ng-1   MLNPSRKLVELVRILNKGGFIFSGDPVQATEALRRVDGSTEEKIFRRAEMIDRDRMLRDT
                   10         20         30         40         50         60
```

```
                70        80        90       100       110       120
orf33-1.pep LERVRAGSFWLWVVAATFAFFTGFSVTYLLMDNQGLNFFLVLAGVLGMNTLMLAVWLAML
            ||||||||||||||:|::  | :|||  ||||||||||||||||||||||||||||| |
orf33ng-1   LERVRAGSFWLWVVVASMMFTAGFSGTYLLMDNQGLNFFLVLAGVLGMNTLMLAVWLATL
                70        80        90       100       110       120

130       140       150       160       170       180
orf33-1.pep FLRVKVGRFFSSPATWFRGKDPVNQAVLRLYADEWRQPSVRWKTGATSHSLWLCTLLGML
            |||||||||||||||||||| ||||||||||||:||||||||||:|||||||||||||
orf33ng-1   FLRVKVGRFFSSPATWFRGKGPVNQAVLRLYADQWRQPSVRWXTGATAHSLWLCTLLGML
               130       140       150       160       170       180

190       200       210       220       230       240
orf33-1.pep VSVLLLLLVRQYTENWESTLLSNAASVRAVEMLAWLPSKLGFPVPDARAVIEGRLNGNIA
            ||||||||||||| |||||||||||||||||||||||||||||||||||||||||||||
orf33ng-1   VSVLLLLLVRQYTFNWESTLLSNAASVRAVEMLAWLPSKLGFPVPDARAVIEGRLNGNIA
               190       200       210       220       230       240

250       260       270       280       290       300
orf33-1.pep DARAWSGLLVGSIACYGILPRLLAWVVCKILLKTSENGLDLEKPYYQAVIRRWQNKITDA
            |||||||||||:|||||||||||||||||||||||||||||| |||||||||||||||
orf33ng-1   DARAWSGLLVGSIVCYGILPRLLAWVVCKILLKTSENGLDLEKTYYQAVIRRWQNKITDA
               250       260       270       280       290       300

310       320       330       340       350       360
orf33-1.pep DTRRETVSAVSPKIILNDAPKWAVMLETEWQDGEWFEGRLAQEWLDKGVATNREQVAALE
            |||||||||||||:|||||||||:||||||||:|||||||||||||||:||||||||||
orf33ng-1   DTRRETVSAVSPKIVLNDAPKWALMLETEWQDGQWFEGRLAQEWLDKGVAANREQVAALE
               310       320       330       340       350       360

370       380       390       400       410       420
orf33-1.pep TELKQKPAQLLIGVRAQTVPDRGVLRQIVRLSEAAQGGAVVQLLAEQGLSDDLSEKLEHW
            |||||||||||||||||||||||||||:||||||||||||||||||||||||||||||||
orf33ng-1   TELKQKPAQLLIGVRAQTVPDRGVLRQTVRLSEAAQGGAVVQLLAEQGLSDDLSEKLEHW
               370       380       390       400       410       420

430       440
orf33-1.pep RNALAECGAAWLEPDRAAQEGRLKDQX
            ||||:|||||||||||:||||||||||
orf33ng-1   RNALTECGAAWLEPDRVAQEGRLKDQX
               430       440
```

Based on the presence of several putative transmembrane domains in the gonococcal protein, it is predicted that the proteins from N.meningitidis and N.gonorrhoeae, and their epitopes, could be useful antigens for vaccines or diagnostics, or for raising antibodies.

Example 25

The following partial DNA sequence was identified in N.meningitidis (SEQ ID NO: 207):

```
  1 ..CAGAAGAGTT TGTCGAGAAT TTCTTTATGG GGTTTGGGCG GCGTGTTTTT
 51   CGGGGTGTCC GGTCTGGTAT GGTTTTCTTT GGGCGTTTCT TT.GAGTGCG
101   CCTGTTTTTC GGGTGTTTCT TTTCGGGGTT CGGGACGGGG GACGTTTGTG
151   GGCAGTACGG GGGTTTCTTT GAGTGTGTTT TCAGCTTGTG TTCC.GGCGT
201   CGTCCGGCTG CCTGTCGGTT TGAGCTGTGT CGGCAGGTTG CG..GTTTGA
251   CCCGGTTTTT CTTGGGTGCG GCAGGGGACG TCATTCTCCT GCCGCTTTCG
301   TCTGTGCCGT CCGGCTGTGC GGGTTGGGAT GAGGCGGCGT GGTGGTGTTC
351   GGGTTGGGCG GCATCTTGTT CCGACTACGC CGTTTGGCAG CCAGAATTCG
401   GTTTCGCGGG GGCTGTCGGT GTGTTGCGGT TCGGCTTGAA GGGTTTTGTC
451   GTCC..
```

This corresponds to the amino acid sequence (SEQ ID NO: 208; ORF34):

```
  1 ..QKSLSRISLW GLGGVFFGVS GLVWFSLGVS XECACFSGVS FRGSGRGTFV
 51   GSTGVSLSVF SACVXGVVRL PVGLSCVGRL XXLTRFFLGA AGDVILLPLS
```

```
-continued
101  SVPSGCAGSD EAAWWCSGWA ASCPTTPFGS QNSVSRGLSV CCGSA*RVLS

151  S..
```

Further work revealed the complete nucleotide sequence (SEQ ID NO: 209):

```
   1  ATGATGATGC CGTTCATAAT GCTTCCTTGG ATTGCkGGTG TGCCTGCCGT

51  GCCGGGTCAG AATAGGTTGT CCAGAATTTC TTTATGGGGT TTGGGCGGCG

101  TGTTTTTCGG GGTGTCCGGT TTGGTATGGT TTTCTTTGGG CGTTTCTTTG

151  GGCTGCGCCT GTTTTTCGGG TGTTTCTTTT CGGGGTTCGG GACGGGGGAC

201  CTTTGTGGGC AGTACGGGGG TTTCTTTGAG TGTGTTTTCA GCTTGTGTTC

251  CGGCGTCGTC CGGCTGCCTG TCGGTTTGAG CTGTGTCGGC AGGTTGCGGT

301  TTGACCCGGT TTTTCTTGGG TGCGGCAGGG GACGGCAGTC CGCTGCCGCT

351  TTCGTCTGTG CCGTCCGGCT GTGCGGGTTC GGATGAGGCG GCGTGGTGGT

401  GTTCGGGTTG GGCGGCATCT TGTCCGACTA CGCCGTTTGG CAGCCAGAAT

451  TCGGTTTCGC GGGGGCTGTC GGTGTGTTGC GGTTCGGCTT GAAGGGTTTT

501  GTCGCCGTTC GGGTTGAATG TGCTGACGAT GCCTATTGCC AATGCGCCGA

551  TGGCGGCGAT ACAGATGAGC AATACGGCGC GTATCAGGAG TTTGGGGGTC

601  AGCCTGAAGG GTTTGTTCGG TTTTTTTGCC ATTTTGATTG TGCTTTTGGG

651  GTGTCGGGCA ATGCCGTCTG AAGGCGGTTC AGACGGCATT GCCGAGTCAG

701  CGTTGGACGT AGTTTTGGTA GAGGGTGATG ACTTTTTGTA CGCCGACGGT

751  GGTGCTGACT TTTTGGGTAA TCTGCGCCTG TTCTTCGGGG GTGAGGATGC

801  CCATAACGTA GGTTACGTTG CCGTAGGTAA CGATTTTGAC GCGCGCCTGT

851  GTGGCGGGGC TGATGCCCAA CAGCGTGGCG CGGACTTTGG ATGTGTTCCA

901  AGTGTCGCCG GCGATGTCGC CGGCAGTGCG CGGCAGGGAG GCGACGGTAA

951  TATAGTTGTA CACGCCTTCG GCGGCCTGTT CGGAACGTGC AATCTGACCG

1001  ACGAACTGTT TTTCGCCTTC GGTGGCGACT TGTCCGAGCA GCAGCAGGTG

1051  GCGGTTGTAG CCGACGACGG AGATTTGGGG CGTGTAGCCT TTGGTTTGGT

1101  TGTTGTGGCG CAGATAGGAA CGGGCGGTGG TTTCGATACG CAACGCCATA

1151  ACGTTGTCGT CGGTTTGCGC GCCGGTGGTT CGGCGGTCGA CGGCGGATTT

1201  CGCGCCGACG GCGGCGCTTC CGATTACTGC GCTGACGCAG CCGCTAAGGG

1251  CAAGGCTGAA AATGGCGGCA ATCAGGGTGC GGACGGTGTG CGGTTTGGGT

1301  TTCATCGGGT GCTTCCTTTC TTGGGCGTTT CAGACGGCAT TGCTTTGCGC

1351  CATGCCGTCT GA
```

This corresponds to the amino acid sequence (SEQ ID NO: 210; ORF34-1):

```
   1  MMMPFIMLPW IAGVPAVPGQ NRLSRISLWG LGGVFFGVSG LVWFSLGVSL

51  GCACFSGVSF RGSGRGTFVG STGVSLSVFS ACVPASSGCL SV*AVSAGCG

101  LTRFFLGAAG DGSPLPLSSV PSGCAGSDEA AWWCSGWAAS CPTTPFGSQN

151  SVSRGLSVCC GSA*RVLSPF GLNVLTMPIA NAPMAAIQMS NTARIRSLGV
```

-continued

```
201  SLKGLFGFFA ILIVLLGCRA MPSEGGSDGI AESALDVVLV EGDDFLYADG

251  GADFLGNLRL FFGGEDAHNV GYVAVGVDFD ARLCGGADAQ QRGADFGCVP

301  SVAGDVAGSA RQGGDGNIVV MAFGGLFGTC NLTDELFFAF GGDLSEQQQV

351  AVVADDGDLG RVAFGLVVLA QIGTGGGFDT QRHNVVVGLR AGGSAVDGGF

401  RGDGGASDYC ADAAAKGKAE NGGNQGADGV RFGFHRVLPF LGVSDGIALR

451  HAV*
```

Computer analysis of this amino acid sequence gave the following results:
Homology with a Predicted ORF from N.meningitidis (Strain A)

ORF34 (SEQ ID NO: 208) shows 73.3% identity over a 161aa overlap with an ORF (ORF34a) (SEQ ID NO: 212) from strain A of N. meningitidis:

```
                             10        20        30
orf34.pep                    QKSLSRISLWGLGGVFFGVSGLVWFSLGVSXE------CAC
                                ||| |||||||| ||||||||||||||||   |||
orf34a     MMXPXIMLPWIAGVPAVPGQKRLSRXSLWGLGGXFFGVSGLVWFSLGVSXSLGVSXGCAC
                10        20        30        40        50        60

40        50        60        70        80        90
orf34.pep  FSGVSFRGSGRGTFVGSTGVSLSVFSACVXGVVRLPVGLSCVGRLXX-----LTRFFLGA
           ||||||||||||||||||||||||||||:   |:: :|::       ||| | ||
orf34a     FSGVSFRGSGRGTFVGSTGVSLSVFSACA------PASSGCLSVXAVSAGCGLTRXFXGA
                70        80        90       100       110

100       110       120       130       140       150
orf34.pep  AGDVILLPLSSVPSGCAGSDEAAWWCSGWAASCPTTPFGSQNSVSRGLSVCCGSAXRVLS
           |||   ||||||||||||:|| |  ||||||||||||||||||||||||||||||: ||||
orf34a     AGDGSPLPLSSVPSGCAGADEEAXXCSGWAASCPTTPFGSQNSVSRGLSVCCGSVWRVLS
                120       130       140       150       160       170 orf34.pep  S
orf34a     PFGXNVLTMPIANAPMAVIQMSNTARIRSLGVSLKGLFXFFAILIVLLGCRAMPSEGGSD
                180       190       200       210       220       230
```

The complete length ORF34a nucleotide sequence (SEQ ID NO: 211) is:

```
  1  ATGATGATNC CGTTNATAAT GCTTCCTTGG ATTGCGGGTG TGCCTGCCGT

51  GCCGGGTCAG AAGAGGTTGT CGAGAANTTC TTTATGGGGT TTAGGCGGCN

101  TGTTTTTCGG GGTGTCCGGT TTGGTATGGT TTTCTTTGGG CGTTTCTNTT

151  TCTTTGGGTG TTTCTNTGGG CTGTGCCTGT TTTTCGGGTG TTTCTTTTCG

201  GGGTTCGGGA CGGGGGACGT TTGTGGGCAG TACNGGGGTT TCTTTGAGTG

251  TGTTTTCAGC TTGTGCTCCG GCGTCGTCCG GCTGCCTGTC GGTTTNAGCT

301  GTGTCGGCAG GTTGCGGTTT GACCCGGNTT TTCTTNGGTG CGGCAGGGGA

351  CGGCAGTCCG CTGCCGCTTT CGTCTGTGCC GTCCGGCTGT GCGGGTGCGG

401  ATGAGGAGGC GTNGTNGTGT TCGGGTTGGG CGGCATCTTG TCCGACTACG

451  CCGTTTGGCA GCCAGAATTC GGTTTCGCGG GGGCTGTCGG TGTGTTGCGG

501  TTCGGTNTGG AGGGTTTTGT CNCCGTTCGG GTNGAATGTG CTGACGATGC

551  CTATTGCCAA TGCGCCGATG GCGGTGATAC AGATGAGCAA TACGGCGCGT

601  ATCAGGAGTT TGGGGGTCAG CCTGAAGGGT TTGTTCNGTT TTTTTGCCAT

651  TTTGATTGTG CTTTTGGGGT GTCGGGCAAT GCCGTCTGAA GGCGGTTCAG

701  ACGGCATTGC CGAGTCAGCG TTGGACGTAG TTTNGGTAGA GGGTGATGAC
```

-continued

```
 751   TTTTTGTACG CCGACGGTGG TGCTGACTTT TTGGGTAATC TGCGCCTGTT

801   CTTCGGGGGT GAGGATGCCC ATAACGTAGG TTACGTTGCC GTAGGTAACG

851   ATTTTGACGC GCGCCTGTGT GGCGGGGCTG ATGCCCAACA GCGTGGCGCG

901   GACTTTGGAT GTGTTCCAAG TGTCGCCGGC GATGTCGCCG GCAGTGCGCG

951   GCAGGGAGGC GACGGTAATG TANTTGTACA CGCCTTCGGC GGCCTGTTCG

1001   GAACGTGCAA TCTGACCGAC GAACTGTTTC TCGCCTTCGG TGGCGACTTG

1051   TCCGAGCAGC AGCAGGTGGC GGTTGTAGCC GACAACGGAG ATTTGGGGCG

1101   TGTANCCTTT GGTTTGGTTG TTTTGGCGCA GATAGGAGCG GGCGGTGGTT

1151   TCGATACGCA GCGCCATTAC GTTGTCGTCG GTTNGCGCGC CGGTGGTTCG

1201   GCGGTCGACG GCGGATTTCG CGCCGACCGC CGCGCCGCCG ACGACTGCGC

1251   TGACGCAGCC GCCGAGGGCA AGGCTGAGGA CGGCGGCAGT CAGGGTGCGG

1301   ACGGTGTGCG GTTTGGGTTT CATCGGGTGC TTCCTTTCTT GGGCGTTTCA

1351   GACGGCATTG CTTTGCGCCA TGCCGTCTGA
```

This encodes a protein having amino acid sequence (SEQ ID NO: 212):

```
  1   MMXPXIMLPW IAGVPAVPGQ KRLSRXSLWG LGGXFFGVSG LVWFSLGVSX

51   SLGVSXGCAC FSGVSFRGSG RGTFVGSTGV SLSVFSACAP ASSGCLSVXA

101   VSAGCGLTRX FXGAAGDGSP LPLSSVPSGC AGADEEAXXC SGWAASCPTT

151   PFGSQNSVSR GLSVCCGSVW RVLSPFGXNV LTMPIANAPM AVIQMSNTAR

201   IRSLGVSLKG LFXFFAILIV LLGCRAMPSE GGSDGIAESA LDVVXVEGDD

251   FLYADGGADF LGNLRLFFGG EDAHNVGYVA VGNDFDARLC GGADAQQRGA

301   DFGCVPSVAG DVAGSARQGG DGNVXVHAFG GLFGTCNLTD ELFLAFGGDL

351   SEQQQVAVVA DNGDLGRVXF GLVVLAQIGA GGGFDTQRHY VVVGXRAGGS

401   AVDGGFRADR RAADDCADAA AEGKAEDGGS QGADGVRFGF HRVLPFLGVS

451   DGIALRHAV*
```

ORF34a (SEQ ID NO: 212) and ORF34-1 (SEQ ID NO: 210) show 91.3% identity in 459 aa overlap:

```
                    10         20         30         40         50         60
orf34a.pep  MMXPXIMLPWIAGVPAVPGQKRLSRXSLWGLGGXFFGVSGLVWFSLGVSXSLGVSXGCAC
            || | ||||||||||||||:|||| ||||||| ||||||||||||||||      ||||
orf34-1     MMMPFIMLPWIAGVPAVPGQNRLSRISLWGLGGVFFGVSGLVWFSLGVSL------GCAC
                    10         20         30         40         50

70         80         90        100        110        120
orf34a.pep  FSGVSFRGSGRGTFVGSTGVSLSVFSACAPASSGCLSVXAVSAGCGLTRXFXGAAGDGSP
            |||||||||||||||||||||||||||||:|||||||||||||||||||| | |||||||
orf34-1     FSGVSFRGSGRGTFVGSTGVSLSVFSACVPASSGCLSVXAVSAGCGLTRFFLGAAGDGSP
                  60         70         80         90        100        110

130        140        150        160        170        180
orf34a.pep  LPLSSVPSGCAGADEEAXXCSGWAASCPTTPFGSQNSVSRGLSVCCGSVWRVLSPFGXNV
            ||||||||||:|| |  |||||||||||||||||||||||||||||||: |||||||:||
orf34-1     LPLSSVPSGCAGSDEAAWWCSGWAASCPTTPFGSQNSVSRGLSVCCGSAXRVLSPFGLNV
                  120        130        140        150        160        170

190        200        210        220        230        240
orf34a.pep  LTMPIANAPMAVIQMSNTARIRSLGVSLKGLFXFFAILIVLLGCRAMPSEGGSDGIAESA
            ||||||||||:|||||||||||||||||||||| ||||||||||||||||||||||||||
orf34-1     LTMPIANAPMAAIQMSNTARIRSLGVSLKGLFGFFAILIVLLGCRAMPSEGGSDGIAESA
                  180        190        200        210        220        230
```

```
                       250        260        270        280        290        300
orf34a-pep  LDVVXVEGDDFLYADGGADFLGNLRLFFGGEDAHNVGYVAVGNDFDARLCGGADAQQRGA
            ||||  |||||||||||||||||||||||||||||||||||||||||||||||||||||
orf34-1     LDVVLVEGDDFLYADGGADFLGNLRLFFGGEDAHNVGYVAVGNDFDARLCGGADAQQRGA
                    240        250        260        270        280        290

310        320        330        340        350        360
orf34a.pep  DFGCVPSVAGDVAGSARQGGDGNVXVHAFGGLFGTCNLTDELFLAFGGDLSEQQQVAVVA
            |||||||||||||||||||||:  |||||||||||||||||||||:|||||||||||||
orf34-1     DFGCVPSVAGDVAGSARQGGDGNIVVHAFGGLFGTCNLTDELFFAFGGDLSEQQQVAVVA
                    300        310        320        330        340        350

370        380        390        400        410        420
orf34a.pep  DNGDLGRVXFGLVVLAQIGAGGGFDTQRHYVVVGXRAGGSAVDGGFRADRRAADDCADAA
            |:||||||  ||||||||||:|||||||||  ||||  ||||||||||||||  |:  |||||
orf34-1     DDGDLGRVAFGLVVLAQIGTGGGFDTQRHNVVVGLRAGGSAVDGGFRADGGASDYCADAA
                    360        370        380        390        400        410

430        440        450        460
orf34a.pep  AEGKAEDGGSQGADGVRFGFHRVLPFLGVSDGIALRHAVX
            |:||||:||:|||||||||||||||||||||||||||||
orf34-1     AKGKAENGGNQGADGVRFGFHRVLPFLGVSDGIALRHAVX
                    420        430        440        450
```

Homology with a Predicted ORF from *N.gonorrhoeae*
ORF34 (SEQ ID NO: 208) shows 77.6% identity over a
161aa overlap with a predicted ORF (ORF34.ng) (SEQ NO:
214) from *N. gonorrhoeae*:

```
orf34.pep                           QKSLSRISLWGLGGVFFGVSGLVWFSLGVSXE------CAC   35
                                    || |||||||||:||||||||||||||||||      |||
orf34ng     MMMPFIMLPWIAGVPAVPGQKRLSRISLWGLAGVFFGVSGLVWFSLGVSFSLGVSLGCAC   60 orf34.pep   FSGVSFRGSGRGTFVGSTGVSLSVFSACVXGVVRLPVGLSCV-----GRLXXLTRFFLGA    90
            |||||||||| :|||||||||||||||||    :||: | :     ||   ||||||||
orf34ng     FSGVSFRGSGWGAFVGSTGVSLSVFSACVP----VPVNESAARAASEGR--GLTRFFLGA   114 orf34.pep   AGDVILLPLSSVPSGCAGSDEAAWWCSGWAASCPTTPFGSQNSVSRGLSVCCGSAXRVLS   150
            |||   |||||||||||||||||||||||||||| :|||||||||||||||||||: ||||
orf34ng     AGDGSPLPLSSVPSGCAGSDEAAWWCSGWAASCPTAPFGSQNSVSRGLSVCCGSVWRVLS   174 orf34.pep   S                                                             175
orf34ng     PFGLNVLTMPTANAPMAVIQMSNTARIRSLGVSLKGLFGFFAILIVLLGCRAMPSEGGSD   234
```

The complete length ORF34ng nucleotide sequence (SEQ
ID NO: 213) is:

```
  1    ATGATGATGC CGTTCATAAT GCTTCCTTGG ATTGCGGGTG TGCCTGCCGT

51    GCCGGGTCAA AAGAGGTTGT CGAGAATCTC TTTATGGGGT TTGGCCGGCG

101    TGTTTTTCGG GGTGTCCGGT TTGGTATGGT TTTCTTTGGG CGTTTCTTTT

151    TCTTTGGGTG TTTCTTTGGG CTGCGCCTGT TTTTCGGGTG TTTCTTTTCG

201    GGGTTCGGGA TGGGGGGCGT TTGTGGGCAG TACGGGGGTT TCTTTGAGTG

251    TGTTTTCAGC TTGTGTTCCG GTGCCGGTTA ACGAATCGGC TGCCCGGGCC

301    GCATCCGAAG GGCGCGGTTT gACCCGGTTT TTCTTGGGTG CGGCAGGGGA

351    CGGCAGTCCG CTGCCGCTTT CTTCTGTGCC GTCCGGCTGT GCGGGTTCGG

401    ATGAGGCGGC GTGGTGGTGT TCGGGTTGGG CGGCATCTTG TCCGACGGCG

451    CCGTTTGGCA GCCAGAATTC GGTTTCGCGG GGGCTGTCGG TGTGTTGCGG

501    TTCGGTTTGG AGGGTTTTGT CGCCGTTCGG GTTGAATGTG CTGACGATGC

551    CTACTGCCAA TGCGCCGATG GCGGTGATAC AGATGAGCAA TACGGCGCGT

601    ATCAGGAGTT TGGGGGTCAG CCTGAAGGGT TTGTTCGGTT TTTTTGCCAT
```

```
                      -continued
 651   TTTGATTGTG CTTTTGGGGT GTCGGGCAAT GCCGTCTGAA GGCGGTTCAG

701   ACGGCATTGC CGAGTCAGCG TTGGACGTAG TTTTGGTAGA GGGTAATGAC

751   TTTTTGTACG CCGAcggTGG TGCTGACTTT TTGGGTAATC TGCGCCTGTT

801   CTTCGGGGGT GAGGATGCCC ATAACGTAGG TTACATTGCC GTAGGTAATG

851   ATTTTGACGC GCGCCTGTGT AGCGGGCTG ATGCCCAGCA GcgtgGCGCG

901   GACTTTGGAC GTGTTCCAAG TGTCGCCGGC GATGTCGCCC GCAGTGCGCG

951   GCAGGGAGGC GACGGTAATG TAGTTGTATA CGCCTTCGGC GGCCTGTTCG

1001   GAACGTGCAA TCTGACCGAC GAACTGTTTT TCGCCTTCGG TGGCGACTTG

1051   TCCGAGCAGC AGCAGGTGGC GGTTGTAGCC GACGACGGAG ATTTGGGGCG

1101   TGTAGCCTTT CGTTTGGTTG TTTTGGCGCA GGTAGGAACG GGCGGTGGTT

1151   TCGATACGCA ACGCCATAAC GTtgtCATCG GTTtgcgcgc CGGTGGTTcg 1201   gCGGTCGATG ACGGATTTTG CGCCGACGGC GGCCCCGCCG ACGACTGCGC

1251   TGAAGCAGCC GCCGAGGGCA AGGCTGAGGA CGGCGGCAAT CAGGGTGCGG

1301   ACGGTGTGTG GTTTGGGTTT CATCGGGGAC TTCCTTTCTT GGGCGTTTCA

1351   GACGGCATTG CTTTGCGCCA TGCCGTCTGA
```

This encodes protein having amino acid sequence (SEQ ID NO: 214):

```
  1   MMMPFIMLPW IAGVPAVPGQ KRLSRISLWG LAGVFFGVSG LVWFSLGVSF

51   SLGVSLGCAC FSGVSFRGSG WGAFVGSTGV SLSVFSACVP VPVNESAARA

101   ASEGRGLTRF FLGAAGDGSP LPLSSVPSGC AGSDEAAWWC SGWAASCPTA

151   PFGSQNSVSR GLSVCCGSVW RVLSPFGLNV LTMPTANAPM AVIQMSNTAR

201   IRSLGVSLKG LFGFFAILIV LLGCRAMPSE GGSDGIAESA LDVVLVEGND

251   FLYADGGADF LGNLRLFFGG EDAHNVGYIA VGNDFDARLC SGADAQQRGA

301   DFGRVPSVAG DVARSARQGG DGNVVVYAFG GLFGTCNLTD ELFFAFGGDL

351   SEQQQVAVVA DDGDLGRVAF GLVVLAQVGT GGGFDTQRHN VVIGLRAGGS

401   AVDDGFCADG GPADDCAEAA AEGKAEDGGN QGADGVWFGF HRGLPFLGVS

451   DGIALRHAV*
```

ORF34ng (SEQ ID NO: 214) and ORF34-1 (SEQ ID NO: 210) show 90.0% identity in 459 aa overlap:

```
                    10         20         30         40       4         50
orf34-1.pep MMMPFIMLPWIAGVPAVPGQNRLSRISLWGLGGVFFGVSGLVWFSLGVS------LGCAC
            ||||||||||||||||||||:|||||||||:||||||||||||||||||      |||||
orf34ng     MMMPFIMLPWIAGVPAVPGQKRLSRISLWGLAGVFFGVSGLVWFSLGVSFSLGVSLGCAC
                    10         20         30         40         50         60

60         70         80         90        100        110
orf34-1.pep FSGVSFRGSGRGTFVGSTGVSLSVFSACVPASSGCLSVXAVSAGCGLTRFFLGAAGDGSP
            ||||||||||| :|||||||||||||||||:  ::  |: |  ||||||||||||||||
orf34ng     FSGVSFRGSGWGAFVGSTGVSLSVFSACVPVPVNESAARAASEGRGLTRFFLGAAGDGSP
                    70         80         90        100        110        120

120        130        140        150        160        170
orf34-1.pep LPLSSVPSGCAGSDEAAWWCSGWAASCPTTPFGSQNSVSRGLSVCCGSAXRVLSPFGLNV
            |||||||||||||||||||||||||||||:||||||||||||||||||: ||||||||||
orf34ng     LPLSSVPSGCAGSDEAAWWCSGWAASCPTAPFGSQNSVSRGLSVCCGSVWRVLSPFGLNV
                   130        140        150        160        170        180
```

```
                180       190       200       210       220       230
orf34-1.pep  LTMPIANAPMAAIQMSNTARIRSLGVSLKGLFGFFAILIVLLGCRAMPSEGGSDGIAESA
             ||||  ||||||:|||||||||||||||||||||||||||||||||||||||||||||||
orf34ng      LTMPTANAPMAVIQMSNTARIRSLGVSLKGLFGFFAILIVLLGCRAMPSEGGSDGIAESA
                      190       200       210       220       230       240

240       250       260       270       280       290
orf34-1.pep  LDVVLVEGDDFLYADGGADFLGNLRLFFGGEDAHNVGYVAVGNDFDARLCGGADAQQRGA
             ||||||||:|||||||||||||||||||||||||||||:|||||||||||:|||||||||
orf34ng      LDVVLVEGNDFLYADGGADFLGNLRLFFGGEDAHNVGYIAVGNDFDARLCSGADAQQRGA
                250       260       270       280       290       300

300       310       320       330       340       350
orf34-1.pep  DFGCVPSVAGDVAGSARQGGDGNIVVHAFGGLFGTCNLTDELFFAFGGDLSEQQQVAVVA
             |||  ||||||||||  ||||||||:||:|||||||||||||||||||||||||||||||
orf34ng      DFGRVPSVAGDVARSARQGGDGNVVVYAFGGLFGTCNLTDELFFAFGGDLSEQQQVAVVA
                      310       320       330       340       350       360

360       370       380       390       400       410
orf34-1.pep  DDGDLGRVAFGLVVLAQIGTGGGFDTQRHNVVVGLRAGGSAVDGGFRADGGASDYCADAA
             |||||||||||||||||:|||||||||||||:|||||||||| |||| :| ||:||
orf34ng      DDGDLGRVAFGLVVLAQVGTGGGFDTQRHNVVIGLRAGGSAVDDGFCADGGPADDCAEAA
                      370       380       390       400       410       420

420       430       440       450
orf34-1.pep  AKGKAENGGNQGADGVRFGFHRVLPFLGVSDGIALRHAVX
             |:||||:|||||||| ||||| ||||||||||||||||||
orf34ng      AEGKAEDGGNQGADGVWFGFHRGLPFLGVSDGIALRHAVX
                      430       440       450       460
```

Based on this analysis, including the presence of a putative leader sequence (double-underlined) and several putative transmembrane domains (single-underlined) in the gonococcal protein, it is predicted that the proteins from N.meningitidis and N.gonorrhoeae, and their epitopes, could be useful antigens for vaccines or diagnostics, or for raising antibodies.

Example 26

The following partial DNA sequence was identified in N.meningitidis (SEQ ID NO: 215):

```
  1  ATGAAAACCT TCTTCAAAAC CCTTTCCGCC GCCGCACTCG CGCTCATCCT
 51  CGCCGCCTGC GGATT.CAAA AAGACAGCGC GCCCGCCGCA TCCGCTTCTG
101  CCGCCGCCGA CAACGGCGCG GCGTAAAAAA GAAATCGTCT TCGGCACGAC
151  CGTCGGCGAC TTCGGCGATA TGGTCAAAGA ACAAATCCAA GCCGAGCTGG
201  AGAAAAAGG CTACACCGTC AAACTGGTCG AGTTTACCGA CTATGTACGC
251  CCGAATCTGG CATTGGCTGA GGGCGAGTTG
```

This corresponds to the amino acid sequence (SEQ ID NO: 216; ORF4):

```
  1  MKTFFKTLSA AALALILAAC G.QKDSAPAA SASAAADNGA AKKEIVFGTT
 51  VGDFGDMVKE QIQAELEKKG YTVKLVEFTD YVRPNLALAE GEL
```

Further sequence analysis revealed the complete nucleotide sequence (SEQ ID NO: 217):

```
  1  ATGAAAACCT TCTTCAAAAC CCTTTCCGCC GCCGCACTCG CGCTCATCCT
 51  CGCCGCCTGC GGCGGTCAAA AAGACAGCGC GCCCGCCGCA TCCGCTTCTG
101  CCGCCGCCGA CAACGGCGCG GCGAAAAAAG AAATCGTCTT CGGCACGACC
151  GTCGGCGACT TCGGCGATAT GGTCAAAGAA CAAATCCAAG CCGAGCTGGA
```

```
-continued
201  GAAAAAAGGC TACACCGTCA AACTGGTCGA GTTTACCGAC TATGTACGCC

251  CGAATCTGGC ATTGGCTGAG GGCGAGTTGG ACATCAACGT CTTCCAACAC

301  AAACCCTATC TTGACGACTT CAAAAAAGAA CACAATCTGG ACATCACCGA

351  AGTCTTCCAA GTGCCGACCG CGCCTTTGGG ACTGTACCCG GGCAAGCTGA

401  AATCGCTGGA AGAAGTCAAA GACGGCAGCA CCGTATCCGC GCCCAACGAC

451  CCGTCCAACT TCGCCCGCGT CTTGGTGATG CTCGACGAAC TGGGTTGGAT

501  CAAACTCAAA GACGGCATCA ATCCGTTGAC CGCATCCAAA GCGGACATCG

551  CCGAGAACCT GAAAAACATC AAAATCGTCG AGCTTGAAGC CGCGCAACTG

601  CCGCGTAGCC GCGCCGACGT GGATTTTGCC GTCGTCAACG GCAACTACGC

651  CATAAGCAGC GGCATGAAGC TGACCGAAGC CCTGTTCCAA GAACCGAGCT

701  TTGCCTATGT CAACTGGTCT GCCGTCAAAA CCGCCGACAA AGACAGCCAA

751  TGGCTTAAAG ACGTAACCGA GGCCTATAAC TCCGACGCGT TCAAAGCCTA

801  CGCGCACAAA CGCTTCGAGG GCTACAAATC CCCTGCCGCA TGGAATGAAG

851  GCGCAGCCAA ATAA
```

This corresponds to the amino acid sequence (SEQ ID NO: 218; ORF4-1):

```
  1  MKTFFKTLSA AALALILAAC GGQKDSAPAA SASAAADNGA AKKEIVFGTT

51  VGDFGDMVKE QIQAELEKKG YTVKLVEFTD YVRPNLALAE GELDINVFQH

101  KPYLDDFKKE HNLDITEVFQ VPTAPLGLYP GKLKSLEEVK DGSTVSAPND

151  PSNFARVLVM LDELGWIKLK DGINPLTASK ADIAENLKNI KIVELEAAQL

201  PRSRADVDFA VVNGNYAISS GMKLTEALFQ EPSFAYVNWS AVKTADKDSQ

251  WLKDVTEAYN SDAFKAYAHK RFEGYKSPAA WNEGAAK*
```

Computer analysis of this amino acid sequence gave the following results:
Homolopy with a Predicted ORF from *N.meningitidis* (Strain A)

ORF4 (SEQ ID NO: 216) shows 93.5% identity over a 93aa overlap with an ORF (ORF4a) (SEQ ID NO: 220) from strain A of *N. meningitidis*:

```
                    10         20         30         40         50         59
orf4.pep  MKTFFKTLSAAALALILAAC-QKDSAPAASASAAADNGAAKKEIVFGTTVGDFGDMVKE
          |||||||||||||||||||| |||||||||||||||||||| ||||||||||||||||
orf4a     MKTFFKTLSAAALALILAACGGQKDSAPAASASAAADNGAAXKEIVFGTTVGDFGDMVKE
                    10         20         30         40         50         60

60         70         80         90
orf4.pep  QIQAELEKKGYTVKLVEFTDYVRPNLALAEGEL
          || |||||||||||||| |||||| ||||||||
orf4a     XIQPELEKKGYTVKLVEXTDYVRXNLALAEGELDINVXQHXXYLDDXKKXHNLDITXVXQ
                    70         80         90        100        110        120 orf4a     VPTAPLGLYPGKLKSLXXVKXGSTVSAPNDPXXFXRVLVMLDELGXIKLKDXIXXXXXXX
                   130        140        150        160        170        180
```

The complete length ORF4a nucleotide sequence (SEQ ID NO: 219) is:

```
  1  ATGAAAACCT TCTTCAAAAC CCTTTCCGCC GCCGCACTCG CGCTCATCCT

51  CGCCGCCTGC GGCGGTCAAA AGATAGCGC GCCCGCCGCA TCCGCTTCTG
```

-continued

```
101 CCGCCGCCGA CAACGGCGCG GCGAANAAAG AAATCGTCTT CGGCACGACC

151 GTCGGCGACT TCGGCGATAT GGTCAAAGAA CANATCCAAC CCGAGCTGGA

201 GAAAAAAGGC TACACCGTCA AACTGGTCGA GTNTACCGAC TATGTGCGCN

251 CGAATCTGGC ATTGGCTGAG GGCGAGTTGG ACATCAACGT CTTNCAACAC

301 ANACNCTATC TTGACGACTN CAAAAAANAA CACAATCTGG ACATCACCNN

351 AGTCTTNCAA GTGCCGACCG CGCCTTTGGG ACTGTACCCG GCAAGCTGA

401 AATCGCTGGA NNAAGTCAAA GANGGCAGCA CCGTATCCGC GCCCAACGAC

451 CCGTNNNACT TCGNCCGCGT CTTGGTGATG CTCGACGAAC TGGGTTNGAT

501 CAAACTCAAA GACNGCATCA NNNNGNNGNN NNNANCNANA NNNGANANNN

551 NNNNANNNNT NNNNNNNNNN NNNNNCNNCG NNNNNNNANN NNNNNNNNNN

601 NCGNNTNNNN NNGCNNNNNT NNANNNTNNN NNCNNCNNNN NNNNNTNNNN

651 NANNANNAGC GGCATGAAGC TGACCGAAGC CCTGTTCCAA GAACCGAGCT

701 TTGCCTATGT CAACTGGTCT GCCGTCAAAA CCGCCGACAA AGACAGCCAA

751 TGGCTTAAAG ACGTAACCGA GGCCTATAAC TCCGACGCGT TCAAAGCCTA

801 CGCGCACAAA CGCTTCGAGG GCTACAAATC CCCTGCCGCA TGGAATGAAG

851 GCGCAGCCAA ATAA
```

This is predicted to encode a protein having amino acid sequence (SEQ ID NO: 220):

```
  1 MKTFFKTLSA AALALILAAC GGQKDSAPAA SASAAADNGA AXKEIVPGTT

51 VGDFGDMVKE XIQPELEKKG YTVKLVEXTD YVRXNLALAE GELDINVXQH

101 XXYLDDXKKX HNLDITXVXQ VPTAPLGLYP GKLKSLXXVK XGSTVSAPND

151 PXXFXRVLVM LDELGXIKLK DXIXXXXXXX XXXXXXXXXX XXXXXXXXXX

201 XXXXAXXXXX XXXXXXXXXS GMKLTEALFQ EPSFAYVNWS AVKTADKDSQ

251 WLKDVTEAYN SDAFKAYAHK RFEGYKSPAA WNEGAAK*
```

A leader peptide is underlined.
Further analysis of these strain A sequences revealed the complete DNA sequence (SEQ ID NO: 221).

```
  1 ATGAAAACCT TCTTCAAAAC CCTTTCCGCC GCCGCACTCG CGCTCATCCT

51 CGCCGCCTGC GGCGGTCAAA AAGATAGCGC GCCCGCCGCA TCCGCTTCTG

101 CCGCCGCCGA CAACGGCGCG GCGAAAAAAG AAATCGTCTT CGGCACGACC

151 GTCGGCGACT TCGGCGATAT GGTCAAAGAA CAAATCCAAC CCGAGCTGGA

201 GAAAAAAGGC TACACCGTCA AACTGGTCGA GTTTACCGAC TATGTGCGCC

251 CGAATCTGGC ATTGGCTGAG GGCGAGTTGG ACATCAACGT CTTCCAACAC

301 AAACCCTATC TTGACGACTT CAAAAAAGAA CACAATCTGG ACATCACCGA

351 AGTCTTCCAA GTGCCGACCG CGCCTTTGGG ACTGTACCCG GCAAGCTGA

401 AATCGCTGGA AGAAGTCAAA GACGGCAGCA CCGTATCCGC GCCCAACGAC

451 CCGTCCAACT TCGCCCGCGT CTTGGTGATG CTCGACGAAC TGGGTTGGAT

501 CAAACTCAAA GACGGCATCA ATCCGCTGAC CGCATCCAAA GCGGACATTG
```

```
-continued
551  CCGAAAACCT GAAAAACATC AAAATCGTCG AGCTTGAAGC CGCGCAACTG

601  CCGCGTAGCC GCGCCGACGT GGATTTTGCC GTCGTCAACG GCAACTACGC

651  CATAAGCAGC GGCATGAAGC TGACCGAAGC CCTGTTCCAA GAACCGAGCT

701  TTGCCTATGT CAACTGGTCT GCCGTCAAAA CCGCCGACAA AGACAGCCAA

751  TGGCTTAAAG ACGTAACCGA GGCCTATAAC TCCGACGCGT TCAAAGCCTA

801  CGCGCACAAA CGCTTCGAGG GCTACAAATC CCCTGCCGCA TGGAATGAAG

851  GCGCAGCCAA ATAA
```

This encodes a protein having amino acid sequence (SEQ ID NO: 222; ORF4a-1):

```
  1  MKTFFKTLSA AALALILAAC GGQKDSAPAA SASAAADNGA AKKEIVFGTT

51  VGDFGDMVKE QIQPELEKKG YTVKLVEFTD YVRPNLALAE GELDINVFQH

101  KPYLDDFKKE HNLDITEVFQ VPTAPLGLYP GKLKSLEEVK DGSTVSAPND

151  PSNFARVLVM LDELGWIKLK DGINPLTASK ADIAENLKNI KIVELEAAQL

201  PRSRADVDFA VVNGNYAISS GMKLTEALFQ EPSFAYVNWS AVKTADKDSQ

251  WLKDVTEAYN SDAFKAYAHK RFEGYKSPAA WNEGAAK*
```

ORF4a-1 (SEQ ID NO: 222) and ORF4-1 (SEQ ID NO: 218) show 99.7% identity in 287 aa overlap:

```
                10         20         30         40         50         60
orf4a-1  MKTFFKTLSAAALALILAACGGQKDSAPAASASAAADNGAAKKEIVFGTTVGDFGDMVKE
         ||||||||||||||||||||||||||||||||||||||||||||||||||||||||||||
orf4-1   MKTFFKTLSAAALALILAACGGQKDSAPAASASAAADNGAAKKEIVFGTTVGDFGDMVKE
                10         20         30         40         50         60

70         80         90        100        110        120
orf4a-1  QIQPELEKKGYTVKLVEFTDYVRPNLALAEGELDINVFQHKPYLDDFKKEHNLDITEVFQ
         ||| ||||||||||||||||||||||||||||||||||||||||||||||||||||||||
orf4-1   QIQAELEKKGYTVKLVEFTDYVRPNLALAEGELDINVFQHKPYLDDFKKEHNLDITEVFQ
                70         80         90        100        110        120

130        140        150        160        170        180
orf4a-1  VPTAPLGLYPGKLKSLEEVKDGSTVSAPNDPSNFARVLVMLDELGWIKLKDGINPLTASK
         ||||||||||||||||||||||||||||||||||||||||||||||||||||||||||||
orf4-1   VPTAPLGLYPGKLKSLEEVKDGSTVSAPNDPSNFARVLVMLDELGWIKLKDGINPLTASK
               130        140        150        160        170        180

190        200        210        220        230        240
orf4a-1  ADIAENLKNIKIVELEAAQLPRSRADVDFAVVNGNYAISSGMKLTEALFQEPSFAYVNWS
         ||||||||||||||||||||||||||||||||||||||||||||||||||||||||||||
orf4-1   ADIAENLKNIKIVELEAAQLPRSRADVDFAVVNGNYAISSGMKLTEALFQEPSFAYVNWS
               190        200        210        220        230        240

250        260        270        280
orf4a-1  AVKTADKDSQWLKDVTEAYNSDAFKAYAHKRFEGYKSPAAWNEGAAKX
         |||||||||||||||||||||||||||||||||||||||||||||||
orf4-1   AVKTADKDSQWLKDVTEAYNSDAFKAYAHKRFEGYKSPAAWNEGAAKX
               250        260        270        280
```

Homology with an Outer Membrane Protein of *Pasteurella haemolitica* (Accession q08869) (SEQ ID NO: 1126).

ORF4 (SEQ ID NO: 216) and this outer membrane protein (SEQ ID NO: 1126) show 33% aa identity in 91aa overlap:

```
                                       10        20
lip2.pasha                     MNFKKLLGVALVSALALTACKDEKAQAP----
                               || | ::||  || |:||  :|:  |
ORF4         VXTPNPDGRTPCPSFLFETATTSGENMKTFFKTLSAAAL--ALILAACGFKKTARPPHPL
                110       120       130       140       150

30        40        50        60        70        80
lip2.pasha   -ATTAKTENKAPLKVGVMTGPEAQMTEVAVKIAKEKYGLDVELVQFTEYTQPNAALHSKD
              : ::  |   :  |: :|  ::|::  ::    || |   |:||:||:|::|| ||   :
ORF4         LPPPTTARRKKEIVFGTTVGDFGDMVKEQIQAELEKKGYTVKLVEFTDYVRPNLALAEGE
             160       170       180       190       200       210

90       100       110       120       130       140
lip2.pasha   LDANAFQTVPYLEQEVKDRGYKLAIIGNTLVWPIAAYSKKIKNISELKDGATVAIPNNAS
             |
ORF4         L.....
```

Homology with a Predicted ORF from *N.gonorrhoeae*

ORF4 (SEQ ID NO: 216) shows 93.6% identity over a 94aa overlap with a predicted ORF (ORF4.ng) (SEQ ID NO: 224) from *N. gonorrhoeae*:

```
                                              10        20        30
orf4nm.pep                          MKTFFKTLSAAALALILAACGXQKDSAPAA
                                    ||||||||:|:|||||||| ||||||||
orf4ng       RANAVXTPNPDGRTPCLSFLFETATTSGENMKTFFKTLSTASLALILAACGGQKDSAPAA
                 200       210       220       230       240       250

40        50        60        70        80        89
orf4nm.pep   SASA-AADNGAAKKEIVFGTTVGDFGDMVKEQIQAELEKKGYTVKLVEFTDYVRPNLALA
             ||:| :||||||||||||||||||||||||||||||||||||||||||||||||||||
orf4ng       SAAAPSADNGAAKKEIVFGTTVGDFGDMVKEQIQAELEKKGYTVKLVEFTDYVRPNLALA
                 260       270       280       290       300       310

90
orf4nm.pep   EGEL
             ||||
orf4ng       EGELDINVFQHKPYLDDFKKEHNLDITEAFQVPTAPLGLYPGKLKSLEEVKDGSTVSAPN
                 320       330       340       350       360       370
```

The complete length ORF4ng nucleotide sequence (SEQ ID NO: 223) was predicted to encode a protein having amino acid sequence (SEQ ID NO: 224):

```
  1 MKTFFKTLST ASLALILAAC GGQKDSAPAA SAAAPSADNG AAKKEIVFGT

51 TVGDFGDMVK EQIQAELEKK GYTVKLVEFT DYVRPNLALA EGELDINVFQ

101 HKPYLDDFKK EHNLDITEAF QVPTAPLGLY PGKLKSLEEV KDGSTVSAPN

151 DPSNFARALV MLNELGWIKL KDGINPLTAS KADIAENLKN IKIVELEAAQ

201 LPRSRADVDF AVVNGNYAIS SGMKLTEALF QEPSFAYVNW SAVKTADKDS

251 QWLKDVTEAY NSDAFKAYAH KRFEGYKYPA AWNEGAAK*
```

Further analysis revealed the complete length ORF4ng DNA sequence (SEQ ID NO: 225) to be:

```
  1 atgAAAACCT TCTTCAAAAC cctttccgcc gccgcaCTCG CGCTCATCCT

51 CGCAGCCTGc ggCggtcaAA AAGACAGCGC GCCCgcagcc tctgcCGCCG

101 CCCCTTCTGC CGATAACGgc gCgGCGAAAA AAGAAAtcgt cttTCGGCACG
```

-continued

```
151  Accgtgggcg acttcggcgA TAtggTCAAA GAACAAATCC AagcCGAgct
201  gGAGAAAAAA GgctACACcg tcAAattggt cgaatttacc gactatgtGC
251  gCCCGAATCT GGCATTGGCG GAGGGCGAGT TGGACATCAA CGTCTTCCAA
301  CACAAACCCT ATCTTGACGA TTTCAAAAAA GAACACAACC TGGACATCAC
351  CGAAGCCTTC CAAGTGCCGA CCGCGCCTTT GGGACTGTAT CCGGGCAAAC
401  TGAAATCGCT GGAAGAAGTC AAAGACGGCA GCACCGTATC CGCGCCCAac
451  gACccgTCCA ACTTCGCACG CGCCTTGGTG ATGCTGAACG AACTGGGTTG
501  GATCAAACTC AAAGACGGCA TCAATCCGCT GACCGCATCC AAAGCCGACA
551  TCGCGGAAAA CCTGAAAAAC ATCAAAATCG TCGAGCTTGA AGCCGCACAA
601  CTGCCGCGCA GCCGCGCCGA CGTGGATTTT GCCGTCGTCA ACGGCAACTA
651  CGCCATAAGC AGCGGCATGA AGCTGACCGA AGCCCTGTTC CAAGAGCCGA
701  GCTTTGCCTA TGTCAACTGG TCTGCCgtcA AAACCGCCGA CAAAGACAGC
751  CAATGGCTTA AGACGTAAC CGAGGCCTAT AACTCCGACG CGTTCAAAGC
801  CTACGCGCAC AAACGCTTCG AGGGCTACAA ATACCCTGCC GCATGGAATG
851  AAGGCGCAGC CAAATAA
```

This encodes a protein having amino acid sequence (SEQ ID NO: 226; ORF4ng-1):

```
  1  MKTFFKTLSA AALALILAAC GGQKDSAPAA SAAAPSADNG AAKKEIVFGT
 51  TVGDFGDMVK EQIQAELEKK GYTVKLVEFT DYVRPNLALA EGELDINVFQ
101  HKPYLDDFKK EHNLDITEAF QVPTAPLGLY PGKLKSLEEV KDGSTVSAPN
151  DPSNFARALV MLNELGWIKL KDGINPLTAS KADIAENLKN IKIVELEAAQ
201  LPRSRADVDF AVVNGNYAIS SGMKLTEALF QEPSFAYVNW SAVKTADKDS
251  QWLKDVTEAY NSDAFKAYAH KRFEGYKYPA AWNEGAAK*
```

This shows 97.6% identity in 288 aa overlap with ORF4-1 (SEQ ID NO: 218):

```
                   10         20         30         40         50         59
orf4-1.pep   MKTFFKTLSAAALALILAACGGQKDSAPAASASA-AADNGAAKKEIVFGTTVGDFGDMVK
             ||||||||||||||||||||||||||||||||| : :||||||||||||||||||||||||
orf4ng-1     MKTFFKTLSAAALALILAACGGQKDSAPAASAAAPSADNGAAKKEIVFGTTVGDFGDMVK
                   10         20         30         40         50         60

60         70         80         90        100        110        119
orf4-1.pep   EQIQAELEKKGYTVKLVEFTDYVRPNLALAEGELDINVFQHKPYLDDFKKEHNLDITEVF
             |||||||||||||||||||||||||||||||||||||||||||||||||||||||||:|
orf4ng-1     EQIQAELEKKGYTVKLVEFTDYVRPNLALAEGELDINVFQHKPYLDDFKKEHNLDITEAF
                   70         80         90        100        110        120

120        130        140        150        160        170        179
orf4-1.pep   QVPTAPLGLYPGKLKSLEEVKDGSTVSAPNDPSNFARVLVMLDELGWIKLKDGINPLTAS
             |||||||||||||||||||||||||||||||||||||:||||:|||||||||||||||||
orf4ng-1     QVPTAPLGLYPGKLKSLEEVKDGSTVSAPNDPSNFARALVMLNELGWIKLKDGINPLTAS
                  130        140        150        160        170        180

180        190        200        210        220        230        239
orf4-1.pep   KADIAENLKNIKIVELEAAQLPRSRADVDFAVVNGNYAISSGMKLTEALFQEPSFAYVNW
             ||||||||||||||||||||||||||||||||||||||||||||||||||||||||||||
orf4ng-1     KADIAENLKNIKIVELEAAQLPRSRADVDFAVVNGNYAISSGMKLTEALFQEPSFAYVNW
                  190        200        210        220        230        240
```

```
                      -continued
            240       250       260       270       280
orf4-1.pep  SAVKTADKDSQWLKDVTEAYNSDAFKAYAHKRFEGYKSPAAWNEGAAKX
            ||||||||||||||||||||||||||||||||||||| |||||||||||
orf4ng-1    SAVKTADKDSQWLKDVTEAYNSDAFKAYAHKRFEGYKYPAAWNEGAAKX
                      250       260       270       280
```

In addition, orf4ng-1 (SEQ ID NO: 226) shows significant homology with an outer membrane protein (SEQ ID NO: 1126) from the database:

```
ID LIP2_PASHA STANDARD; PRT; 276 AA.
AC Q08869;
DT 01-NOV-1995 (REL. 32, CREATED)
DT 01-NOV-1995 (REL. 32, LAST SEQUENCE UPDATE)
DT 01-NOV-1995 (REL. 32, LAST ANNOTATION UPDATE)
DE 28.2 KD OUTER MEMBRANE PROTEIN PRECURSOR . . .
SCORES Init1: 279 Initn: 416 Opt: 494
Smith-Waterman score: 494; 36.0% identity in 275 aa overlap 10         20         30         40         50
orf4ng-1.pep  MKTFFKTLSAAAL--ALILAACGGQKDSAPAASAAAPSADNGAAKKEIVFGTTVGDFGDM
              ||| ::||  || |:||  :| :|||::|   :::| | |   |: :|  ::|
lip2_pasha    MNFKKLLGVALVSALALTACKDEKAQAPATTA---KTENKAPLK---VGVMTGPEAQM
                        10         20         30            40            50

60         70         80         90        100        110
orf4ng-1.pep  VKEQIQAELEKKGYTVKLVEFTDYVRPNLALAEGELDINVFQHKPYLDDFKKEHNLDITE
              ::  ::   || |  |:||:||:|::||  ||   :||  |:||     ||||   |:::  ::
lip2_pasha    TEVAVKIAKEKYGLDVELVQFTEYTQPNAALHSKDLDANAFQTVPYLEQEVKDRGYKLAI
                        60         70         80         90        100        110

120        130        140        150        160        170
orf4ng-1.pep  AFQVPTAPLGLYPGKLKSLEEVKDGSTVSAPNDPSNFARALVMLNELGWIKLKDGINPLT
              :: : |:: |   |:|:: |:|||:||: ||: ||  ||||::|:    | :||||   |  :
lip2_pasha    IGNTLVWPIAAYSKKIKNISELKDGATVAIPNNASNTARALLLLQAHGLLKLKDPKN-VF
                        120        130        140        150        160        170

180        190        200        210        220        230
orf4ng-1.pep  ASKADIAENLKNIKIVELEAAQLPRSRADVDFAVVNGNYAISSGMKLTE--ALFQEPSFA
              |::  || ||  ||||||| :::   | |     ||::||:::||  ::|::    :     : :      :
lip2_pasha    ATENDIIENPKNIKIVQADTSLLTRMLDDVELAVINNTYAGQAGLSPDKDGIIVESKDSP
                        180        190        200        210        220        230

240        250        260        270        280       289
orf4ng-1.pep  YVNWSAVKTADKDSQWLKDVTEAYNSDAFKAYAHKRFEGYKYPAAWNEGAAKX
              |||  : :  :||:    |:  :::::::::      | |  |:|
lip2_pasha    YVNLVVSREDNKDDPRLQTFVKSFQTEEVFQEALKLFNGGVVKGW
                        240        250        260        270
```

Based on this analysis, including the homology with the outer membrane protein of *Pasteurella haemolitica*, and on the presence of a putative prokaryotic membrane lipoprotein lipid attachment site in the gonococcal protein, it was predicted that these proteins from *N.meningitidis* and *N.gonorrhoeae*, and their epitopes, could be useful antigens for vaccines or diagnostics, or for raising antibodies.

Figure 8E:
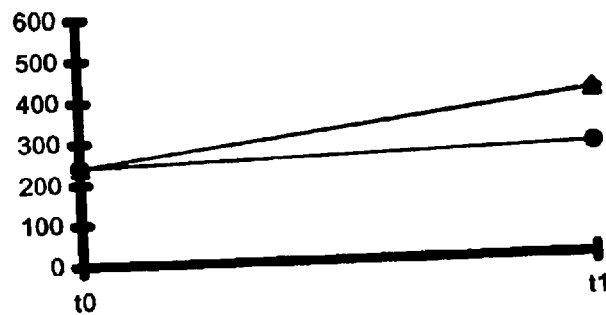

ORF4-1 (SEQ ID NO: 218) (30 kDa) was cloned in pET and pGex vectors and expressed in *E.coli*, as described above. The products of protein expression and purification were analyzed by SDS-PAGE. FIGS. 8A and 8B show, respectively, the results of affinity purification of the His-fusion and GST-fusion proteins. Purified His-fusion protein was used to immunise mice, whose sera were used for ELISA (positive result), Western blot (FIG. 8C), FACS analysis (FIG. 8D), and a bactericidal assay (FIG. 8E). These experiments confirm that ORF4-1 (SEQ ID NO: 218) is a surface-exposed protein, and that it is a useful immunogen.

Figure 8F:
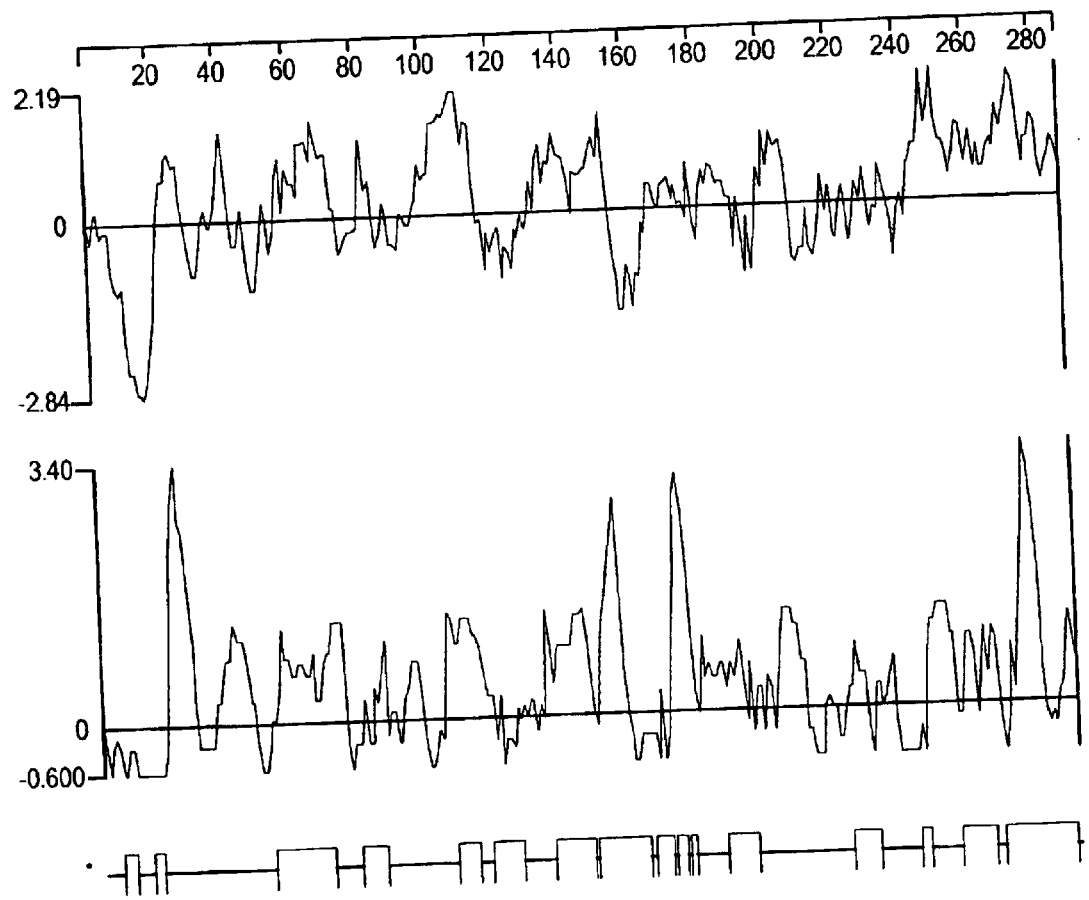

FIG. 8F shows plots of hydrophilicity, antigenic index, and AMPHI regions for ORF4-1 (SEQ ID NO: 218).

Example 27

The following partial DNA sequence was identified in *N.meningitidis* (SEQ ID NO: 227):

```
  1  CCTCGTCGTC CTCGGCATGC TCCAGTTTCA AGGGGCGATT TACTCCAAGG
 51  CGGTGGAACG TATGCTCGGC ACGGTCATCG GGCTGGGCGC GGGTTTGGGC
101  GTTTTATGGC TGAACCAGCA TTATTTCCAC GGCAACCTCC TCTTCTACCT
```

-continued
```
151 CACCGTCGGC ACGGCAAGCG CACTGGCCGG CTGGGCGGCG GTCGGCAAAA

201 ACGGCTACGT CCCTmTGCTG GCAGGGCTGA CGATGTCTAT GCTCATCGGC

251 GACAACGGCA GCGAATGGCT CGACAGCGGA CTCATGCGCG CCATGAACGT

301 CCTCATCGGC GyGGCCATCG CCATCGCCGC CGCCAAACTG CTGCCGCTGA

351 AATCCACACT GATGTGGCGT TTCATGCTTG CCGACAACCT GGCCGACTGC

401 AGCAAAATGA TTGCCGAAAT CAGCAACGGC AGGCGCATGA CCCGCGAACG

451 CCTCGAGGAG AACATGGCGA AAATGCGCCA AATCAACGCA CGCATGGTCA

501 AAAGCCGCAG CCATCTCGCC GCCACATCGG GCGAAAGCTG CATCAGCCCC

551 GCCATGATGG AAGCCATGCA GCACGCCCAC CGTAAAATCG TCAACACCAC

601 CGAGCTGCTC CTGACCACCG CCGCCAAGCT GCAATCTCCC AAACTCAACG

651 GCAGCGAAAT CCGGCTGCTT GACCGCCACT TCACACTGCT CCAAAC....

701 ........................ GC AGACACGCCC GCCGCATCCG

751 CATCGACACC GCCATCAACC CCGAACTGGA AGCCCTCGCC GAACACCTCC

801 ACTACCAATG GCAGGGCTTC CTCTGGCTCA GCACCGATAT GCGTCAGGAA

851 ATTTCCGCCC TCGTCATCCT GCTGCAACGC ACCCGCCGCA AATGGCTGGA

901 TGCCCACGAA CGCCAACACC TGCGCCAAAG CCTGCTTGA
```

This corresponds to the amino acid sequence (SEQ ID NO: 228; ORF8):

```
  1 ......PRRP RHAPVSRGDL LQGGGTYARH GHRAGRGFGR FMAEPALFPR

51 QPPLLPHRRH GKRTGRLGGG RQKRLRPXAG RADDVYAHRR QRQRMARQRT

101 HARHERPHRR GHRHRRRQTA AAEIHTDVAF HACRQPGRLQ QNDCRNQQRQ

151 AHDPRTPRGE HGENAPNQRT HGQKPQPSRR HIGRKLHQPR HDGSHAARPP

201 XNRQHHRAAP DHRRQAAISQ TQRQRNPAAX PPLHTAPN.. .........Q

251 TRPPHPHRHR HQPRTGSPRR TPPLPMAGLP LAQHRYASGN FRPRHPAATH

301 PPQMAGCPRT PTPAPKPA*
```

Computer analysis of this amino acid sequence gave the following results:
Sequence Motifs
  ORF8 (SEQ ID NO: 228) is proline-rich and has a distribution of proline residues consistent with a surface localization. Furthermore the presence of an RGD motif may indicate a possible role in bacterial adhesion events.

Homology with a Predicted ORF from N.gonorrhoeae

ORF8 (SEQ ID NO: 228) shows 86.5% identity over a 312aa overlap with a predicted ORF (ORF8.ng) (SEQ ID NO: 230) from N. gonorrhoeae:

```
orf8ng     1 MDRDDRLRRPRHAPVPRRDLLQRGGTYARYGHRAGRGFGRFMAEPALFPR     50
               |||||||  |  ||||  ||||||:||||||||||||||||||||||||
orf8.pep   1 ......PRRPRHAPVSRGDLLQGGGTYARHGHRAGRGFGRFMAEPALFPR     44 orf8ng    51 QPPLLPDHRHGKRTGRLGGGRQKRLRPYVGGADDVHAHRRQRQRMARQRP    100
             ||||||  ||||||||||||||||||||  |  ||||:||||||||||||
orf8.pep  45 QPPLLPHRRHGKRTGRLGGGRQKRLRPXAGRADDVYAHRRQRQRMARQRT     94 orf8ng   101 DARDERPHRRRHRHCRRQTAAAEIHTDVAFHACRQPGRLQQNDCRNQQRQ    150
               ||  |||||  |||  ||||||||||||||||||||||  ||||||||||
orf8.pep  95 HARHERPHRRGHRHRRRQTAAAEIHTDVAFHACRQPGRMQQNDCRNQQRQ    144 orf8ng   151 AYDARTFGAEYGQNAPNQRTHGQKPQPPRRHIGRKPHQPLHDGSHAARPP    200
             |:|  ||  |:|:|||||||||||||||||||||  |||  |||||||||
orf8.pep 145 AHDPRTPRGEHGENAPNQRTHGQKPQPSRRHIGRKLHQPRHDGSHAARPP    194
```

```
                              -continued
orf8ng    201 QNRQHHRAAPDHRRQAAISQTQRQRNPAARPPLHTAPNRPATNRRPHQRQ    250
              ||||||||||||||||||||||||||||| ||||||||             |
orf8.pep  195 XNRQHHRAAPDHRRQAAISQTQRQRNPAAXPPLHTAPN...........Q    244 orf8ng    251 TRPPHPHRHRHQPRTGSPRRTPPLPMAGFPLAQHQYASGNFRPRHPPATH    300
              ||||||||||||||||||||||||||||||||| ||||| |||||||||| |||
orf8.pep  245 TRPPHPHRHRHQPRTGSPRRTPPLPMAGLPLAQHRYASGNFRPRHPAATH    294 orf8ng    301 PPQMAGCPRTPTPAPKPA*                                  319
              ||| |||||||||||||||
orf8.pep  295 PPQNAGCPRTPTPAPKPA*                                  313
```

The complete length ORF8ng nucleotide sequence (SEQ ID NO: 229) is predicted to encode a protein having amino acid sequence (SEQ ID NO: 230):

```
  1   MDRDDRLRRP  RHAPVPRRDL  LQRGGTYARY  GHRAGRGFGR  FMAEPALFPR

51   QPPLLPDHRH  GKRTGRLGGG  RQKRLRPYVG  GADDVHAHRR  QRQRMARQRP

101   DARDERPHRR  RHRHCRRQTA  AAEIHTDVAF  HACRQPGRLQ  QNDCRNQQRQ

151   AYDARTFGAE  YGQNAPNQRT  HGQKPQPPRR  HIGRKPHQPL  HDGSHAARPP

201   QNRQHHRAAP  DHRRQAAISQ  TQRQRNPAAR  PPLHTAPNRP  ATNRRPHQRQ

251   TRPPHPHRHR  HQPRTGSPRR  TPPLPMAGFP  LAQHQYASGN  FRPRHPPATH

301   PPQMAGCPRT  PTPAPKPA*
```

Based on the sequence motifs in these proteins, it is predicted that the proteins from N.meningitidis and N.gonorrhoeae, and their epitopes, could be useful antigens for vaccines or diagnostics, or for raising antibodies.

Example 28

The following partial DNA sequence was identified in N.meningitidis (SEQ ID NO: 231):

```
  1  ..GAAATCAGCC  TGCGGTCCGA  CNACAGGCCG  GTTTCCGTGN  CGAAGCGGCG

51    GGATTCGGAA  CGTTTTCTGC  TGTTGGACGG  CGGCAACAGC  CGGCTCAAGT

101    GGGCGTGGGT  GGAAAACGGC  ACGTTCGCAA  CCGTCGGTAG  CGCGCCGTAC

151    CGCGATTTGT  CGCCTTTGGG  CGCGGAGTGG  GCGGAAAAGG  CGGATGGAAA

201    TGTCCGCATC  GTCGGTTGCG  CTGTGTGCGG  AGAATTCAAA  AAGGCACAAG

251    TGCAGGAACA  GCTCGCCCGA  AAAATCGAGT  GGCTGCCGTC  TTCCGCACAG

301    GCTTT.GGCA  TACGCAACCA  CTACCGCCAC  CCCGAAGAAC  ACGGTTCCGA

351    CCGCTGGTTC  AACGCCTTGG  GCAGCCGCCG  CTTCAGCCGC  AACGCCTGCG

401    TCGTCGTCAG  TTGCGGCACG  GCGGTAACGG  TTGACGCGCT  CACCGATGAC

451    GGACATTATC  TCGGAGA.GG  AACCATCATG  CCCGGTTTCC  ACCTGATGAA

501    AGAATCGCTC  GCCGTCCGAA  CCGCCAACCT  CAACCGGCAC  GCCGGTAAGC

551    GTTATCCTTT  CCCGACCGG..
```

This corresponds to the amino acid sequence (SEQ ID NO: 232; OR61):

```
  1  ..EISLRSDXRP  VSVXKRRDSE  RFLLLDGGNS  RLKWAWVENG  TFATVGSAPY

51    RDLSPLGAEW  AEKADGNVRI  VGCAVCGEFK  KAQVQEQLAR  KIEWLPSSAQ

101    AXGIRNHYRH  PEEHGSDRWF  NALGSRRFSR  NACVVVSCGT  AVTVDALTDD

151    GHYLGXGTIM  PGFHLMKESL  AVRTANLNRH  AGKRYPFPT..
```

Further work revealed the complete nucleotide sequence (SEQ ID NO: 233):

```
   1 ATGACGGTTT TGAAGCTTTC GCACTGGCGG GTGTTGGCGG AGCTTGCCGA
  51 CGGTTTGCCG CAACACGTCT CGCAACTGGC GCGTATGGCG GATATGAAGC
 101 CGCAGCAGCT CAACGGTTTT TGGCAGCAGA TGCCGGCGCA CATACGCGGG
 151 CTGTTGCGCC AACACGACGG CTATTGGCGG CTGGTGCGCC CATTGGCGGT
 201 TTTCGATGCC GAAGGTTTGC GCGAGCTGGG GGAAAGGTCG GGTTTTCAGA
 251 CGGCATTGAA GCACGAGTGC GCGTCCAGCA ACGACGAGAT ACTGGAATTG
 301 GCGCGGATTG CGCCGGACAA GGCGCACAAA ACCATATGCG TGACCCACCT
 351 GCAAAGTAAG GGCAGGGGGC GGCAGGGGCG GAAGTGGTCG CACCGTTTGG
 401 GCGAGTGTCT GATGTTCAGT TTTGGCTGGG TGTTTGACCG GCCGCAGTAT
 451 GAGTTGGGTT CGCTGTCGCC TGTTGCGGCA GTGGCGTGTC GGCGCGCCTT
 501 GTCGCGTTTA GGTTTGGATG TGCAGATTAA GTGGCCCAAT GATTTGGTTG
 551 TCGGACGCGA CAAATTGGGC GGCATTCTGA TTGAAACGGT CAGGACGGGC
 601 GGCAAAACGG TTGCCGTGGT CGGTATCGGC ATCAATTTTG TCCTGCCCAA
 651 GGAAGTAGAA AATGCCGCTT CCGTGCAATC GCTGTTTCAG ACGGCATCGC
 701 GGCGGGGCAA TGCCGATGCC GCCGTGCTGC TGGAAACGCT GTTGGTGGAA
 751 CTGGACGCGG TGTTGTTGCA ATATGCGCGG GACGGATTTG CGCCTTTTGT
 801 GGCGGAATAT CAGGCTGCCA ACCGCGACCA CGGCAAGGCG GTATTGCTGT
 851 TGCGCGACGG CGAAACCGTG TTCGAAGGCA CGGTTAAAGG CGTGGACGGA
 901 CAAGGCGTTT TGCACTTGGA AACGGCAGAG GGCAAACAGA CGGTCGTCAG
 951 CGGCGAAATC AGCCTGCGGT CCGACGACAG GCCGGTTTCC GTGCCGAAGC
1001 GGCGGGATTC GGAACGTTTT CTGCTGTTGG ACGGCGGCAA CAGCCGGCTC
1051 AAGTGGGCGT GGGTGGAAAA CGGCACGTTC GCAACCGTCG GTAGCGCGCC
1101 GTACCGCGAT TTGTCGCCTT TGGGCGCGGA GTGGGCGGAA AAGGCGGATG
1151 GAAATGTCCG CATCGTCGGT TGCGCTGTGT GCGGAGAATT CAAAAAGGCA
1201 CAAGTGCAGG AACAGCTCGC CCGAAAAATC GAGTGGCTGC CGTCTTCCGC
1251 ACAGGCTTTG GGCATACGCA ACCACTACCG CCACCCCGAA GAACACGGTT
1301 CCGACCGCTG GTTCAACGCC TTGGGCAGCC GCCGCTTCAG CCGCAACGCC
1351 TGCGTCGTCG TCAGTTGCGG CACGGCGGTA ACGGTTGACG CGCTCACCGA
1401 TGACGGACAT TATCTCGGGG GAACCATCAT GCCCGGTTTC CACCTGATGA
1451 AAGAATCGCT CGCCGTCCGA ACCGCCAACC TCAACCGGCA CGCCGGTAAG
1501 CGTTATCCTT TCCCGACCAC AACGGGCAAT GCCGTCGCCA GCGGCATGAT
1551 GGATGCGGTT TGCGGCTCGG TTATGATGAT GCACGGGCGT TTGAAAGAAA
1601 AAACCGGGGC GGGCAAGCCT GTCGATGTCA TCATTACCGG CGGCGGCGCG
1651 GCAAAAGTTG CCGAAGCCCT GCCGCCTGCA TTTTTGGCGG AAAATACCGT
1701 GCGCGTGGCG GACAACCTCG TCATTTACGG GTTGTTGAAC ATGATTGCCG
1751 CCGAAGGCAG GGAATATGAA CATATTTAA
```

This corresponds to the amino acid sequence (SEQ ID NO: 234; ORF61-1):

```
  1 MTVLKLSHWR VLAELADGLP QHVSQLARMA DMKPQQLNGF WQQMPAHIRG

51 LLRQHDGYWR LVRPLAVFDA EGLRELGERS GFQTALKHEC ASSNDEILEL

101 ARIAPDKAHK TICVTHLQSK GRGRQGRKWS HRLGECLMFS FGWVFDRPQY

151 ELGSLSPVAA VACRRALSRL GLDVQIKWPN DLVVGRDKLG GILIETVRTG

201 GKTVAVVGIG INFVLPKEVE NAASVQSLFQ TASRRGNADA AVLLETLLVE

251 LDAVLLQYAR DGFAPFVAEY QAANRDHGKA VLLLRDGETV FEGTVKGVDG

301 QGVLHLETAE GKQTVVSGEI SLRSDDRPVS VPKRRDSERF LLLDGGNSRL

351 KWAWVENGTF ATVGSAPYRD LSPLGAEWAE KADGNVRIVG CAVCGEFKKA

401 QVQEQLARKI EWLPSSAQAL GIRNHYRHPE EHGSDRWFNA LGSRRFSRNA

451 CVVVSCGTAV TVDALTDDGH YLGGTIMPGF HLMKESLAVR TANLNRRAGK

501 RYPFPTTTGN AVASGMMDAV CGSVMMMHGR LKEKTGAGKP VDVIITGGGA

551 AKVAEALPPA FLAENTVRVA DNLVIYGLLN MIAAEGREYE HI*
```

Figure 9:
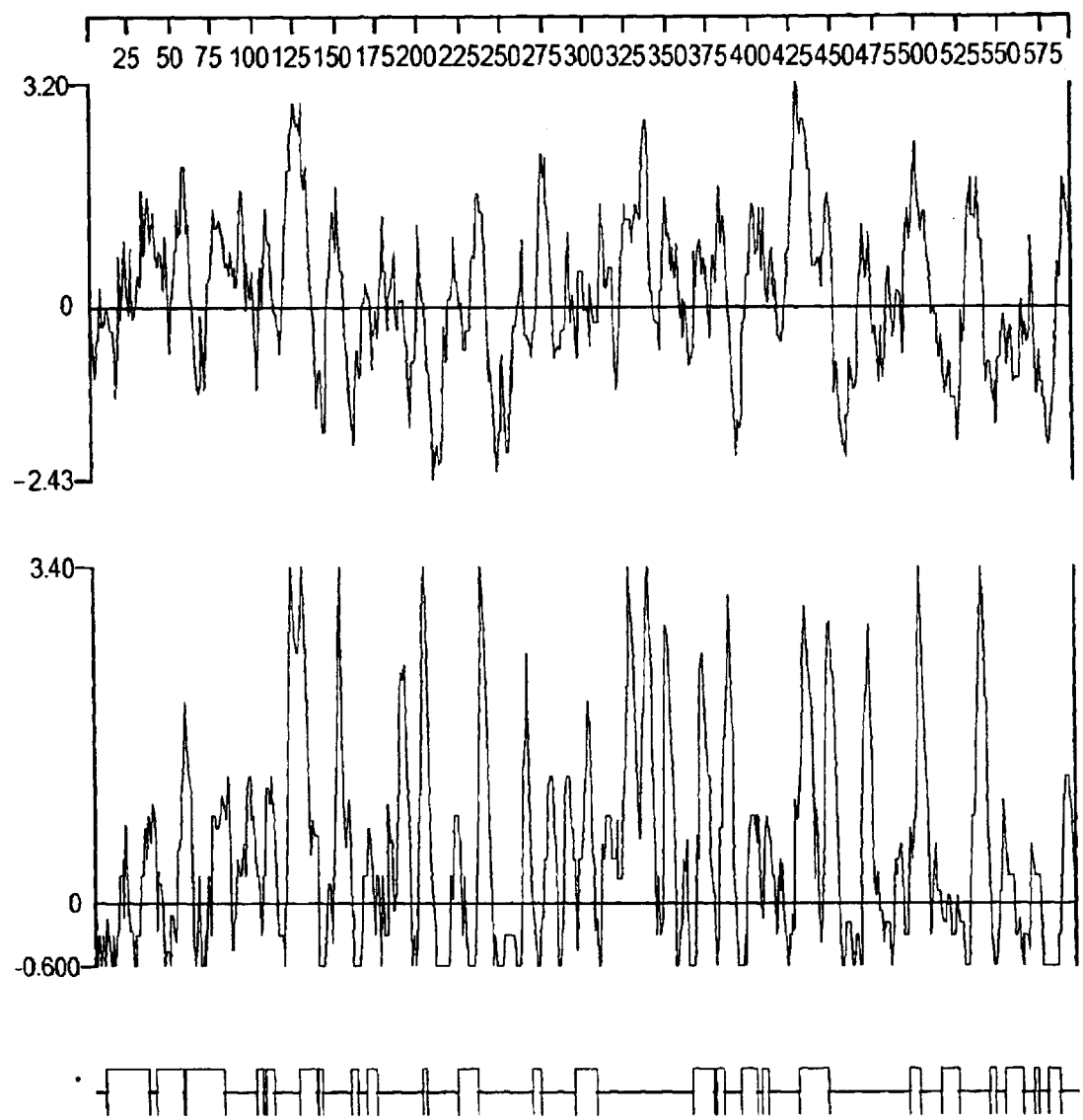

FIG. 9 shows plots of hydrophilicity, antigenic index, and AMPHI regions for OF61-1 (SEQ ID NO: 234). Further computer analysis of this amino acid sequence gave the following results:

Homology with the baf Protein of *B. pertussis* (accession number U12020) (SEQ ID NO: 1127).

ORF61 (SEQ ID NO: 232) and baf protein (SEQ ID NO: 1127) show 33% aa identity in 166aa overlap:

```
orf61    23 LLLDGGNSRLKWAWVE-NGTFATVGSAPYR----DLSPLGAEWAEKADGNVRIVGCAVCG    77
            +L+D GNSRLK  W + +   A    AP        DL  LG  A       R +G  V G
baf       3 ILIDSGNSRLKVGWFDPDAPQAAREPAPVAFDNLDLDALGRWLATLPRRPQRALGVNVAG    62 orf61    78 EFKKAQVQEQLAR---KIEWLPSSAQAXGIRNHYRHPEEHGSDRW---FNALGSRRFSRN   131
             +  +    L       I WL +   A G+RN YR+P++ G+DRW      L  +
baf      63 LARGEAIAATLRAGGCDIRWLRAQPLAMGLRNGYRNPDQLGADRWACMVGVLARQPSVHP   122 orf61   132 ACVVVSCGTAVTVDALTDDGHYLGXGTIMPGFHLMKESLAVRTANL                177
            +V S GTA T+D  +  D   + G G  I+PG  +M+ +LA   TA+L
baf     123 PLLVASFGTATTLDTIGPDNVFPG-GLILPGPAMMRGALAYGTAHL                167
```

Homolopy with a Predicted ORF from *N.meningitidis* (Strain A)

ORF61 (SEQ ID NO: 232) shows 97.4% identity over a 189aa overlap with an ORF (ORF61a) (SEQ ID NO: 236) from strain A of *N. meningitidis*:

```
                                       10        20        30
orf61.pep                      EISLRSDXRPVSVXKRRDSERFLLLDGGNS
                               ||||||| |||||  ||||||||||||||
orf61a      TVFEGTVKGVDGQGVLHLETAEGKQTVVSGEISLRSDDRPVSVPKRRDSERFLLLDGGNS
            290       300       310       320       330       340

40        50        60        70        80        90
orf61.pep   RLKWAWVENGTFATVGSAPYRDLSPLGAEWAEKADGNVRIVGCAVCGEFKKAQVQEQLAR
            ||||||||||||||||||||||||||||||||||||:|||||||||||||||||||||||
orf61a      RLKWAWVENGTFATVGSAPYRDLSPLGAEWAEKVDGNVRIVGCAVCGEFKKAQVQEQLAR
            350       360       370       380       390       400

100       110       120       130       140       150
orf61.pep   KIEWLPSSAQAXGIRNHYRHPEEHGSDRWFNALGSRRFSRNACVVVSCGTAVTVDALTDD
            ||||||||||| ||||||||||||||||||||||||||||||||||||||||||||||||
orf61a      KIEWLPSSAQALGIRNHYRHPEEHGSDRWFNALGSRRFSRNACVVVSCGTAVTVDALTDD
            410       420       430       440       450       460
```

```
                            -continued
                  160       170       180       189
orf61.pep     GHYLGXGTIMPGFHLMKESLAVRTANLNRHAGKRYPFPT
              ||||| ||||||||||||||||||||||||||||||||
orf61a        GHYLG-GTIMPGFHLMKESLAVRTANLNRHAGKRYPFPTTTGNAVASGMMDAVCGSVMMM
                  470       480       490       500       510       520 orf61a        HGRLKEKTGAGKPVDVIITGGGAAKVAEALPPAFLAENTVRVADNLVIHGLLNLIAAEGG
                  530       540       550       560       570       580
```

The complete length ORF61 a nucleotide sequence (SEQ ID NO: 235) is:

```
   1  ATGACGGTTT TGAAGCCTTC GCACTGGCGG GTGTTGGCGG AGCTTGCCGA
  51  CGGTTTGCCG CAACACGTCT CGCAACTGGC GCGTATGGCG GATATGAAGC
 101  CGCAGCAGCT CAACGGTTTT TGGCAGCAGA TGCCGGCGCA CATACGCGGG
 151  CTGTTGCGCC AACACGACGG CTATTGGCGG CTGGTGCGCC CATTGGCGGT
 201  TTTCGATGCC GAAGGTTTGC GCGAGCTGGG GGAAAGGTCG GGTTTTCAGA
 251  CGGCATTGAA GCACGAGTGC GCGTCCAGCA ACGACGAGAT ACTGGAATTG
 301  GCGCGGATTG CGCCGGACAA GGCGCACAAA ACCATATGTG TGACCCACCT
 351  GCAAAGTAAG GGCAGGGGGC GGCAGGGGCG GAAGTGGTCG CACCGTTTGG
 401  GCGAGTGTCT GATGTTCAGT TTTGGCTGGG TGTTTGACCG GCCGCAGTAT
 451  GAGTTGGGTT CGCTGTCGCC TGTTGCGGCA GTGGCGTGCC GGCGCGCCTT
 501  GTCGCGTTTG GGTTTGAAAA CGCAAATCAA GTGGCCAAAC GATTTGGTCG
 551  TCGGACGCGA CAAATTGGGC GGCATTCTGA TTGAAACGGT CAGGACGGGC
 601  GGCAAAACGG TTGCCGTGGT CGGTATCGGC ATCAATTTCG TGCTGCCCAA
 651  GGAAGTGGAA AACGCCGCTT CCGTGCAATC GCTGTTTCAG ACGGCATCGC
 701  GGCGGGGAAA TGCCGATGCC GCCGTGTTGC TGGAAACGCT GTTGGCGGAA
 751  CTTGATGCGG TGTTGTTGCA ATATGCGCGG GACGGATTTG CGCCTTTTGT
 801  GGCGGAATAT CAGGCTGCCA ACCGCGACCA CGGCAAGGCG GTATTGCTGT
 851  TGCGCGACGG CGAAACCGTG TTCGAAGGCA CGGTTAAAGG CGTGGACGGA
 901  CAAGGCGTTC TGCACTTGGA AACGGCAGAG GGCAAACAGA CGGTCGTCAG
 951  CGGCGAAATC AGCCTGCGGT CCGACGACAG GCCGGTTTCC GTGCCGAAGC
1001  GGCGGGATTC GGAACGTTTT CTGCTGTTGG ACGGCGGCAA CAGCCGGCTC
1051  AAGTGGGCGT GGGTGGAAAA CGGCACGTTC GCAACCGTCG GTAGCGCGCC
1101  GTACCGCGAT TTGTCGCCTT TGGGCGCGGA GTGGGCGGAA AAGGTGGATG
1151  GAAATGTCCG CATCGTCGGT TGCGCCGTGT GCGGAGAATT CAAAAAGGCA
1201  CAAGTGCAGG AACAGCTCGC CGAAAAATC GAGTGGCTGC CGTCTTCCGC
1251  ACAGGCTTTG GCATACGCA ACCACTACCG CCACCCCGAA GAACACGGTT
1301  CCGACCGCTG GTTCAACGCC TTGGGCAGCC GCCGCTTCAG CCGCCACGCC
1351  TGCGTCGTCG TCAGTTGCGG CACGGCGGTA ACGGTTGACG CGCTCACCGA
1401  TGACGGACAT TATCTCGGGG GAACCATCAT GCCCGGTTTC CACCTGATGA
1451  AAGAATCGCT CGCCGTCCGA ACCGCCAACC TCAACCGGCA CGCCGGTAAG
1501  CGTTATCCTT TCCCGACCAC AACGGGCAAT GCCGTCGCCA GCGGCATGAT
1551  GGATGCGGTT TGCGGCTCGG TTATGATGAT GCACGGGCGT TTGAAAGAAA
```

```
                              -continued
1601 AAACCGGGGC GGGCAAGCCT GTCGATGTCA TCATTACCGG CGGCGGCGCG

1651 GCAAAAGTTG CCGAAGCCCT GCCGCCTGCA TTTTTGGCGG AAAATACCGT

1701 GCGCGTGGCG GACAACCTCG TCATTCACGG GCTGCTGAAC CTGATTGCCG

1751 CCGAAGGCGG GGAATCGGAA CATACTTAA
```

This encodes a protein having amino acid sequence (SEQ ID NO: 236):

```
  1 MTVLKPSHWR VLAELADGLP QHVSQLARMA DMKPQQLNGF WQQMPAHIRG

51 LLRQHDGYWR LVRPLAVFDA EGLRELGERS GFQTALKHEC ASSNDEILEL

101 ARIAPDKAHK TICVTHLQSK GRGRQGRKWS HRLGECLMFS FGWVFDRPQY

151 ELGSLSPVAA VACRRALSRL GLKTQIKWPN DLVVGRDKLG GILIETVRTG

201 GKTVAVVGIG INFVLPKEVE NAASVQSLFQ TASRRGNADA AVLLETLLAE

251 LDAVLLQYAR DGFAPFVAEY QAANRDHGKA VLLLRDGETV FEGTVKGVDG

301 QGVLHLETAE GKQTVVSGEI SLRSDDRPVS VPKRRDSERF LLLDGGNSRL

351 KWAWVENGTF ATVGSAPYRD LSPLGAEWAE KVDGNVRIVG CAVCGEFKKA

401 QVQEQLARKI EWLPSSAQAL GIRNHYRHPE EHGSDRWFNA LGSRRFSRNA

451 CVVVSCGTAV TVDALTDDGH YLGGTIMPGF HLMKESLAVR TANLNRHAGK

501 RYPFPTTTGN AVASGMMDAV CGSVMMMHGR LKEKTGAGKP VDVIITGGGA

551 AKVAEALPPA FLAENTVRVA DNLVIHGLLN LIAAEGGESE HT*
```

ORF61a (SEQ ID NO: 236) and ORF61-1 (SEQ ID NO: 234) show 98.5% identity in 591 aa overlap:

```
                    10         20         30         40         50         60
orf61a.pep  MTVLKPSHWRVLAELADGLPQHVSQLARMADMKPQQLNGFWQQMPAHIRGLLRQHDGYWR
            ||||| ||||||||||||||||||||||||||||||||||||||||||||||||||||||
orf61-1     MTVLKLSHWRVLAELADGLPQHVSQLARMADMKPQQLNGFWQQMPAHIRGLLRQHDGYWR
                    10         20         30         40         50         60

70         80         90        100        110        120
orf61a.pep  LVRPLAVFDAEGLRELGERSGFQTALKHECASSNDEILELARIAPDKAHKTICVTHLQSK
            ||||||||||||||||||||||||||||||||||||||||||||||||||||||||||||
orf61-1     LVRPLAVFDAEGLRELGERSGFQTALKHECASSNDEILELARIAPDKAHKTICVTHLQSK
                    70         80         90        100        110        120

130        140        150        160        170        180
orf61a.pep  GRGRQGRKWSHRLGECLMFSFGWVFDRPQYELGSLSPVAAVACRRALSRLGLKTQIKWPN
            ||||||||||||||||||||||||||||||||||||||||||||||||||||:||||||
orf61-1     GRGRQGRKWSHRLGECLMFSFGWVFDRPQYELGSLSPVAAVACRRALSRLGLDVQIKWPN
                   130        140        150        160        170        180

190        200        210        220        230        240
orf61a.pep  DLVVGRDKLGGILIETVRTGGKTVAVVGIGINFVLPKEVENAASVQSLFQTASRRGNADA
            ||||||||||||||||||||||||||||||||||||||||||||||||||||||||||||
orf61-1     DLVVGRDKLGGILIETVRTGGKTVAVVGIGINFVLPKEVENAASVQSLFQTASRRGNADA
                   190        200        210        220        230        240

250        260        270        280        290        300
orf61a.pep  AVLLETLLAELDAVLLQYARDGFAPFVAEYQAANRDHGKAVLLLRDGETVFEGTVKGVDG
            |||||||| :||||||||||||||||||||||||||||||||||||||||||||||||||
orf61-1     AVLLETLLVELDAVLLQYARDGFAPFVAEYQAANRDHGKAVLLLRDGETVFEGTVKGVDG
                   250        260        270        280        290        300

310        320        330        340        350        360
orf61a.pep  QGVLHLETAEGKQTVVSGEISLRSDDRPVSVPKRRDSERFLLLDGGNSRLKWAWVENGTF
            ||||||||||||||||||||||||||||||||||||||||||||||||||||||||||||
orf61-1     QGVLHLETAEGKQTVVSGEISLRSDDRPVSVPKRRDSERFLLLDGGNSRLKWAWVENGTF
                   310        320        330        340        350        360
```

```
                    -continued
                 370        380        390       400        410       420
orf61a.pep  ATVGSAPYRDLSPLGAEWAEKVDGNVRIVGCAVCGEFKKAQVQEQLARKIEWLPSSAQAL
            ||||||||||||||||||||||||:|||||||||||||||||||||||||||||||||||
orf61-1     ATVGSAPYRDLSPLGAEWAEKADGNVRIVGCAVCGEFKKAQVQEQLARKIEWLPSSAQAL
                 370        380        390       400        410       420

430        440        450       460        470       480
orf61a.pep  GIRNHYRHPEEHGSDRWFNALGSRRFSRNACVVVSCGTAVTVDALTDDGHYLGGTIMPGF
            ||||||||||||||||||||||||||||||||||||||||||||||||||||||||||||
orf61-1     GIRNHYRHPEEHGSDRWFNALGSRRFSRNACVVVSCGTAVTVDALTDDGHYLGGTIMPGF
                 430        440        450       460        470       480

490        500        510       520        530       540
orf61a.pep  HLMKESLAVRTANLNRHAGKRYPFPTTTGNAVASGMMDAVCGSVMMMHGRLKEKTGAGKP
            ||||||||||||||||||||||||||||||||||||||||||||||||||||||||||||
orf61-1     HLMKESLAVRTANLNRHAGKRYPFPTTTGNAVASGMMDAVCGSVMMMHGRLKEKTGAGKP
                 490        500        510       520        530       540

550        560        570       580        590
orf61a.pep  VDVIITGGGAAKVAEALPPAFLAENTVRVADNLVIHGLLNLIAAEGGESEHTX
            ||||||||||||||||||||||||||||||||||||||||:||||:|||| | ||
orf61-1     VDVIITGGGAAKVAEALPPAFLAENTVRVADNLVIYGLLNMIAAEGREYEHIX
                 550        560        570       580        590
```

Homology with a Predicted ORF from *N.gonorrhoeae*

ORF61 (SEQ ID NO: 232) shows 94.2% identity over a 189aa overlap with a predicted ORF (ORF61.ng) (SEQ ID NO: 238) from *N. gonorrhoeae*:

```
orf61.pep                       EISLRSDXRPVSVXKRRDSERFLLLDGGNS          30
                                |||||  |  |||| || ||||||||:||||
orf61ng    TVCEGTVKGVDGRGVLHLETAEGEQTVVSGEISLRPDNRSVSVPKRPDSERFLLLEGGNS  211 orf61.pep  RLKWAWVENGTFATVGSAPYRDLSPLGAEWAEKADGVVRIVGCAVCGEFKKAQVQEQLAR   90
           |||||||||||||||||||||||||||||||||||||||||||||||| |||||:||||
orf61ng    RLKWAWVENGTFATVGSAPYRDLSPLGAEWAEKADGNVRIVGCAVCGESKKAQVKEQLAR  271 orf61.pep  KIEWLPSSAQAXGIRNHYRHPEEHGSDRWFNALGSRRFSRNACVVVSCGTAVTVDALTDD  150
           ||||||||||| ||||||||||||||||||||||||||||||||||||||||||||||||
orf61ng    KIEWLPSSAQALGIRNHYRHPEEHGSDRWFNALGSRRFSRNACVVVSCGTAVTVDALTDD  331 orf61.pep  GHYLGXGTIMPGFHLMKESLAVRTANLNRHAGKRYPFPT                        189
           ||||| |||||||||||||||||||||||| ||||||||
orf61ng    GHYLG-GTIMPGFHLMKESLAVRTANLNRPAGKRYPFPTTTGNAVASGMMDAVCGSIMMM  390
```

An ORF61ng nucleotide sequence (SEQ ID NO: 237) was predicted to encode a protein having amino acid sequence (SEQ ID NO: 238):

```
  1 MFSFGWAFDR PQYELGSLSP VAALACRRAL GCLGLETQIK WPNDLVVGRD

51 KLGGILIETV RAGGKTVAVV GIGINFVLPK EVENAASVQS LFQTASRRGN

101 ADAAVLLETL LAELGAVLEQ YAEEGFAPFL NEYETANRDH GKAVLLLRDG

151 ETVCEGTVKG VDGRGVLHLE TAEGEQTVVS GEISLRPDNR SVSVPKRPDS

201 ERFLLLEGGN SRLKWAWVEN GTFATVGSAP YRDLSPLGAE WAEKADGNVR

251 IVGCAVCGES KKAQVKEQLA RKIEWLPSSA QALGIRNHYR HPEEHGSDRW

301 FNALGSRRFS RNACVVVSCG TAVTVDALTD DGHYLGGTIM PGFHLMKESL

351 AVRTANLNRP AGKRYPFPTT TGNAVASGMM DAVCGSIMMM HGRLKEKNGA

401 GKPVDVIITG GGAAKVAEAL PPAFLAENTV RVADNLVIHG LLNLIAAEGG

451 ESEHA*
```

Further analysis revealed the complete gonococcal DNA sequence (SEQ ID NO: 239) to be:

```
   1 ATGACGGTTT TGAAGCCTTC GCATTGGCGG GTGTTGGCGG AGCTTGCCGA

51 CGGTTTGCCG CAACACGTAT CGCAATTGGC GCGTGAGGCG GACATGAAGC

101 CGCAGCAGCT CAACGGTTTT TGGCAGCAGA TGCCGGCGCA TATACGCGGG

151 CTGTTGCGCC AACACGACGG CTATTGGCGG CTGGTGCGCC CCTTGGCGGT

201 TTTCGATGCC GAAGGTTTGC GCGATCTGGG GGAAAGGTCG GGTTTTCAGA

251 CGGCATTGAA GCACGAGTGC GGGTCCAGCA ACGACGAGAT ACTGGAATTG

301 GCGCGGATTG CGCCGGACAA GGCGCACAAA ACCATATGCG TGACCCACCT

351 GCAAAGTAAG GGCAGGGGGC GGCAGGGGCG GAAGTGGTCG CACCGTTTGG

401 GCGAGTGCCT GATGTTCAGT TTCGGCTGGG CGTTTGACCG GCCGCAGTAT

451 GAGTTGGGTT CGCTGTCGCC TGTTGCGGCA CTTGCGTGCC GGCGCGCTTT

501 GGGGTGTTTG GGTTTGGAAA CGCAAATCAA GTGGCCAAAC GATTTGGTCG

551 TCGGACGCGA CAAATTGGGC GGCATTCTGA TTGAAACAGT CAGGGCGGGC

601 GGTAAAACGG TTGCCGTGGT CGGTATCGGC ATCAATTTCG TGCTGCCCAA

651 GGAAGTGGAA AACGCCGCTT CCGTGCAGTC GCTGTTTCAG ACGGCATCGC

701 GGCGGGGCAA TGCCGATGCC GCCGTATTGC TGGAAACATT GCTTGCGGAA

751 CTGGGCGCGG TGTTGGAACA ATATGCGGAA GAAGGGTTCG CGCCATTTTT

801 AAATGAGTAT GAAACGGCCA ACCGCGACCA CGGCAAGGCG GTATTGCTGT

851 TGCGCGACGG CGAAACCGTG TGCGAAGGCA CGGTTAAAGG CGTGGACGGA

901 CGAGGCGTTC TGCACTTGGA AACGGCAgaa ggcgaACAGa cggtcgtcag 951 cggcgaaaTC AGcctGCggc ccgacaacaG GTCGGtttcc gtgccgaagc 1001 ggccggatTC GgaacgtTTT tTGCtgttgg aaggcgggaa cagccgGCTC 1051 AAGTGGGCGT GggtggAAAa cggcacgttc gcaaccgtgg gcagcgcgCc 1101 gtaCCGCGAT TTGTCGCCTT TGGGCGCGGA GTGGGCGGAA AAGGCGGATG

1151 GAAATGTCCG CATCGTCGGT TGCGCCGTGT GCGGAGAATC CAAAAAGGCA

1201 CAAGTGAAGG AACAGCTCGC CCGAAAAATC GAGTGGCTGC CGTCTTCCGC

1251 ACAGGCTTTG GCATACGCA  ACCACTACCG CCACCCCGAA GAACACGGTT

1301 CCGACCGTTG GTTCAACGCC TTGGGCAGCC GCCGCTTCAG CCGCAACGCC

1351 TGCGTCGTCG TCAGTTGCGG CACGGCGGTA ACGGTTGACG CGCTCACCGA

1401 TGACGGACAT TATCTCGGCG GAACCATCAT GCCCGGCTTC CACCTGATGA

1451 AAGAATCGCT CGCCGTCCGA ACCGCCAACC TCAACCGCCC CGCCGGCAAA

1501 CGTTACCCTT TCCCGACCAC AACGGGCAAC GCCGTCGCAA GCGGCATGAT

1551 GGACGCGGTT TGCGGCTCGA TAATGATGAT GCACGGCCGT TTGAAAGAAA

1601 AAAACGGCGC GGGCAAGCCT GTCGATGTCA TCATTACCGG CGGCGGCGCG

1651 GCGAAAGTCG CCGAAGCCCT GCCGCCTGCA TTTTTGGCGG AAAATACCGT

1701 GCGCGTGGCG GACAACCTCG TCATCCACGG GCTGCTGAAC CTGATTGCCG

1751 CCGAAGGCGG GGAATCGGAA CACGCTTAA
```

This corresponds to the amino acid sequence (SEQ ID NO: 240; ORF61ng-1):

```
  1 MTVLKPSHWR VLAELADGLP QHVSQLAREA DMKPQQLNGF WQQWPAHIRG

51 LLRQHDGYWR LVRPLAVFDA EGLRDLGERS GFQTALKHEC ASSNDEILEL

101 ARIAPDKAHK TICVTHLQSK GRGRQGRKWS HRLGECLMFS FGWAFDRPQY

151 ELGSLSPVAA LACRRALGCL GLETQIKWPN DLVVGRDKLG GILIETVRAG

201 GKTVAVVGIG INFVLPKEVE NAASVQSLFQ TASRRGNADA AVLLETLLAE

251 LGAVLEQYAE EGFAPFLNEY ETANRDHGKA VLLLRDGETV CEGTVKGVDG

301 RGVLHLETAE GEQTVVSGEI SLRPDNRSVS VPKRPDSERF LLLEGGNSRL

351 KWAWVENGTF ATVGSAPYRD LSPLGAEWAE KADGNVRIVG CAVCGESKKA

401 QVKEQLARKI EWLPSSAQAL GIRNHYRHPE EHGSDRWFNA LGSRRFSRNA

451 CVVVSCGTAV TVDALTDDGH YLGGTIMPGF HLMKESLAVR TANLNRPAGK

501 RYPFPTTTGN AVASGMMDAV CGSIMMMHGR LKEKNGAGKP VDVIITGGGA

551 AKVAEALPPA FLAENTVRVA DNLVIHGLLN LIAAEGGESE HA*
```

ORF61ng-1 (SEQ ID NO: 240) and ORF61-1 (SEQ ID NO: 234) show 93.9% identity in 591 aa overlap:

```
orf61ng-1.pep  MTVLKPSHWRVLAELADGLPQHVSQLAREADMKPQQLNGFWQQMPAHIRGLLRQHDGYWR    60
               |||||  |||||||||||||||||||||| ||||||||||||||||||||||||||||||
orf61-1        MTVLKLSHWRVLAELADGLPQHVSQLARMADMKPQQLNGFWQQMPAHIRGLLRQHDGYWR    60 orf61ng-1.pep  LVRPLAVFDAEGLRDLGERSGPQTALKHECASSNDEILELARIAPDKAHKTICVTHLQSK   120
               ||||||||||||| |||||| :||||||||||||||||||||||||||||||||||||||
orf61-1        LVRPLAVFDAEGLRELGERSGFQTALKHECASSNDEILELARIAPDKAHKTICVTHLQSK   120 orf61ng-1.pep  GRGRQGRKWSHRLGECLMFSFGWAFDRPQYELGSLSPVAALACRRALGCLGLETQIKWPN   180
               |||||||||||||||||||||||:|||||||||||||||||:|||||| :|||::|||||
orf61-1        GRGRQGRKWSHRLGECLMFSFGWVFDRPQYELGSLSPVAAVACRRALSRLGLDVQIKWPN   180 orf61ng-1.pep  DLVVGRDKLGGILIETVRAGGKTVAVVGIGINFVLPKEVENAASVQSLFQTASRRGNADA   240
               ||||||||||||||||||| :|||||||||||||||||||||||||||||||||||||||
orf61-1        DLVVGRDKLGGILIETVRTGGKTVAVVGIGINFVLPKEVENAASVQSLFQTASRRGNADA   240 orf61ng-1.pep  AVLLETLLAELGAVLEQYAEEGFAPFLNEYETANRDHGKAVLLLRDGETVCEGTVKGVDG   300
               ||||||||:|| ||| |||::||||| ||::|||||||||||||||||| |||||||||
orf61-1        AVLLETLLVELDAVLLQYARDGFAPFVAEYQAANRDHGKAVLLLRDGETVFEGTVKGVDG   300 orf61ng-1.pep  RGVLHLETAEGEQTVVSGEISLRPDNRSVSVPKRPDSERFLLLEGGNSRLKWAWVENGTF   360
               :|||||||||| |||||||||||| ||| ||||| |||||||:|||||||||||||||||
orf61-1        QGVLHLETAEGKQTVVSGEISLRSDDRPVSVPKRRDSERFLLLDGGNSRLKWAWVENGTF   360 orf61ng-1.pep  ATVGSAPYRDLSPLGAEWAEKADGNVRIVGCAVCGESKKAQVKEQLARKIEWLPSSAQAL   420
               |||||||||||||||||||||||||||||||||||| :|||||:||||||||||||||||
orf61-1        ATVGSAPYRDLSPLGAEWAEKADGNVRIVGCAVCGEFKKAQVQEQLARKIEWLPSSAQAL   420 orf61ng-1.pep  GIRNHYRHPEEHGSDRWFNALGSRRFSRNACVVVSCGTAVTVDALTDDGHYLGGTIMPGF   480
               ||||||||||||||||||||||||||||||||||||||||||||||||||||||||||||
orf61-1        GIRNHYRHPEEHGSDRWFNALGSRRFSRNACVVVSCGTAVTVDALTDDGHYLGGTIMPGF   480 orf61ng-1.pep  HLMKESLAVRTANLNRPAGKRYPFPTTTGNAVASGMMDAVCGSIMMMHGRLKEKNGAGKP   540
               |||||||||||||||||| ||||||||||||||||||||||||:||||||||||:|||||
orf61-1        HLMKESLAVRTANLNRHAGKRYPFPTTTGNAVASGMMDAVCGSVMMNHGRLKEKTGAGKP   540 orf61ng-1.pep  VDVIITGGGAAKVAEALPPAFLAENTVRVADNLVIHGLLNLIAAEGGESEHAX          593
               ||||||||||||||||||||||||||||||||||:||||| ||||| |||| ||
orf61-1        VDVIITGGGAAKVAEALPPAFLAENTVRVADNLVIYGLLNMIAAEGREYEHIX          593
```

Based on this analysis, including the homology with the baf protein (SEQ ID NO: 1127) of *B.pertussis* and the presence of a putative prokaryotic membrane lipoprotein lipid attachment site, it is predicted that these proteins from *N.meningitidis* and *N.gonorrhoeae*, and their epitopes, could be useful antigens for vaccines or diagnostics, or for raising antibodies.

Example 29

The following partial DNA sequence was identified in *N.meningitidis* (SEQ ID NO: 241):

```
  1 ATGTTTTACC AAATCCTTGC CCTGATTATC TGGAGCAGCT CGTTTATTGC
 51 CGCCAAATAT GTCTATGGCG GCATCGATCC CGCATTGATG GTCGGCGTGC
101 GCCTGCTAAT TGCCGCGCTG CCTGCACTGC CCGCCTGCCG CCGTCATGTC
151 GGCAAGATTC CGCGTGAGGA ATGGAAGCCG TTGCTGATTG TGTCGTTCGT
201 CAACTATGTG CTGACCCTGC TGCTTCAGTT TGTCGGGTTG AAATACACTT
251 CCGCCGCCAG CGCATCGGTC ATTGTCGGAC TCGAGCCGCT GCTGATGGTG
301 TTTGTCGGAC ACTTTTTCTT CAACGACAAA GCGCGTGCCT ACCACTGGAT
351 ATGCGGCGCG GCGGCATTTG CCGGTGTCGC GCTGCTGATG GCGGGCGGTG
401 CGGaAGAGGG CGGCGaAGTC GGCTGGTTCG GCTGCCTGCT GGTGTTGTTG
451 GCGGGCGCGG GCTTTTGTGC CGCTATGCGT CCGACGCAAA GGCTGATTGC
501 ACGCATCGGC GCACCGGCAT TCACATCTGT TTCCATTGCC GCCGCATCGT
551 TGATGTGCCT GCCGTTTTCG CTTGCTTTGG CGCAAAGTTA TACCGTGGAC
601 TGGAGCGTCG GGATGGTATT GTCGCTGCTG TATTTGGGTT TGGGGTGC..
```

This corresponds to the amino acid sequence (SEQ ID NO: 242; ORF62):

```
  1 MFYQILALII WSSSFIAAKY VYGGIDPALM VGVRLLIAAL PALPACRRHV
 51 GKIPREEWKP LLIVSFVNYV LTLLLQFVGL KYTSAASASV IVGLEPLLMV
101 FVGHFFFNDK ARAYHWICGA AAFAGVALLM AGGAEEGGEV GWFGCLLVLL
151 AGAGFCAAMR PTQRLIARIG APAFTSVSIA AASLMCLPFS LALAQSYTVD
201 WSVGMVLSLL YLGLGC..
```

Further work revealed the complete nucleotide sequence (SEQ ID NO: 243):

```
  1 ATGTTTTACC AAATCCTTGC CCTGATTATC TGGAGCAGCT CGTTTATTGC
 51 CGCCAAATAT GTCTATGGCG GCATCGATCC CGCATTGATG GTCGGCGTGC
101 GCCTGCTAAT TGCCGCGCTG CCTGCACTGC CCGCCTGCCG CCGTCATGTC
151 GGCAAGATTC CGCGTGAGGA ATGGAAGCCG TTGCTGATTG TGTCGTTCGT
201 CAACTATGTG CTGACCCTGC TGCTTCAGTT TGTCGGGTTG AAATACACTT
251 CCGCCGCCAG CGCATCGGTC ATTGTCGGAC TCGAGCCGCT GCTGATGGTG
301 TTTGTCGGAC ACTTTTTCTT CAACGACAAA GCGCGTGCCT ACCACTGGAT
351 ATGCGGCGCG GCGGCATTTG CCGGTGTCGC GCTGCTGATG GCGGGCGGTG
401 CGGAAGAGGG CGGCGAAGTC GGCTGGTTCG GCTGCCTGCT GGTGTTGTTG
451 GCGGGCGCGG GCTTTTGTGC CGCTATGCGT CCGACGCAAA GGCTGATTGC
501 ACGCATCGGC GCACCGGCAT TCACATCTGT TTCCATTGCC GCCGCATCGT
551 TGATGTGCCT GCCGTTTTCG CTTGCTTTGG CGCAAAGTTA TACCGTGGAC
601 TGGAGCGTCG GGATGGTATT GTCGCTGCTG TATTTGGGTT TGGGGTGCGG
```

```
-continued
651 CTGGTACGCC TATTGGCTGT GGAACAAGGG GATGAGCCGT GTTCCTGCCA

701 ATGTTTCGGG ACTGTTGATT TCGCTCGAAC CCGTCGTCGG CGTGCTGCTG

751 GCGGTTTTGA TTTTGGGCGA ACACCTGTCG CCCGTGTCCG CCTTGGGCGT

801 GTTTGTCGTC ATCGCCGCCA CCTTGGTTGC CGGCCGGCTG TCGCATCAAA

851 AATAA
```

This corresponds to the amino acid sequence (SEQ ID NO: 244; ORF62-1):

```
  1 MFYQILALII WSSSFIAAKY VYGGIDPALM VGVRLLIAAL PALPACRRHV

51 GKIPREEWKP LLIVSFVNYV LTLLLQFVGL KYTSAASASV IVGLEPLLMV

101 FVGHFFFNDK ARAYHWICGA AAFAGVALLM AGGAEEGGEV GWFGCLLVLL

151 AGAGFCAAMR PTQRLIARIG APAFTSVSIA AASLMCLPFS LALAQSYTVD

201 WSVGMVLSLL YLGLGCGWYA YWLWNKGMSR VPANVSGLLI SLEPVVGVLL

251 AVLILGEHLS PVSALGVFVV IAATLVAGRL SHQK*
```

Computer analysis of this amino acid sequence gave the following results:

Homology with Hypothetical Transmembrane Protein HI0976 of *H. influenzae* (Accession Number Q57147) (SEQ ID NO: 1128)

ORF62 (SEQ ID NO: 242) and HI0976 (SEQ ID NO: 1128) show 50% aa identity in 114aa overlap:

```
Orf62    1 MFYQILALIIWSSSFIAAKYVYGGIDPALMVGVRYXXXXXXXXXXXXCRRHVGKIPREEWKP   60
           M YQILAL+IWSSS I  K Y +DP L+V VR          R   KI +    K
HI0976   1 MLYQILALLIWSSSLIVGKLTYSMMDPVLVVQVRLIIAMIIVMPLFLRRWKKIDKPMRKQ    60

Orf62   61 LLIVSFVNYVLTLLLQFVGLKYTSAASASVIVGLEPLLMVFVGHFFFNDKARAY         114
           L ++F NY   LLQF+GLKYTSA+SA ++GLEPLL+VFVGHFFF K  +
HI0976  61 LWWLAFFNYTAVFLLQFIGLKYTSASSAVTMIGLEPLLVVFVGHFFFKTKQNGF         114
```

Homology with a Predicted ORF from *N.meningitidis* (Strain A)

ORF62 (SEQ ID NO: 242) shows 99.5% identity over a 216aa overlap with an ORF (ORF62a) (SEQ ID NO: 246) from strain A of *N. meningitidis*:

```
                    10         20         30         40         50         60
orf62.pep  MFYQILALIIWSSSFIAAKYVYGGIDPALMVGVRLLIAALPALPACRRHVGKIPREEWKP
           ||||||||||||||||||||||||||||||||||||||||||||||||||||||||||||
orf62a     MFYQILALIIWSSSFIAAKYVYGGIDPALMVGVRLLIAALPALPACRRHVGKIPREEWKP
                    10         20         30         40         50         60

70         80         90        100        110        120
orf62.pep  LLIVSFVNYVLTLLLQFVGLKYTSAASASVIVGLEPLLMVFVGHFFFNDKARAYHWICGA
           ||||||||||||||||||||||||||||||||||||||||||||||||||||||||||||
orf62a     LLIVSFVNYVLTLLLQFVGLKYTSAASASVIVGLEPLLMVFVGHFFFNDKARAYHWICGA
                    70         80         90        100        110        120

130        140        150        160        170        180
orf62.pep  AAFAGVALLMAGGAEEGGEVGWFGCLLVLLAGAGFCAAMRPTQRLIARIGAPAFTSVSIA
           ||||||||||||||||||||||||||||||||||||||||||||||||||||||||||||
orf62a     AAFAGVALLMAGGAEEGGEVGWFGCLLVLLAGAGFCAAMRPTQRLIARIGAPAFTSVSIA
                   130        140        150        160        170        180
```

```
                    -continued
               190        200       210
orf62.pep  AASLMCLPFSLALAQSYTVDWSVGMVLSLLYLGLGC
           |||||||||||||||||||||||||||||:||
orf62a     AASLMCLPFSLALAQSYTVDWSVGMVLSLLYLGVGCSWYAYWLWNKGMSRVPANVSGLLI
               190        200       210       220       230       240 orf62a     SLEPVVGVLLAVLILGEHLSPVSVLGVFVVIAATLVAGRLSHQKX
               250        260       270       280
```

The complete length ORF62a nucleotide sequence (SEQ ID NO: 245) is:

```
  1  ATGTTTTACC AAATCCTTGC CCTGATTATC TGGAGCAGCT CGTTTATTGC
 51  CGCCAAATAT GTCTATGGCG GCATCGATCC CGCATTGATG GTCGGCGTGC
101  GCCTGCTGAT TGCTGCGCTG CCTGCACTGC CCGCCTGCCG CCGTCATGTC
151  GGCAAGATTC CGCGTGAGGA ATGGAAGCCG TTGCTGATTG TGTCGTTCGT
201  CAACTATGTG CTGACCCTGC TACTTCAGTT TGTCGGGTTG AAATACACTT
251  CCGCCGCCAG CGCATCGGTC ATTGTCGGAC TCGAGCCACT GCTGATGGTG
301  TTTGTCGGAC ACTTTTTCTT CAACGACAAA GCGCGTGCCT ACCACTGGAT
351  ATGCGGCGCG GCGGCATTTG CCGGTGTCGC GCTGCTGATG GCGGGCGGTG
401  CGGAAGAGGG CGGCGAAGTC GGCTGGTTCG GCTGCCTGCT GGTGTTGTTG
451  GCGGGCGCGG GCTTTTGTGC CGCTATGCGT CCGACGCAAA GGCTGATTGC
501  ACGCATCGGC GCACCGGCAT TCACATCTGT TTCCATTGCC GCCGCATCGT
551  TGATGTGCCT GCCGTTTTCG CTTGCTTTGG CGCAAAGTTA TACCGTGGAC
601  TGGAGCGTCG GAATGGTATT GTCGCTGCTG TATTTGGGCG TGGGGTGCAG
651  CTGGTACGCC TATTGGCTGT GGAACAAGGG GATGAGCCGT GTTCCTGCCA
701  ACGTTTCGGG ACTGTTGATT TCGCTCGAAC CCGTCGTCGG CGTGCTGCTG
751  GCGGTTTTGA TTTTGGGCGA ACACCTGTCG CCCGTGTCCG TCTTGGGCGT
801  GTTTGTCGTC ATCGCCGCCA CCTTGGTTGC CGGCCGGCTG TCGCATCAAA
851  AATAA
```

This encodes a protein having amino acid sequence (SEQ ID NO: 246):

```
  1  MFYQILALII WSSSFIAAKY VYGGIDPALM VGVRLLIAAL PALPACRRHV
 51  GKIPREEWKP LLIVSFVNYV LTLLLQFVGL KYTSAASASV IVGLEPLLMV
101  FVGHFFFNDK ARAYHWICGA AAFAGVALLM AGGAEEGGEV GWFGCLLVLL
151  AGAGFCAAMR PTQRLIARIG APAFTSVSIA AASLMCLPFS LALAQSYTVD
201  WSVGMVLSLL YLGVGCSWYA YWLWNKGMSR VPANVSGLLI SLEPVVGVLL
251  AVLILGEHLS PVSVLGVFVV IAATLVAGRL SMQK*
```

ORF62a (SEQ ID NO: 246) and ORF62-1 (SEQ ID NO: 244) show 98.9% identity in 284 aa overlap:

```
orf62a.pep  MFYQILALIIWSSSFIAAKYVYGGIDPALMVGVRLLIAALPALPACRRHVGKIPREEWKP   60
            ||||||||||||||||||||||||||||||||||||||||||||||||||||||||||||
orf62-1     MFYQILALIIWSSSFIAAKYVYGGIDPALMVGVRLLIAALPALPACRRHVGKIPREEWKP   60
```

-continued

```
orf62a.pep  LLIVSFVNYVLTLLLQFVGLKYTSAASASVIVGLEPLLMVFVGHFFFNDKARAYHWICGA  120
            ||||||||||||||||||||||||||||||||||||||||||||||||||||||||||||
orf62-1     LLIVSFVNYVLTLLLQFVGLKYTSAASASVIVGLEPLLMVFVGHFFFNDKARAYHWICGA  120 orf62a.pep  AAFAGVALLMAGGAEEGGEVGWFGCLLVLLAGAGFCAAMRPTQRLIARIGAPAFTSVSIA  180
            ||||||||||||||||||||||||||||||||||||||||||||||||||||||||||||
orf62-1     AAFAGVALLMAGGAEEGGEVGWFGCLLVLLAGAGFCAAMRPTQRLIARIGAPAFTSVSIA  180 orf62a.pep  AASLMCLPFSLALAQSYTVDWSVGMVLSLLYLGVGCSWYAYWLWMKGMSRVPANVSGLLI  240
            |||||||||||||||||||||||||||||||||||:||:|||||||||||||||||||||
orf62-1     AASLMCLPFSLALAQSYTVDWSVGMVLSLLYLGLGCGWYAYWLWNKGMSRVPANVSGLLI  240 orf62a.pep  SLEPVVGVLLAVLILGEHLSPVSVLGVFVVIAATLVAGRLSHQKX                 285
            ||||||||||||||||||||||||||:|||||||||||||||||
orf62-1     SLEPVVGVLLAVLILGEHLSPVSALGVFVVIAATLVAGRLSHQKX                 285
```

15

Homology with a Predicted ORF from *N.gonorrhoeae*

ORF62 (SEQ ID NO: 242) shows 99.5% identity over a 216aa overlap with a predicted ORF (ORF62.ng) (SEQ ID NO: 248) from *N. gonorrhoeae*:

```
orf62.pep   MFYQILALIIWSSSFIAAKYVYGGIDPALMVGVRLLIAALPALPACRRHVGKIPREEWKP  60
            ||||||||||:|||||||||||||||||||||||||||||||||||||||||||||:|||
orf62ng     MFYQILALIIWGSSFIAAKYVYGGIDPALMVGVRLLIAALPALPACRRHVGKIPRERWKP  60 orf62.pep   LLIVSFVNYVLTLLLQFVGLKYTSAASASVIVGLEPLLMVFVGHFFFNDKARAYHWICGA  120
            ||||||||||||||||||||||||||||||||||||||||||||||||||||||||||||
orf62ng     LLIVSFVNYVLTLLLQFVGLKYTSAASASVIVGLEPLLMVFVGHFFFNDKARAYHWICGA  120 orf62.pep   AAFAGVALLMAGGAEEGGEVGWFGCLLVLLAGAGFCAAMRPTQRLIARIGAPAFTSVSIA  180
            ||||||||||||||||||||||||||||||||||||||||||||||||||||||||||||
orf62ng     AAFAGVALLMAGGAEEGGEVGWFGCLLVLLAGAGFCAAMRPTQRLIARIGAPAFTSVSIA  180 orf62.pep   AASLMCLPFSLALAQSYTVDWSVGMVLSLLYLGLGC                          216
            |||||||||||||||||||||||||||||||||||
orf62ng     AASLMCLPFSLALAQSYTVDWSVGMVLSLLYLGLGCGWYAYWLWNKGMSRVPANASGLLI  240
```

35

The complete length ORF62ng nucleotide sequence (SEQ ID NO: 247) is:

```
  1  ATGTTTTACC AAATCCTTGC CCTGATTATC TGGGGCAGCT CGTTTATTGC
 51  CGCCAAATAT GTCTATGGCG GCATCGATCC CGCATTGATG GTCGGCGTGC
101  GCCTGCTGAT TGCCGCGCTG CCTGCACTGC CCGCCTGCCG CCGTCATGTC
151  GGCAAGATTC CGCGTGAGGA ATGGAAGCCG TTGCTGATTG TGTCGTTCGT
201  CAACTATGTG CTGACCCTGC TGCTTCAGTT TGTCGGGTTG AAATACACTT
251  CCGCCGCCAG CGCATCGGTC ATTGTCGGAC TCGAGCCGCT GCTGATGGTG
301  TTTGTCGGAC ACTTTTTCTT CAACGACAAA GCGCGTGCCT ACCACTGGAT
351  ATGCGGCGCG GCGGCATTTG CCGGTGTCGC GCTGCTGATG GCGGGCGGTG
401  CGGAAGAGGG CGGCGAAGTC GGCTGGTTCG GCTGCCTGCT GGTGTTGTTG
451  GCGGGCGCGG GCTTTTGTGC CGCTATGCGT CCGACGCAAA GGCTGATTGC
501  CCGCATCGGC GCACCGGCAT TCACATCTGT TTCCATTGCC GCCGCATCGT
551  TGATGTGCCT GCCGTTTTCG CTTGCTTTGG CGCAAAGTTA TACCGTGGAC
601  TGGAGCGTCG GGATGGTATT GTCGCTGTTG TATTTGGGTT TGGGGTGCGG
651  CTGGTACGCC TATTGGCTGT GGAACAAGGG GATGAGCCGT GTTCCTGCCA
701  ACGCGTCGGG ACTGTTGATT TCGCTCGAAC CCGTCGTCGG CGTGCTGTTG
751  GCGGTTTTGA TTTTGGGCGA ACATTTATCG CCCGTGTCCG CCTTGGGCGT
```

```
801 GTTTGTCGTC ATCGCCGCCA CTTTCGCCGC CGGCCGGCTG TCGCGCAGGG

851 ACGCGCAAAA CGGCAATGCC GTCTGA
```

This encodes a protein having amino acid sequence (SEQ ID NO: 248):

```
  1 MFYQILALII WGSSFIAAKY VYGGIDPALM VGVRLLIAAL PALPACRRHV

51 GKIPREEWKP LLIVSFVNYV LTLLLQFVGL KYTSAASASV IVGLEPLLMV

101 FVGHFFFNDK ARAYHWICGA AAFAGVALLM AGGAEEGGEV GWFGCLLVLL

151 AGAGFCAAMR PTQRLIARIG APAFTSVSIA AASLMCLPFS LALAQSYTVD

201 WSVGMVLSLL YLGLGCGWYA YWLWNKGMSR VPANASGLLI SLEPVVGVLL

251 AVLILGEHLS PVSALGVFVV IAATFAAGRL SRRDAQNGNA V*
```

ORF62ng (SEQ ID NO: 248) and ORF62-1 (SEQ ID NO: 244) show 97.9% identity in 283 aa overlap:

```
                  10         20         30         40         50         60
orf62ng.pep MFYQILALIIWGSSFIAAKYVYGGIDPALMVGVRLLIAALPALPACRRHVGKIPREEWKP
            ||||||||||:|||||||||||||||||||||||||||||||||||||||||||||||||
orf62-1     MFYQILALIIWSSSFIAAKYVYGGIDPALMVGVRLLIAALPALPACRRHVGKIPREEWKP
                  10         20         30         40         50         60

70         80         90        100        110        120
orf62ng.pep LLIVSFVNYVLTLLLQFVGLKYTSAASASVIVGLEPLLMVFVGHFFFNDKARAYHWICGA
            ||||||||||||||||||||||||||||||||||||||||||||||||||||||||||||
orf62-1     LLIVSFVNYVLTLLLQFVGLKYTSAASASVIVGLEPLLMVFVGHFFFNDKARAYHWICGA
                  70         80         90        100        110        120

130        140        150        160        170        180
orf62ng.pep AAFAGVALLMAGGAEEGGEVGWFGCLLVLLAGAGFCAAMRPTQRLIARIGAPAFTSVSIA
            ||||||||||||||||||||||||||||||||||||||||||||||||||||||||||||
orf62-1     AAFAGVALLMAGGAEEGGEVGWFGCLLVLLAGAGFCAAMRPTQRLIARIGAPAFTSVSIA
                 130        140        150        160        170        180

190        200        210        220        230        240
orf62ng.pep AASLMCLPFSLALAQSYTVDWSVGMVLSLLYLGLGCGWYAYWLWNKGMSRVPANASGLLI
            |||||||||||||||||||||||||||||||||||||||||||||||||||||:||||
orf62-1     AASLMCLPFSLALAQSYTVDWSVGMVLSLLYLGLGCGWYAYWLWNKGMSRVPANVSGLLI
                 190        200        210        220        230        240

250        260        270        280        290
orf62ng.pep SLEPVVGVLLAVLILGEHLSPVSALGVFVVIAATFAAGRLSRRDAQNGNAVX
            |||||||||||||||||||||||||||||||||::||||::
orf62-1     SLEPVVGVLLAVLILGEHLSPVSALGVFVVIAATLVAGRLSHQKX
                 250        260        270        280
```

Furthermore, ORF62ng (SEQ ID NO: 248) shows significant homology to a hypothetical *H.influenzae* protein (SEQ ID NO: 1128):

```
sp|Q57147|Y976_HAEIN HYPOTHETICAL PROTEIN HI0976 )gi|1074589|pir||B64163
hypothetical protein HI0976 - Haemophilus influenzae (strain Rd KW20)
)gi|1574004 (U32778) hypothetical [Haemophilus influenzae] Length = 128
Score = 106 bits (262), Expect = 2e-22
Identities = 56/114 (49%), Positives = 68/114 (59%)

Query:   1 MFYQILALIIWGSSFIAAKYVYGGIDPALMVGVRXXXXXXXXXXXXCRRHVGKIPREEWKP 60
           M YQILAL+IW SS I   K Y +DP L+V VR            R  KI +   K
Sbjct:   1 MLYQILALLIWSSSLIVGKLTYSMMDPVLVVQVRLIIAMIIVMPLFLRRWKKIDKPMRKQ 60

Query:  61 LLIVSFVNYVLTLLLQFVGLKYTSAASASVIVGLEPLLMVFVGHFFFNDKARAY 114
           L  ++F NY   LLQF+GLKYTSA+SA  ++GLEPLL+VFVGHFFF K   +
Sbjct:  61 LWWLAFFNYTAVFLLQFIGLKYTSASSAVTMIGLEPLLVVFVGHFFFKTKQNGF 114
```

Based on this analysis, including the homology with the transmembrane protein (SEQ ID NO: 1128) of *H.influenzae* and the putative leader sequence and several transmembrane domains in the gonococcal protein, it is predicted that these proteins from *N.meningitidis* and *N.gonorrhoeae*, and their epitopes, could be useful antigens for vaccines or diagnostics, or for raising antibodies.

Example 30

The following partial DNA sequence was identified in *N.meningitidis* (SEQ ID NO: 249):

```
   1 ATGCGCCCTT TTCTACCGAT CGCAGCCATA TGCGCmGwms TCCTGkkGTA
  51 sGGACTGACG GCGGCAACCG GCAGCACCAG TTCGCTGGCG GATTATTTCT
 101 GGTGGATTGT TGCGTTCAGC GCAATGCTGC TGCTGGTGTT GTCCGCCGTT
 151 TTGGCACGTT ATGTCATATT GCTGTTGAAA GACAGGCGCG ACGGCGTATT
 201 CGGTTCGCtA srTyGCCAAA gsGCCTgkks TGGG.ATGTT TACGCTGGTT
 251 GCCGkACTGC CCGGCGTGTT TCTGTTCGGC TTTCCCGCAC AGTTCATCAA
 301 CGGCACGATT AATTCGTGGT TCGGCAACGA TACCCACGAG GCGCTTGAAC
 351 GCAGCCTCAA TTTGAGCAAG TCCGCATTGA ATTTGGCGGC AGACAACGCC
 401 CTCGGCAACG CCGTCCCCGT GCAGATAGAC CTCATCGGCG CGGCTTCCCT
 451 GCCCGGGGAT ATGGGCAGGG TGCTGGAACA TTACGCCGGC AGCGGTTTTG
 501 CCCAGCTTGC CCTGTACAAy ksCGCAAGCG GCAAAATCGA AAAAAGCATC
 551 AACCCGCACA AGCTCGATCA GCCGTTTCCA GGTAAGGCGC GTTGGGAaAa
 601 AATCCaACGG GCGGGTTCGG TCAGGGATTT GGAAAGCATA GGCGGCGTAT
 651 TGTaCGCGCA GGGCTGGCTG TCGGCGGGTA CGCACWACGG GCGCGATTAC
 701 GCCTTGTTTT TCCGTCAGCC GGTTCCCAAA GGCGTGGCAG AGGATGCCGT
 751 yTTAATCGAA AAGGCAAGGG CGAAATATGC TGAGTTGAGT TACAGCAAAA
 801 AAGGTTTGCA GACCTTTTTC CTGGCAACCC TGCTGATTGC CTCGCTGCTG
 851 TCGATTTTTC TTGCACTGGT CATGGCACTG TATTTCGCCC GCCGTTTCGT
 901 CGAACCCGTC CTATCGCTTG CCGAGGGGGC GAAGGCGGTG GCGCAAGGCG
 951 ATTTCAGCCA GACGCGCCCC GTGTTGCGCA ACGACGAGTT CGGACGCTTG
1001 ACCArGTTGT TCAACCACAT GACCGAGCAG CTTTCCATCG CCAAAGATGC
1051 AGACGAGCGC AACCGCCGGC GCGAGGAAGC CGCCAGGCAT TATCTTGAAT
1101 GCGTGTTGGA GGGGCTGACC ACGGGCGTGG TGGTGTTTGA CGAACAAGGC
1151 TGTCTGAAAA CCTTCAACAA AGCGGCGGGT ACC..
```

This corresponds to the amino acid sequence (SEQ ID NO: 250; ORF64):

```
  1 MRRFLPIAAI CAXXLXXGLT AATGSTSSLA DYFWWIVAFS AMLLLVLSAV
 51 LARYVILLLK DRRDGVFGSX XAKXPXXXMF TLVAXLPGVF LFGFPAQFIN
101 GTINSWFGND THEALERSLN LSKSALNLAA DNALGNAVPV QIDLIGAASL
151 PGDMGRVLEH YAGSGFAQLA LYNXASGKIE KSINPHKLDQ PFPGKARWEK
201 IQRAGSVRDL ESIGGVLYAQ GWLSAGTHXG RDYALFFRQP VPKGVAEDAV
251 LIEKARAKYA ELSYSKKGLQ TFFLATLLIA SLLSIFLALV MALYFARRFV
301 EPVLSLAEGA KAVAQGDFSQ TRPVLRNDEF GRLTXLFNHM TEQLSIAKDA
351 DERNRRREEA ARHYLECVLE GLTTGVVVFD EQGCLKTFNK AAGT..
```

Further work revealed the complete nucleotide sequence (SEQ ID NO: 251):

```
   1  ATGCGCCGTT TTCTACCGAT CGCAGCCATA TGCGCCGTCG TCCTGTTGTA
  51  CGGACTGACG GCGGCAACCG GCAGCACCAG TTCGCTGGCG GATTATTTCT
 101  GGTGGATTGT TGCGTTCAGC GCAATGCTGC TGCTGGTGTT GTCCGCCGTT
 151  TTGGCACGTT ATGTCATATT GCTGTTGAAA GACAGGCGCG ACGGCGTATT
 201  CGGTTCGCAG ATTGCCAAAC GCCTTTCTGG GATGTTTACG CTGGTTGCCG
 251  TACTGCCCGG CGTGTTTCTG TTCGGCGTTT CCGCACAGTT CATCAACGGC
 301  ACGATTAATT CGTGGTTCGG CAACGATACC CACGAGGCGC TTGAACGCAG
 351  CCTCAATTTG AGCAAGTCCG CATTGAATTT GGCGGCAGAC AACGCCCTCG
 401  GCAACGCCGT CCCCGTGCAG ATAGACCTCA TCGGCGCGGC TTCCCTGCCC
 451  GGGGATATGG GCAGGGTGCT GGAACATTAC GCCGGCAGCG GTTTTGCCCA
 501  GCTTGCCCTG TACAATGCCG CAAGCGGCAA AATCGAAAAA AGCATCAACC
 551  CGCACAAGCT CGATCAGCCG TTTCCAGGTA AGGCGCGTTG GGAAAAAATC
 601  CAACGGGCGG GTTCGGTCAG GGATTTGGAA AGCATAGGCG GCGTATTGTA
 651  CGCGCAGGGC TGGCTGTCGG CGGGTACGCA CAACGGGCGC GATTACGCCT
 701  TGTTTTTCCG TCAGCCGGTT CCCAAAGGGG TGGCAGAGGA TGCCGTCTTA
 751  ATCGAAAAGG CAAGGGCGAA ATATGCTGAG TTGAGTTACA GCAAAAAAGG
 801  TTTGCAGACC TTTTTCCTGG CAACCCTGCT GATTGCCTCG CTGCTGTCGA
 851  TTTTTCTTGC ACTGGTCATG GCACTGTATT TCGCCCGCCG TTTCGTCGAA
 901  CCCGTCCTAT CGCTTGCCGA GGGGCGAAG GCGGTGGCGC AAGGCGATTT
 951  CAGCCAGACG CGCCCCGTGT TGCGCAACGA CGAGTTCGGA CGCTTGACCA
1001  AGTTGTTCAA CCACATGACC GAGCAGCTTT CCATCGCCAA AGAAGCAGAC
1051  GAGCGCAACC GCCGGCGCGA GGAAGCCGCC AGGCATTATC TTGAATGCGT
1101  GTTGGAGGGG CTGACCACGG GCGTGGTGGT GTTTGACGAA CAAGGCTGTC
1151  TGAAAACCTT CAACAAAGCG GCGGAACAGA TTTTGGGGAT GCCGCTTACC
1201  CCCCTGTGGG CAGCAGCCG GCACGGTTGG CACGGCGTTT CGGCGCAGCA
1251  GTCCCTGCTT GCCGAAGTGT TTGCCGCCAT CGGCGCGGCG GCAGGTACGG
1301  ACAAACCGGT CCATGTGAAA TATGCCGCGC CGGACGATGC CAAAATCCTG
1351  CTGGGCAAGG CAACCGTCCT GCCCGAAGAC AACGGCAACG GCGTGGTAAT
1401  GGTGATTGAC GACATCACCG TTTTGATACA CGCGCAAAAA GAAGCCGCGT
1451  GGGGCGAAGT GGCGAAGCGG CTGGCACACG AAATCCGCAA TCCGCTCACG
1501  CCCATCCAGC TTTCCGCCGA ACGGCTGGCG TGGAAATTGG GCGGGAAGCT
1551  GGATGAGCAG GATGCGCAAA TCCTGACGCG TTCGACCGAC ACCATCGTCA
1601  AACAGGTGGC GGCATTGAAG GAAATGGTCG AAGCATTCCG CAATTATGCG
1651  CGTTCCCCTT CGCTCAAATT GGAAAATCAG GATTTGAACG CCTTAATCGG
1701  CGATGTGTTG GCATTGTATG AAGCCGGTCC GTGCCGGTTT GCGGCGGAGC
1751  TTGCCGGCGA ACCGCTGACG GTGGCGGCGG ATACGACCGC CATGCGGCAG
1801  GTGCTGCACA ATATTTTCAA AAATGCCGCC GAAGCGGCGG AAGAAGCCGA
1851  TGTGCCCGAA GTCAGGGTAA AATCGGAAAC AGGGCAGGAC GGTCGGATTG
```

-continued

```
1901  TCCTGACGGT TTGCGACAAC GGCAAAGGGT TCGGCAGGGA AATGCTGCAC

1951  AACGCCTTCG AGCCGTATGT AACGGACAAA CCGGCGGGAA CGGGATTGGG

2001  TCTGCCTGTG GTGAAAAAAA TCATTGAAGA ACACGGCGGC CGCATCAGCC

2051  TGAGCAATCA GGATGCGGGT GGCGCGTGTG TCAGAATCAT CTTGCCAAAA

2101  ACGGTAAAAA CTTATGCGTA G
```

This corresponds to the amino acid sequence (SEQ ID NO: 252; ORF64-1):

```
  1  MRRFLPIAAI CAVVLLYGLT AATGSTSSLA DYFWWIVAFS AMLLLVLSAV

51  LARYVILLLK DRDDGVFGSQ IAKRLSGMFT LVAVLPGVFL FGVSAQFING

101  TINSWFGNDT HEALERSLNL SKSALNLAAD NALGNAVPVQ IDLIGAASLP

151  GDMGRVLEHY AGSGFAQLAL YNAASGKIEK SINPHKLDQP FPGKARWEKI

201  QRAGSVRDLE SIGGVLYAQG WLSAGTHNGR DYALFFRQPV PKGVAEDAVL

251  IEKARAKYAE LSYSKKGLQT FFLATLLIAS LLSIFLALVM ALYFARRFVE

301  PVLSLAEGAK AVAQGDFSQT RPVLRNDEFG RLTKLFNHMT EQLSIAKEAD

351  ERNRRREEAA RHYLECVLEG LTTGVVVFDE QGCLKTFNKA AEQILGMPLT

401  PLWGSSRHGW HGVSAQQSLL AEVFAAIGAA AGTDKPVHVK YAAPDDAKIL

451  LGKATVLPED NGNGVVMVID DITVLIHAQK EAAWGEVAKR LAHEIRNPLT

501  PIQLSAERLA WKLGGKLDEQ DAQILTRSTD TIVKQVAALK EMVEAFRNYA

551  RSPSLKLENQ DLNALIGDVL ALYEAGPCRF AAELAGEPLT VAADTTAMRQ

601  VLMNIFKNAA EAAEEADVPE VRVKSETGQD GRIVLTVCDN GKGFGREMLH

651  NAFEPYVTDK PAGTGLGLPV VKKIIEEHGG RISLSNQDAG GACVRIILPK

701  TVKTYA*
```

Computer analysis of this amino acid sequence gave the following results:
Homology with a Predicted ORF from N.meningitidis (Strain A)

ORF64 (SEQ ID NO: 250) shows 92.6% identity over a 392aa overlap with an ORF (ORF64a) (SEQ ID NO: 254) from strain A of N. meningitidis:

```
                      10         20         30         40         50         60
orf64.pep  MRRFLPIAAICAXXLXXGLTAATGSTSSLADYFWMIVAFSAMLLLVLSAVLARYVILLLK
           ||||||||||| |  ||||||||||||||||||||||||||||||||||||||||||||
orf64a     MRRFLPIAAICAVVLLYGLTAATGSTSSLADYFWMIVAFSAMLLLVLSAVLARYVILLLK
                      10         20         30         40         50         60

70         80         90        100        110        120
orf64.pep  DRDDGVFGSXXAKXPXXXMFTLVAXLPGVFLFGFPAQFINGTINSWFGNDTHEALERSLN
           |||||||||  ||      ||||| |||||||||  ||||||||||||||||||||||||
orf64a     DRRGGVFGSQIAKR-LSGMFTLVAVLPGVFLFGVSAQFINGTINSWFGNDTHEALERSLN
                      70         80         90        100        110

130        140        150        160        170        180
orf64.pep  LSKSALNLAADNALGNAVPVQIDLIGAASLPGDMGRVLEHYAGSGFAQLALYNXASGKIE
           ||||||||||||||||| :|||||  |||||| |||||||||||||||||||||  ||||||
orf64a     LSKSALNLAADNALGNAIPVQIDXIGAASLPXDMGRVLEHYAGSGFAQLALYNAASGKIE
                     120        130        140        150        160        170        180

190        200        210        220        230        240
orf64.pep  KSINPHKLDQPFPGKARWEKIQRAGSVRDLESIGGVLYAQGWLSAGTHXGRDYALFFRQP
           ||||||||||||||||||||||:|||||| |||||||| ||||| || ||||||||||||
orf64a     KSINPHKLDQPFPGKARWEKIQQAGSVRDXESIGGVLYAXGWLSAXTHNGRDYALFFRQP
                     180        190        200        210        220        230
```

```
                   -continued
              250        260        270        280        290        300
orf64.pep  VPKGVAEDAVLIEKARAKYAELSYSKKGLQTFFFLATLLIASLLSIFLALVMALYFARRFV
           ||||||||||||||||        ||||||||||||||||||||||||||||||||||||
orf64a     VPKGVAEDAVLIEKDRAXXXXLSYSKKGLQTFFLATLLIASLLSIFLALVMALYFARRFV
              240        250        260        270        280        290

310        320        330        340        350        360
orf64.pep  EPVLSLAEGAKAVAQGDFSQTRPVLRNDEFGRLTXLFNHMTEQLSIAKDADERNRRREEA
           ||||||||||||||||||||||||||||||||||| |||||||||||||||:||||||||
orf64a     EPVLSLAEGAKAVAQGDFSQTRPVLRNDEFGRLTKLFNHMTEQLSIAKEADERNRRREEA
              300        310        320        330        340        350

370        380        390
orf64.pep  ARHYLECVLEGLTTGVVVFDEQGCLKTFNKAAGT
           ||||||||||||||||||||||||||||||||
orf64a     ARHYLECVLEGLTTGVVVFDEQGCLKTFNKAAEQILGMPLTPLWGSSRHGWHGVSAQQSL
              360        370        380        390        400        410 orf64a     LAEVFAAIGAAAGTDKPVHVKYAAPDDAKILLGKATVLPEDNXNGVVMVIDDITVLIHAQ
              420        430        440        450        460   470
```

The complete length ORF64a nucleotide sequence (SEQ ID NO: 253) is:

```
   1  ATGCGCCGTT TTCTACCGAT CGCAGCCATA TGCGCCGTCG TCCTGTTGTA
  51  CGGACTGACG GCGGCAACCG GCAGCACCAG TTCGCTGGCG GATTATTTCT
 101  GGTGGATTGT TGCGTTCAGC GCAATGCTGC TGCTGGTGTT GTCCGCCGTT
 151  TTGGCACGTT ATGTCATATT GCTGTTGAAA GACAGGCGCG ACGGCGTATT
 201  CGGTTCGCAG ATTGCCAAAC GCCTTTCCGG GATGTTTACG CTGGTTGCCG
 251  TACTGCCCGG CGTGTTTCTG TTCGGCGTTT CCGCACAGTT TATCAACGGC
 301  ACGATTAATT CGTGGTTCGG CAACGATACC CACGAGGCGC TTGAACGCAG
 351  CCTCAATTTG AGCAAGTCCG CATTGAATCT GGCGGCAGAC AACGCCCTTG
 401  GCAACGCCAT CCCCGTGCAd ATAGACNTCA TCGGCGCGGC TTCCCTGCCC
 451  NGGGATATGG GCAGGGTGCT GGAACATTAC GCCGGCAGCG GTTTTGCCCA
 501  GCTTGCCCTG TACAATGCCG CAAGCGGCAA AATCGAAAAA AGCATCAACC
 551  CGCACAAGCT CGATCAGCCG TTTCCAGGTA AGGCGCGTTG GGAAAAAATC
 601  CAACAGGCGG GTTCGGTCAG GGATNNGGAA AGCATAGGCG GCGTATTGTA
 651  CGCGCANGGC TGGCTGTCGG CAGNNACGCA CAACGGGCGC GATTACGCCT
 701  TGTTTTTCCG TCAGCCGGTT CCCAAAGGCG TGGCAGAGGA TGCCGTCTTA
 751  ATCGAAAAGG CAAGGGCGNA ANANNNTNAG TTGAGTTACA GCAAAAAAGG
 801  TTTGCAGACC TTTTTCCTNG CAACCCTGCT GATTGCCTCN CTGCTGTCGA
 851  TTTTTCTTGC ACTGGTCATG GCACTGTATT TCGCCCGCCG TTTCGTCGAA
 901  CCCGTCCTAT CGCTTGCCGA GGGGGCGAAG GCGGTGGCGC AAGGCGATTT
 951  CAGCCAGACG CGCCCCGTGT TGCGCAACGA CGAGTTCGGA CGCTTGACCA
1001  AGTTGTTCAA CCACATGACC GAGCAGCTTT CCATCGCCAA AGAAGCAGAC
1051  GAGCGCAACC GCCGGCGCGA GGAAGCCGCC AGACATTATC TCGAATGCGT
1101  GTTGGAGGGG CTGACCACGG GCGTGGTGGT GTTTGACGAA CAAGGCTGTC
1151  TGAAAACCTT CAACAAAGCG GCGGAACAGA TTTTGGGGAT GCCGCTTACC
1201  CCCCTGTGGG GCAGCAGCCG GCACGGTTGG CACGGCGTTT CGGCGCAGCA
1251  GTCCCTGCTT GCCGAAGTGT TTGCCGCCAT CGGCGCGGCG GCAGGTACGG
```

-continued

```
1301  ACAAACCGGT CCATGTGAAA TATGCCGCGC CGGACGATGC CAAAATCCTG

1351  CTGGGCAAGG CAACCGTCCT GCCCGAAGAC AACNGCAACG GCGTGGTAAT

1401  GGTGATTGAC GACATCACCG TTTTGATACA CGCGCAAAAA GAAGCCGCGT

1451  GGGGCGAAGT GGCAAAACGG CTGGCACACG AAATCCGCAA TCCGCTCACG

1501  CCCATCCAGC TTTCTGCCGA ACGGCTGGCG TGGAAATTGG GCGGGAAGCT

1551  GGACGAGCAN GACGCGCAAA TCCTGACACG TTCGACCGAC ACCATCATCA

1601  AACAAGTGGC GGCATTAAAA GAAATGGTCG AGGCATTCCG CAATTACNCG

1651  CGTTCCCCTT CGNCTCAATT GGAAAATCAG GATTTGAACG CCTTAATCGG

1701  CGATGTGTTG GCATTGTACG AAGCTGGTCC GTGCCGGTTT GCGGCGGAAC

1751  TTGCCGGCGA ACCGCTGATG ATGGCGGCGG ATACGACCGC CATGCGGCAG

1801  GTGCTGCACA ATATTTTCAA AAATGCCGCC GAAGCGGCGG AAGAAGCCGA

1851  TGTGCCCGAA GTCAGGGTAA ATCGGAAGC GGGGCAGdAC GGACGGATTG

1901  TCCTGACAGT TTGCGACAAC GGCAAGGGGT TCGGCAGGGA AATGCTGCAC

1951  AATGCCTTCG AGCCGTATGT AACGGACAAA CCGGCTGGAA CGGGATTGNG

2001  ACTGCCCGTG GTGAAAAAAA TCATTGAAGA ACACGGCGGC CNCATCAGCC

2051  TGAGCAATCA GGATGCGGGC GGCGCGTNTG TCAGAATCAT CTTGCCAAAA

2101  ACGGTACAAA CTTATGCGTA G
```

This encodes a protein having amino acid sequence (SEQ ID NO: 254):

```
  1  MRRFLPIAAI CAVVLLYGLT AATGSTSSLA DYFWWIVAFS AMLLLVLSAV

51  LARYVILLLK DRRDGVFGSQ IAKRLSGMFT LVAVLPGVFL FGVSAQFING

101  TINSWFGNDT HEALERSLNL SKSALNLAAD NALGNAIPVQ IDXIGAASLP

151  XDMGRVLEHY AGSGFAQLAL YNAAEGKIEK SINPHKLDQP FPGKARWEKI

201  QQAGSVRDXE SIGGVLYAXG WLSAXTHNGR DYALFFRQPV PKGVAEDAVL

251  IEKARAXXXX LSYSKKGLQT FFLATLLIAS LLSIPLALVM ALYFARRFVE

301  PVLSLAEGAK AVAQGDFSQT RPVLRNDEFG RLTKLFNHMT EQLSIAKEAD

351  ERNRRREEAA RHYLECVLEG LTTGVVVFDE QGCLKTFNKA AEQILGMPLT

401  PLWGSSRHGW HGVSAQQSLL AEVFAAIGAA AGTDKPVHVK YAAPDDAKIL

451  LGKATVLPED NXNGVVMVID DITVLIHAQK EAAWGEVAKR LAHEIRNPLT

501  PIQLSAERLA WKLGGKLDEX DAQILTRSTD TIIKQVAALK EMVEAFRNYX

551  RSPSXQLENQ DLNALIGDVL ALYEAGPCRF AAELAGEPLM MAADTTAMRQ

601  VLHNIFKNAA EAAEEADVPE VRVKSEAGQD GRIVLTVCDN GKGFGREMLH

651  NAFEPYVTDK PAGTGLXLPV VKKIIEEHGG XISLSNQDAG GAXVRIILPK

701  TVETYA*
```

ORF64a (SEQ ID NO: 254) and ORF64-1 (SEQ ID NO: 252) show 96:6% identity in 706 aa overlap:

```
                  10        20        30        40        50        60
orf64a.pep  MRRFLPIAAICAVVLLYGLTAATGSTSSLADYFWWIVAFSAMLLLVLSAVLARYVILLLK
            ||||||||||||||||||||||||||||||||||||||||||||||||||||||||||||
orf64-1     MRRFLPIAAICAVVLLYGLTAATGSTSSLADYFWWIVAFSAMLLLVLSAVLARYVILLLK
                  10        20        30        40        50        60
```

-continued

```
                70        80        90       100       110       120
orf64a.pep  DRRDGVFGSQIAKRLSGMFTLVAVLPGVFLFGVSAQFINGTINSWFGNDTHEALERSLNL
            ||||||||||||||||||||||||||||||||||||||||||||||||||||||||||||
orf64-1     DRRDGVFGSQIAKRLSGMFTLVAVLPGVFLFGVSAQFINGTINSWFGNDTHEALERSLNL
                70        80        90       100       110       120

130       140       150       160       170       180
orf64a.pep  SKSALNLAADNALGNAIPVQIDXIGAASLPXDMGRVLEHYAGSGFAQLALYNAASGKIEK
            ||||||||||||||||:|||||  ||||||  ||||||||||||||||||| |||||||
orf64-1     SKSALNLAADNALGNAVPVQIDLIGAASLPGDMGRVLEHYAGSGFAQLALYAAASGKIEK
               130       140       150       160       170       180

190       200       210       220       230       240
orf64a.pep  SINPHKLDQPFPGKARWEKIQQAGSVRDXESIGGVLYAXGWLSAXTHNGRDYALFFRQPV
            |||||||||||||||||||||:||||| |||||||||| ||||| |||||||||||||||
orf64-1     SINPHKLDQPFPGKARWEKIQRAGSVRDLESIGGVLYAQGWLSAGTHNGRDYALFFRQPV
               190       200       210       220       230       240

250       260       270       280       290       300
orf64a.pep  PKGVAEDAVLIEKARAXXXXLSYSKKGLQTFFLATLLIASLLSIFLALVMALYFARRFVE
            |||||||||||||||||   ||||||||||||||||||||||||||||||||||||||||
orf64-1     PKGVAEDAVLIEKARAKYAELSYSKKGLQTFFLATLLIASLLSIFLALVMALYFARRFVE
               250       260       270       280       290       300

310       320       330       340       350       360
orf64a.pep  PVLSLAEGAKAVAQGDFSQTRPVLRNDEFGRLTKLFNHMTEQLSIAKEADERNRRREEAA
            ||||||||||||||||||||||||||||||||||||||||||||||||||||||||||||
orf64-1     PVLSLAEGAKAVAQGDFSQTRPVLRNDEFGRLTKLFNHMTEQLSIAKEADERNRRREEAA
               310       320       330       340       350       360

370       380       390       400       410       420
orf64a.pep  RHYLECVLEGLTTGVVVFDEQGCLKTFNKAAEQILGMPLTPLWGSSRHGWHGVSAQQSLL
            ||||||||||||||||||||||||||||||||||||||||||||||||||||||||||||
orf64-1     RHYLECVLEGLTTGVVVFDEQGCLKTFNKAAEQILGMPLTPLWGSSRHGWHGVSAQQSLL
               370       380       390       400       410       420

430       440       450       460       470       480
orf64a.pep  AEVFAAIGAAAGTDKPVHVKYAAPDDAKILLGKATVLPEDNXNGVVMVIDDITVLIHAQK
            ||||||||||||||||||||||||||||||||||||||||||| ||||||||||||||||
orf64-1     AEVFAAIGAAAGTDKPVHVKYAAPDDAKILLGKATVLPEDNGNGVVMVIDDITVLIHAQK
               430       440       450       460       470       480

490       500       510       520       530       540
orf64a.pep  EAAWGEVAKRLAHEIRNPLTPIQLSAERLAWKLGGKLDEXDAQILTRSTDTIIKQVAALK
            |||||||||||||||||||||||||||||||||||||| ||||||||||||:||||||||
orf64-1     EAAWGEVAKRLAHEIRNPLTPIQLSAERLAWKLGGKLDEQDAQILTRSTDTIVKQVAALK
               490       500       510       520       530       540

550       560       570       580       590       600
orf64a.pep  EMVEAFRNYXRSPSXQLENQDLNALIGDVLALYEAGPCRFAAELAGEPLMMAADTTAMRQ
            |||||||||:||||  ||||||||||||||||||||||||||||||||||:|||||||||
orf64-1     EMVEAFRNYARSPSLKLENQDLNALIGDVLALYEAGPCRFAAELAGEPLTVAADTTAMRQ
               550       560       570       580       590       600

610       620       630       640       650       660
orf64a.pep  VLHNIFKNAAEAAEEADVPEVRVKSEAGQDGRIVLTVCDNGKGFGREMLHNAFEPYVTDK
            |||||||||||||||||||||||||:|||||||||||||||||||||||||||||||||
orf64-1     VLHNIFKNAAEAAEEADVPEVRVKSETGQDGRIVLTVCDNGKGFGREMLHMAFEPYVTDK
               610       620       630       640       650       660

670       680       690       700
orf64a.pep  PAGTGLXLPVVKKIIEEHGGXISLSNQDAGGAXVRIILPKTVETYAX
            ||||||  |||||||||||| |||||||||||:|||||||||:|||
orE64-1     PAGTGLGLPVVKKIIEEHGGRISLSNQDAGGACVRIILPKTVKTYAX
               670       680       690       700
```

55

Homology with a Predicted ORF from *N. gonorrhoeae*

ORF64 (SEQ ID NO: 250) shows 86.6% identity over a 387aa overlap with a predicted ORF (ORF64.ng) (SEQ ID NO: 256) from *N. gonorrhoeae*:

```
orf64.pep  MRRFLPIAAICAXXLXXGLTAATGSTSSLADYFWWIVAFSAMLLLVLSAVLARYVILLLK  60
           ||||||||||  |   ||||||||||||||||||||||||:|||||||||||||||||||
orf64ng    MRRFLPIAAICAVVLLYGLTAATGSTSSLADYFWWIVSFSAMLLLVLSAVLARYVILLLK  60
```

-continued

```
orf64.pep  DRRDGVFGSXXAKXPXXXMFTLVAXLPGVFLFGFPAQFINGTINSWFGNDTHEALERSLN  120
           |||:||||| ||     |||||  |||:||||: |||||||||||||||||||||||||
orf64ng    DRRNGVFGSQIAKR-LSGMFTLVAVLPGLFLFGISAQFINGTINSWFGNDTHEALERSLN  119 orf64.pep  LSKSALNLAADNALGNAVPVQIDLIGAASLPGDMGRVLEHYAGSGFAQLALYNXASGKIE  180
           ||||||:||||::|||||||||||||:|||  |:|| |||||||||||||||  ||||||
orf64ng    LSKSALDLAADNAVSNAVPVQIDLIGTASLSGNMGSVLEHYAGSGPAQLALYNAASGKIE  179 orf64.pep  KSINPHKLDQPFPGKARWEKIQRAGSVRDLESIGGVLYAQGWLSAGTHXGRDYALFFRQP  240
           ||||||::|||:| | :||:||::||||:|||||||||||||||||| ||||||||||||
orf64ng    KSINPHQFDQPLPDKEHWEQIQQTGSVRSLESIGGVLYAQGWLSAGTHNGRDYALFFRQP  239 orf64.pep  VPKGVAEDAVLIEKARAKYAELSYSKKGLQTFFLATLLIASLLSIFLALVMALYFARRFV  300
           :|::||:|||||||||||||||||||||||||||:|||||||||||||||||||||||||
orf64ng    IPENVAQDAVLIEKARAKYAELSYSKKGLQTFFLVTLLIASLLSIFLALVMALYFARRFV  299 orf64.pep  EPVLSLAEGAKAVAQGDFSQTRPVLRNDEFGRLTXLFNHMTEQLSIAKDADERNRRREEA  360
           ||:|||||||||||||||||||||||||||||| ||||||||||||||:|||||||||||
orf64ng    EPILSLAEGAKAVAQGDFSQTRPVLRNDEFGRLTKLFNHMTEQLSIAKEADERNRRREEA  359 orf64.pep  ARHYLECVLEGLTTGVVVFDEQGCLKTFNKAAGT  394
           ||||||||||:||||||||    :|:|
orf64ng    ARHYLECVLDGLTTGVVVSYPLSCCRTAVFSTCHSSPLSYF  400
```

An ORF64ng nucleotide sequence (SEQ ID NO: 255) was predicted to encode a protein having amino acid sequence (SEQ ID NO: 256):

```
  1  MRRFLPIAAI CAVVLLYGLT AATGSTSSLA DYFWWIVSFS AMLLLVLSAV

51  LARYVILLLK DRRNGVFGSQ IAKRLSGMFT LVAVLPGLFL FGISAQFING

101  TINSWFGNDT HEALERSLNL SKSALDLAAD NAVSNAVPVQ IDLIGTASLS

151  GNMGSVLEHY AGSGFAQLAL YNAASGKIEK SINPHQFDQP LPDKEHWEQI

201  QQTGSVRSLE SIGGVLYAQG WLSAGTHNGR DYALFFRQPI PENVAQDAVL

251  IEKARAKYAE LSYSKKGLQT FFLVTLLIAS LLSIFLALVM ALYFARRFVE

301  PILSLAEGAK AVAQGDFSQT RPVLRNDEFG RLTKLFNHMT EQLSIAKEAD

351  ERNRRREEAA RHYLECVLDG LTTGVVVSYP LSCCRTAVFS TCHSSPLSYF*
```

Further work revealed the complete gonococcal DNA sequence (SEQ ID NO: 257):

```
  1  ATGCGCCGCT TCCTACCGAT CGCAGCCATA TGCGCCGTCG TCCTGCTGTA

51  CGGATTGACG GCGGCGACCG GCAGCACCAG TTCGCTGGCG GATTATTTCT

101  GGTGGATAGT CTCGTTCAGC GCAATGCTGC TGCTGGTGTT GTCCGCCGTT

151  TTGGCACGTT ATGTCATATT GCTGTTGAAA GACAGGCGCA ACGGCGTGTT

201  CGGTTCGCAG ATTGCCAAAC GCCTTTCCGG GATGTTCACG CTGGTCGCCG

251  TACTGCCCGG CTTGTTCCTG TTCGGCATTT CCGCGCAGTT TATCAACGGC

301  ACGATTAATT CGTGGTTCGG CAACGACACC CACGAAGCCC TCGAACGCAG

351  CCTTAATTTG AGCAAGTCCG CACTGGATTT GGCGGCAGAC AATGCCGTCA

401  GCAACGCCGT TCCCGTACAG ATAGACCTCA TCGGCACCGC CTCCCTGTCG

451  GGCAATATGG CAGTGTGCT GGAACACTAC GCCGGCAGCG GTTTTGCCCA

501  GCTTGCCCTG TACAATGCCG CAAGCGGGAA AATCGAAAAA AGCATCAATC

551  CGCACCAATT CGACCAGCCG CTTCCCGACA AGAACATTG GGAACAGATT

601  CAGCAGACCG GTTCGGTTCG GAGTTTGGAA AGCATAGGCG GCGTATTGTA
```

```
-continued
 651  CGCGCAGGGA TGGTTGTCGG CAGGTACGCA CAACGGGCGC GATTACGCGC
 701  TGTTCTTCCG CCAGCCGATT CCCGAAAATG TGGCACAGGA TGCCGTTCTG
 751  ATTGAAAAGG CGCGGGCGAA ATATGCCGAA TTGAGTTACA GCAAAAAAGG
 801  TTTGCAGACC TTTTTTCTGG TAACCCTGCT GATTGCCTCG CTGCTGTCGA
 851  TTTTTCTTGC GCTGGTAATG GCACTGTATT TTGCCCGCCG TTTCGTCGAA
 901  CCCATTCTGT CGCTTGCCGA GGGCGCAAAG GCGGTGGCGC AGGGTGATTT
 951  CAGCCAGACG CGCCCCGTAT TGCGCAACGA CGAGTTCGGA CGTTTGACCA
1001  AGCTGTTCAA CCATATGACC GAGCAGCTTT CCATCGCCAA GAAAGCAGAC
1051  GAACGCAACC GCCGGCGCGA GGAAGCCGCC CGTCACTACC TCGAGTGCGT
1101  GTTGGATGGG TTGACTACCG GTGTGGTGGT GTTTGACGAA AAAGGCCGTT
1151  TGAAAACCTT CAACAAGGCG GCGGAACAGA TTTTGGGGAT GCCGCTCGCC
1201  CCCCTGTGGG GCAGCAGCCG GCACGGTTGG CACGGCGTTT CGGCGCAGCA
1251  GTCCCTGCTT GCCGAAGTGT TtgccgccAT CGGTGCGGCG GCAGGTACGG
1301  ACAAACCGGT CCAGGTGGAA TATGCCGCGC CGGACGATGC CAAAATCCTG
1351  CTGGGCAAGG CGACGGTATT GCCCGAAGAC AACGGCAACG GCGTGGTGAT
1401  GGTGATTGAC GACATCACCG TGCTGATACG CGCGCAAAAA GAAGCCGCGT
1451  GGGGTGAAGT GGCGAAGCGG CTGGCACACG AAATCCGCAA TCCGCTCACG
1501  CCCATCCAGC TTTCCGCCGA ACGGCTGGCG TGGAAATTGG GCGGGAAGCT
1551  GGACGATCAG GACGCGCAAA TCCTGACGCG TtcgACCGAC ACCATCATCA
1601  AACAGgtggc gGCGTTAAAA GAAATGGTCG AGGCATTCCG CAATTACGCG
1651  CGCGCCCCTT CGCTCAAACT GGAAAATCAG GATTTGAACG CCTTAATCGG
1701  CGATGTTTTG GCCCTGTACG AAGCCGGCCC GTGCCGGTTT GAGGCGGAAC
1751  TTGCCGGCGA ACCGCTGATG ATGGCGGCGG ATACGACCGC CATGCGGCAG
1801  GTGCTGCACA ATATTTTCAA AAATGCCGCC GAAGCGGCGG AAGAAGCCGA
1851  TATGCCCGAA GTCAGGGTAA ATCGGAAAC GGGGCAGGAC GGACGGATTG
1901  TCCTGACGGT TGCGACAAC GGCAAGGGAT TCGGCAAGGA AATGCTGCAC
1951  AATGCTTTCG AGCCGTATGT GACGGATAAG CCGGCGGGAA CGGGACTGGG
2010  TCTGCCTGTA GTGAAAAAAA TCATTGGAGA ACACGGCGGC CGCATCAGCC
2051  TGAGCAATCA GGATGCGGGT GGGCGTGTG TCAGAATCAT CTTGCCAAAA
2101  ACGGTAGAAA CTTATGCGTA G
```

This corresponds to the amino acid sequence (SEQ ID NO: 258; ORF64ng-1):

```
  1  MRRFLPIAAI CAVVLLYGLT AATGSTSSLA DYFWWIVSPS AMLLLVLSAV
 51  LARYVILLLK DRRNGVFGSQ IAKRLSGMFT LVAVLPGLFL FGISAQFING
101  TINSWFGNDT HEALERSLNL SKSALDLAAD NAVSNAVPVQ IDLIGTASLS
151  GNMGSVLEHY AGSGFAQLAL YNAASGKIEK SINPHQFDQP LPDKEHWEQI
201  QQTGSVRSLE SIGGVLYAQG WLSAGTHNGR DYALFFRQPI PENVAQDAVL
251  IEKARAKYAE LSYSKKGLQT FFLVTLLIAS LLSIFLALVM ALYFARRFVE
301  PILSLAEGAK AVAQGDFSQT RPVLRNDEFG RLTKLFNHMT EQLSIAKEAD
```

```
                    -continued
351  ERNRRREEAA RHYLECVLDG LTTGVVVFDE KGRLKTFNKA AEQILGMPLA

401  PLWGSSRHGW HGVSAQQSLL AEVFAAIGAA AGTDKPVQVE YAAPDDAKIL

451  LGKATVLPED NGNGVVMVID DITVLIRAQK EAAWGEVAKR LAHEIRNPLT

501  PIQLSAERLA WKLGGKLDDQ DAQILTRSTD TIIKQVAALK EMVEAFRNYA

551  RAPSLKLENQ DLNALIGDVL ALYEAGPCRF EAELAGEPLM MAADTTAMRQ

601  VLHNIFKNAA EAAEEADMPE VRVKSETGQD GRIVLTVCDN GKGFGKEMLH

651  NAFEPYTTDK PAGTGLGLPV VKKIIGEHGG RISLSNQDAG GACVRIILPK

701  TVETYA*
```

ORF64ng-1 (SEQ ID NO: 258) and ORF64-1 (SEQ ID NO: 252) show 93.8% identity in 706 aa overlap:

```
                       10         20         30         40         50         60
orf64ng-1.pep  MRRFLPIAAICAVVLLYGLTAATGSTSSLADYFWWIVSFSAMLLLVLSAVLARYVILLLK
               ||||||||||||||||||||||||||||||||||||:|||||||||||||||||||||||
orf64-1        MRRFLPIAAICAVVLLYGLTAATGSTSSLADYFWWIVAFSAMLLLVLSAVLARYVILLLK
                       10         20         30         40         50         60

70         80         90        100        110        120
orf64ng-1.pep  DRRNGVFGSQIAKRLSGMFTLVAVLPGLFLFGISAQFINGTINSWFGNDTHEALERSLNL
               |||:|||||||||||||||||||||||:||||:|||||||||||||||||||||||||||
orf64-1        DRRDGVFGSQIAKRLSGMFTLVAVLPGVFLFGVSAQFINGTINSWFGNDTHEALERSLNL
                       70         80         90        100        110        120

130        140        150        160        170        180
orf64ng-1.pep  SKSALDLAADNAVSNAVPVQIDLIGTASLSGNMGSVLEHYAGSGFAQLALYNAASGKIEK
               |||||:||||||::|||||||||||:|||  |:|| ||||||||||||||||||||||||
orf64-1        SKSALNLAADNALGNAVPVQIDLIGAASLPGDMGRVLEHYAGSGFAQLALYNAASGKIEK
                      130        140        150        160        170        180

190        200        210        220        230        240
orf64ng-1.pep  SINPHQFDQPLPDKEHWEQIQQTGSVRSLESIGGVLYAQGWLSAGTHNGRDYALFFRQPI
               |||||::|||:|  |:||:::||||:||||||||||||||||||||||||||||||||:
orf64-1        SINPHKLDQPFPGKARWEKIQRAGSVRDLESIGGVLYAQGWLSAGTHNGRDYALFFRQPV
                      190        200        210        220        230        240

250        260        270        280        290        300
orf64ng-1.pep  PENVAQDAVLIEKARAKYAELSYSKKGLQTFFLVTLLIASLLSIFLALVMALYFARRFVE
               |::||:|||||||||||||||||||||||||||:||||||||||||||||||||||||||
orf64-1        PKGVAEDAVLIEKARAKYAELSYSKKGLQTFFLATLLIASLLSIFLALVMALYFARRFVE
                      250        260        270        280        290        300

310        320        330        340        350        360
orf64ng-1.pep  PILSLAEGAKAVAQGDFSQTRPVLRNDEFGRLTKLFNHMTEQLSIAKEADERNRRREEAA
               |:||||||||||||||||||||||||||||||||||||||||||||||||||||||||||
orf64-1        PVLSLAEGAKAVAQGDFSQTRPVLRNDEFGRLTKLFNHMTEQLSIAKEADERNRRREEAA
                      310        320        330        340        350        360

370        380        390        400        410        420
orf64ng-1.pep  RHYLECVLDGLTTGVVVFDEKGRLKTFNKAAEQILGMPLAPLWGSSRHGWHGVSAQQSLL
               |||||||:||||||||||||:| ||||||||||||||||| |||||||||||||||||||
orf64-1        RHYLECVLEGLTTGVVVFDEQGCLKTFNKAAEQILGMPLTPLWGSSRHGWHGVSAQQSLL
                      370        380        390        400        410        420

430        440        450        460        470        480
orf64ng-1.pep  AEVFAAIGAAAGTDKPVQVEYAAPDDAKILLGKATVLPEDNGNGVVMVIDDITVLIRAQK
               |||||||||||||||||:|:||||||||||||||||||||||||||||||||||||:|||
orf64-1        AEVFAAIGAAAGTDKPVHVKYAAPDDAKILLGKATVLPEDNGNGVVMVIDDITVLIHAQK
                      430        440        450        460        470        480

490        500        510        520        530        540
orf64ng-1.pep  EAAWGEVAKRLAHEIRNPLTPIQLSAERLAWKLGGKLDDQDAQILTRSTDTIIKQVAALK
               ||||||||||||||||||||||||||||||||||||||:|||||||||||||:|||||||
orf64-1        EAAWGEVAKRLAHEIRNPLTPIQLSAERLAWKLGGKLDEQDAQILTRSTDTIVKQVAALK
                      490        500        510        520        530        540
```

```
                      -continued
             550        560        570        580        590        600
orf64ng-1.pep EMVEAFRNYARAPSLKLENQDLNALIGDVLALYEAGPCRFEAELAGEPLMMAADTTAMRQ
              ||||||||||:|||||||||||||||||||||||||| ||||||||:|||||||||
orf64-1       EMVEAFRNYARSPSLKLENQDLNALIGDVLALYEAGPCRFAAELAGEPLTVAADTTAMRQ
             550        560        570        580        590        600

610        620        630        640        650        660
orf64ng-1.pep VLHNIFKNAAEAAEEADMPEVRVKSETGQDGRIVLTVCDNGKGFGKEMLHNAFEPYVTDK
              |||||||||||||||||:||||||||||||||||||||||||||:||||||||||||||
orf64-1       VLHNIFKNAAEAAEEADVPEVRVKSETGQDGRIVLTVCDNGKGFGREMLHNAFEPYVTDK
             610        620        630        640        650        660

670        680        690        700
orf64ng-1.pep PAGTGLGLPVVKKIIGEHGGRISLSNQDAGGACVRIILPKTVETYAX
              |||||||||||||||:|||||||||||||||||||||||||:||||
orf64-1       PAGTGLGLPVVKKIIEEHGGRISLSNQDAGGACVRIILPKTVKTYAX
             670        680        690        700
```

Furthermore, ORF64ng-1 (SEQ ID NO: 258) shows significant homology to a protein (SEQ ID NO: 1129) from *A. caulinodans*:

```
sp|Q04850|NTRY_AZOCA NITROGEN REGULATION PROTEIN NTRY )gi|77479|pir||S18624
ntrY
protein - Azorhizobium caulinodans )gi|38737 (X63841) NtrY gene product
[Azorhizobium caulinodans] Length = 771
Score = 218 bits (550), Expect = 7e-56
Identities = 195/720 (27%), Positives = 320/720 (44%), Gaps = 56/720 (8%)

Query:   7 IAAICAVVLLYGLTAATGSTSSLADYFWWIXXXXXXXXXXXXXXXXXXXRYVILLLKDRRNGV   66
           I+A+  ++L GLT  +        +   +                    R+  + K R  G
Sbjct:  35 ISALATFLILMGLTPVVPTHQVVIS----VLLVNAAAVLILSAMVGREIWRIAKARARGR   90

Query:  67 FGSQIAKRLSGMFTLVAVLPGLFLFGISAQFINGTINSWFGNDTHEALERSLNLSKSALD  126
           +++  R+ G+F +V+V+P + +      +++   ++   ++ WF    T E   S++++++ +
Sbjct:  91 AAARLHIRIVGLFAVVSVVPAILVAVVASLTLDRGLDRWFSMRTQEIVASSVSVAQTYVR  150

Query: 127 LAADNAVSNAVPVQIDLIGTASLSGNMGSVLEHYAG--SGFAQLALYNAASGKIEKSINP  184
           A N  + + DL  S+          YG   S F Q+     AA    + ++
Sbjct: 151 EHALNIRGDILAMSADLTRLKSV---------YEGDRSRFNQILTAQAALRNLPGAMLI  200

Query  185 HQFDQPLPDKEHWEQIQQTGSVRSLESIGGVLYAQGWLSAGTHNGRDYA-----------  233
           + D  ++ +  I+   V+  +IG   Q +   N  DY
Sbjct: 201 RR-DLSVVERAN-VNIGREFIVPANLAIGDATPDQPVIYLP--NDADYVAAVVPLKDYDD  256

Query: 234 --LFFRQPIPENVAQDAVLIEKARAKYAELSYSKKGLQTFFLVTXXXXXXXXXXXXXXVMA  291
             L+  + I V        ++ A Y  L   +  G+Q F +                   +
Sbjct: 257 LYLYVARLIDPRVIGYLKTTQETLADYRSLRERRFGVQVAFALMYAVITLIVLLSAVWLG  316

Query: 292 LYFARRFVEPILSLAEGAKAVAQGDFSQTRPVLRND-EFGRLTKLFNHMTEQLSIXXXXXX  350
           L F++  V PI  L A   VA+G+   P+ R  +    L + FN MT +L
Sbjct: 317 LNFSKWLVAPIRRLMSAADHVAEGNLDVRVPIYRAEGDLASLAETFNKMTHELRSQREAI  376

Query: 351 XXXXXXXXXXXHYLECVLDGLTTGVVVFDEKGRLKTFNKAAEQILGMPLAPLWGSSRHGW  410
                        + E VL G+   GV+ D + R+   N++AE++LG  L+ +   RH
Sbjct: 377 LTARDQIDSRRRFTEAVLSGVGAGVIGLDSQERITILNRSAERLLG--LSEVEALHRHLA  434

Query: 411 HGVSAQQSLLAEVFXXXXXXXXXTDKPVQVEYAAPDDAKILLGKATVLPEDNG---NGVVM  467
                V    LL E         + VQ       D +  +  V E +     +G V+
Sbjct: 435 EVVPETAGLLEEA------EHARQRSVQGNITLTRDGRERVFAVRVTTEQSPEAEHGWVV  488

Query: 468 VIDDITVLIRAQKEAAWGEVAKRLAHEIRNPLTPIQLSAERLAWKLGGKLDDQDAQILTR  527
           +DDIT LI AQ+  AW +VA+R+AHEI+NPLTPIQLSAERL   K G  +  QD +I  +
Sbjct: 489 TLDDITELISAQRTSAWADVARRIAHEIKNPLTPIQLSAERLKRKFGRHV-TQDREIFDQ  547

Query: 528 STDTIIKQVAALKEMVEAFRNYARAPSLKLENQDLNALIGDVLALYEAGPCRFEAELAGE  587
           +TDTII+QV +  MV+ F ++AR P   +++QD++ +I + L   G           +
Sbjct: 548 CTDTIIRQVGDIGRMVDEFSSFARMPKPVVDSQDMSEIIRQTVFLMRVGHPEVVFDSEVP  607

Query: 588 PLMMAA-DTTAMRQVLHNIFKNXXXXXXXXXDMPEVRVK-------SETGQDGRIVLTVCD  639
           P M A D    + L NI KN            P+VR +          G+D  +V+ + D
Sbjct: 608 PAMPARFDRRLVSQALTNILKNAAEAIEEAVP-PDVRGQGRIRVSANRVGED--LVIDIID  664

Query: 640 NGKGFGKEMLHNAFEPYVTDKPAGTGLGLPVVKKIIGEHGGRISLSNQDAG-GACVRIIL  698
           NG G  +E +    EPYVT +  GTGLGL +V KI+ EHGG I L+   G  GA +R+ L
Sbjct: 665 NGTGLPQESRNRLLEPYVTTREKGTGLGLAIVGKIMEEHGGGIELNDAPEGRGAWIRLTL  724
```

Based on this analysis, including the presence of a putative leader sequence (double-underlined) and several putative transmembrane domains (single-underlined) in the gonococcal protein, it is predicted that the proteins from N.meningitidis and N.gonorrhoeae, and their epitopes, could be useful antigens for vaccines or diagnostics, or for raising antibodies.

Example 31

The following partial DNA sequence was identified in N.meningitidis (SEQ ID NO: 259):

```
  1 ATGTACGCAT TTACCGCCGC ACAGCAACAG AAGGCACTCT TCCGGCTGGT
 51 GCTTTTTCAT ATCCTCATCA TCGCCGCCAG CAACTATCTG GTGCAGTTCC
101 CTTTCCAAAT TTTCGGCATC CACACCACTT GGGGCGCATT TTCCTTTCCC
151 TTCATCTTCC TTGCCACCGA CCTGACCGTC CGCATTTTCG GTTCTCACTT
201 GGCACGGCGG ATTATCTTTT GGGTGATGTT CCCCGCCCTT TTGCTTTCCT
251 ACGTCTTTTC CGTTTTGTTC CACAACGGCA GTTGGACAGG CTTGGGCGCG
301 CTGTCCGAAT TCAACACCTT TGTCGGACGC ATCGCCTTAG CCAGCTTTGC
351 CGCCTACGCG ATCGGACAAA TCCTTGATAT TTTTGTATTC AACAAATTAC
401 GCCGTCTGAA AGCGTGGTGG ATTGCACCGA ACGCATCAAC CGTCATCGGG
451 CACGCGTTGG ATACG...
```

This corresponds to the amino acid sequence (SEQ ID NO: 260; ORF66):

```
  1 MYAFTAAQQQ KALFRLVLFH ILIIAASNYL VQFPFQIFGI HTTWGAFSFP
 51 FIFLATDLTV RIFGSHLARR IIFWVMFPAL LLSYVFSVLF HNGSWTGLGA
101 LSEFNTFVGR IALASFAAYA IGQILDIFVF NKLRRLKAWW IAPNASTVIG
151 HALDT...
```

Further work revealed the complete nucleotide sequence (SEQ ID NO: 261):

```
  1 ATGTACGCAT TTACCGCCGC ACAGCAACAG AAGGCACTCT TCCGGCTGGT
 51 GCTTTTTCAT ATCCTCATCA TCGCCGCCAG CAACTATCTG GTGCAGTTCC
101 CTTTCCAAAT TTTCGGCATC CACACCACTT GGGGCGCATT TTCCTTTCCC
151 TTCATCTTCC TTGCCACCGA CCTGACCGTC CGCATTTTCG GTTCTCACTT
201 GGCACGGCGG ATTATCTTTT GGGTGATGTT CCCCGCCCTT TTGCTTTCCT
251 ACGTCTTTTC CGTTTTGTTC CACAACGGCA GTTGGACAGG CTTGGGCGCG
301 CTGTCCGAAT TCAACACCTT TGTCGGACGC ATCGCCTTAG CCAGCTTTGC
351 CGCCTACGCG ATCGGACAAA TCCTTGATAT TTTTGTATTC AACAAATTAC
401 GCCGTCTGAA AGCGTGGTGG ATTGCACCGA CCGCATCAAC CGTCATCGGC
451 AACGCCTTGG ATACGCTGGT ATTTTTCGCC GTTGCCTTCT ACGCAAGCAG
501 CGATGGATTT ATGGCGGCAA ACTGGCAGGG CATCGCTTTT GTCGATTACC
551 TGTTCAAACT TACCGTCTGC ACCCTCTTCT TCCTGCCCGC CTACGGCGTG
601 ATACTGAATC TGCTGACGAA AAAACTGACA ACCCTGCAAA CCAAACAGGC
651 GCAAGACCGC CCCGCGCCCT CGCTGCAAAA TCCGTAA
```

This corresponds to the amino acid sequence (SEQ ID NO: 262; ORF66-1):

```
  1  MYAFTAAQQQ KALFRLVLFH ILIIAASNYL VQFPFQIFGI HTTWGAFSFP

51  FIFLATDLTV RIFGSHLARR IIFWVMFPAL LLSYVFSVLF HNGSWTGLGA

101  LSEFNTFVGR IALASFAAYA IGQILDIFVF NKLRRLKAWW IAPTASTVIG

151  NALDTLVFFA VAFYASSDGF MAANWQGIAF VDYLFKLTVC TLFFLPAYGV

201  ILNLLTKKLT TLQTKQAQDR PAPSLQNP*
```

Computer analysis of this amino acid sequence gave the following results:

Homology with the Hypothetical Protein o221 (SEQ ID NO: 1130) of *E. coli* (Accession Number P37619)

ORF66 (SEQ ID NO: 260) and o221 protein (SEQ ID NO: 1130) show 67% aa identity in 155aa overlap:

```
orf66    1 MYAFTAAQQQKALFRLVLFHILIIAASNYLVQFPFQIFGIHTTWGAFSFPFIFLATDLTV  60
             M  F+  Q+ KALF L LFH+L+I +SNYLVQ P   I G HTTWGAFSFPFIFLATDLTV
o221     1 MNVFSQTQRYKALFWLSLFHLLVITSSNYLVQLPVSILGFHTTWGAFSFPFIFLATDLTV  60 orf66   61 RIFGSHLARRIIFWVMFPALLLSYVFSVLFHNGSWTGLGALSEFNTFVGRIALASFAAYA  120
             RIFG+ LARRIIF VM PALL+SYV S LF+ GSW G GAL+ FN FV RIA ASF AYA
o221    61 RIFGAPLARRIIFAVMIPALLISYVISSLFYMGSWQGFGALAHFNLFVARIATASFMAYA  120 orf66  121 IGQILDIFVFNKLRRLKAWWIAPNASTVIGHALDT                          155
             +GQILD+ VFN+LR+ + WW+AP AST+ G+   DT
o221   121 LGQILDVHVFNRLRQSRRWWLAPTASTLFGNVSDT                          155
```

Homology with a Predicted ORF from *N.meningitidis* (Strain A)

ORF66 (SEQ ID NO: 260) shows 96.1% identity over a 155aa overlap with an ORF (ORF66a) (SEQ ID NO: 264) from strain A of *N. meningitidis*:

```
                    10         20         30         40         50         60
orf66.pep  MYAFTAAQQQKALFRLVLFHILIIAASNYLVQFPFQIFGIHTTWGAFSFPFIFLATDLTV
           ||||||||||||| |||||||||||||||||||||||| |||||||||||||||||||||
orf66a     MYAFTAAQQQKALFWLVLFHILIIAASNYLVQFPFQISGIHTTWGAFSFPFIFLATDLTV
                    10         20         30         40         50         60

70         80         90        100        110        120
orf66.pep  RIFGSHLARRIIFWVMFPALLLSYVFSVLFHNGSWTGLGALSEFNTFVGRIALASFAAYA
           ||||||||||||||||||||||||||||||||||||||||||||||||||||||||||||
orf66a     RIFGSHLARRIIFWVMFPALLLSYVFSVLFHNGSWTGLGALSEFNTFVGRIALASFAAYA
                    70         80         90        100        110        120

130        140        150
orf66.pep  IGQILDIFVFNKLRRLKAWWIAPNASTVIGHALDT
           :||||||||||||||||||:||:||||||:||||
orf66a     LGQILDIFVFNKLRRLKAWWVAPTASTVIGNALDTLVFFAVAFYASSDGFMAANWQGIAF
                   130        140        150 orf66a     VDYLFKLTVCGLFFLPAYGVILNLLTKKLTTLQTKQAQDRPAPSLQNPX
                   190        200        210        220
```

The complete length ORF66a nucleotide sequence (SEQ ID NO: 263) is:

```
  1  ATGTACGCAT TTACCGCCGC ACAGCAACAG AAGGCACTCT TCTGGCTGGT

51  CCTTTTTCAT ATCCTCATCA TCGCCGCCAG CAACTATCTG GTGCAGTTCC

101  CCTTCCAAAT TTCCGGCATC CACACCACTT GGGGCGCGTT TTCCTTTCCC
```

```
                   -continued
151   TTCATCTTCC TCGCCACCGA CCTGACCGTC CGCATTTTCG GTTCGCACTT

201   GGCACGGCGG ATTATCTTTT GGGTCATGTT CCCCGCCCTT TTGCTTTCCT

251   ACGTCTTTTC CGTTTTGTTC CACAACGGCA GTTGGACGGG CTTGGGCGCG

301   CTGTCCGAAT TCAACACCTT TGTCGGACGC ATCGCGCTGG CAAGTTTTGC

301   CGCCTACGCG CTCGGACAAA TCCTTGATAT TTTTGTGTTC AACAAATTAC

401   GCCGTCTGAA AGCGTGGTGG GTTGCCCCGA CTGCATCAAC CGTCATCGGC

451   AACGCCTTAG ATACGTTGGT ATTTTTCGCC GTTGCCTTCT ACGCAAGCAG

501   CGATGGATTT ATGGCGGCAA ACTGGCAGGG CATCGCTTTT GTCGATTACC

551   TGTTCAAACT CACCGTCTGC GGTCTGTTTT TCCTGCCCGC CTACGGCGTG

601   ATTCTGAATC TGCTGACGAA AAAACTGACG ACCCTGCAAA CCAAACAGGC

651   GCAAGACCGC CCCGCGCCCT CGCTGCAAAA TCCGTAA
```

This encodes a protein having amino acid sequence (SEQ ID NO: 264):

```
  1   MYAFTAAQQQ KALFWLVLFH ILIIAASNYL VQFPFQISGI HTTWGAFSFP

51   FIFLATDLTV RIFGSHLARR IIFWVMFPAL LLSYVFSVLF HNGSWTGLGA

101   LSEFNTFVGR IALASFAAYA LGQILDIFVF NKLRRLKAWW VAPTASTVIG

151   NALDTLVFFA VAFYASSDGF MAANWQGIAF VDYLFKLTVC GLFFLPAYGV

201   ILNLLTKKLT TLQTKQAQDR PAPSLQNP*
```

ORF66a (SEQ ID NO: 264) and ORF66-1 (SEQ ID NO: 262) show 97.8% identity in 228 aa overlap:

```
                      10         20         30         40         50         60
orf66a.pep   MYAFTAAQQQKALFWLVLFHILIIAASNYLVQFPFQISGIHTTWGAFSFPFIFLATDLTV
             |||||||||||||| |||||||||||||||||||||||| ||||||||||||||||||||
orf66-1      MYAFTAAQQQKALFRLVLFHILIIAASNYLVQFPFQIFGIHTTWGAFSFPFIFLATDLTV
                      10         20         30         40         50         60

70         80         90        100        110        120
orf66a.pep   RIFGSHLARRIIFWVMFPALLLSYVFSVLFHNGSWTGLGALSEFNTFVGRIALASFAAYA
             ||||||||||||||||||||||||||||||||||||||||||||||||||||||||||||
orf66-1      RIFGSHLARRIIFWVMFPALLLSYVFSVLFHNGSWTGLGALSEFNTFVGRIALASFAAYA
                      70         80         90        100        110        120

130        140        150        160        170        160
orf66a.pep   LGQILDIFVFNKLRRLKAWWVAPTASTVIGNALDTLVFFAVAFYASSDGFMAANWQGIAF
             :|||||||||||||||||||:|||||||||||||||||||||||||||||||||||||||
orf66-1      IGQILDIFVFNKLRRLKAWWIAPTASTVIGNALDTLVFFAVAFYASSDGFMAANWQGIAF
                      130        140        150        160        170        160

190        200        210        220       229
orf66a.pep   VDYLFKLTVCGLFFLPAYGVILNLLTKKLTTLQTKQAQDRPAPSLQNPX
             ||||||||||  ||||||||||||||||||||||||||||||||||||
orf66-1      VDYLFKLTVCTLFFLPAYGVILNLLTKKLTTLQTKQAQDRPAPSLQNPX
                      190        200        210        220
```

Homology with a Predicted ORF from N.gonorrhoeae

ORF66 (SEQ ID NO: 260) shows 94.2% identity over a 155aa overlap with a predicted ORF (ORF66.ng) (SEQ ID NO: 266) from N. gonorrhoeae:

```
orf66.pep   MYAFTAAQQQKALFRLVLFHILIIAASNYLVQFPFQIFGIHTTWGAFSFPFIFLATDLTV    60
            |||:||||||||||||||||||||||||||||||||||:|||||||||||||||||||||
orf66ng     MYALTAAQQQKALFRLVLFHILIIAASNYLVQFPFRIFGIHTTWGAFSFPFIFLATDLTV    60
```

```
                         -continued
orf66.pep  RIFGSHLARRIIFWVMFPALLLSYVFSVLFHNGSWTGLGALSEFNTFVGRIALASFAAYA  120
           ||||||||||||||||||||||| ||||||||||||||||| :||||||||||||||||||
orf66ng    RIFGSHLARRIIFWVMFPALSLSYVFSVLFHNGSWTGLGAPSQFNTFVGRIALASFAAYA  120 orf66.pep  IGQILDIFVFNKLRRLKAWWIAPNASTVIGHALDT                            155
           :|||||||||:||||||||||| ||||||:||||
orf66ng    LGQILDIFVFDKLRRLKAWWIAPAASTVIGNALDTLVFFAVAFYASSDEFMAANWQGIAF  180
```

The complete length ORF66ng nucleotide sequence (SEQ ID NO: 265) is:

```
  1  ATGTACGCAT TGACCGCCGC ACAGCAACAG AAGGCACTCT TCCGGCTGGT

51  GCTTTTCCAT ATCCTCATCA TCGCCGCCAG CAACTATCTG GTGCAGTTCC

101  CCTTCCGGAT TTTCGGCATC CACACCACTT GGGGCGCGTT TTCCTTTCCC

151  TTCATCTTCC TCGCCACCGA CCTGACCGTC CGCATTTTCG GTTCGCACTT

201  GGCGCGGCGG ATTATCTTTT GGGTGATGTT CCCCGCCCTT ttgCTTTcat 251  aCGTCTTTTC CGTTTTGTTC CACAACGGCA GTTGGACGGG CTTGGGCGCG 301  ctgTCCCAAT TCAACACCTT TGTCGGACGC ATCGCGCTGG CAAGTTTTGC

351  CGCCTACGCG CTCGGACAAA TCCTTGATAT TTTCGTATTC GACAAATTAC

401  GCCGTCTGAA AGCGTGGTGG ATTGCCCCGG CCGCATCAAC CGTCATCGGC

451  AATGCACTGG ACACGTTAGT ATTTTTTGCC GTTGCCTTTT ACGCAAGCAG

501  CGATGAATTT ATGGCGGCAA ACTGGCAGGG CATCGCTTTT GTCGATTACC

551  TGTTCAAACT TACCGTCTGC ACCCTCTTCT TCCTGCCCGC CTACGGCGTG

601  ATACTGAATC TGCTGACGAA AAAACTGACG GCCCTGCAAA CCAAACAGGC

651  GCAAGACCGC CCCGTGCCCT CGCTGCAAAA TCCGTAA
```

This encodes a protein having amino acid sequence (SEQ ID NO: 266):

```
  1  MYALTAAQQQ KALFRLVLFH ILIIAASNYL VQFPFRIFGI HTTW<u>GAFSFP</u>

51  <u>FIFLATDLTV RIFGSHLARR</u> IIFWVMFPAL SLSYVFSVLF HNGSWTGLGA

101  PS<u>QFNTFVGR IALASFAAYA</u> LGQILDIFVF DKLRRLKAWW IAPAA<u>STVIG</u>

151  <u>NALDTLVFFA VAF</u>YASSDEF MAANWQGIA<u>F VDYLFKLTVC TLFFLPAYGV</u>

201  ILNLLTKKLT ALQTKQAQDR PVPSLQNP*
```

An alternative annotated sequence is:

```
  1  MYALTAAQQQ KALFRLVLFH ILIIAASNYL VQFPFRIFGI HTTWGAFSFP

51  FIFLATDLTV RIFGSHLARR <u>IIFWVMFPAL LLSYVFS</u>VLF HNGSWTGLGA

101  LSQFNTFVGR I<u>ALASFAAYA LGQILDIFVF</u> DKLRRLKAWW IAPAA<u>STVIG</u>

151  <u>NALDTLVFFA VAF</u>YASSDEF MAANWQGIAF VDYLFKL<u>TVC TLFFLPAYGV</u>

201  <u>ILNLLTKKLT</u> ALQTKQAQDR PVPSLQNP*
```

ORF66ng (SEQ ID NO: 266) and ORF66-1 (SEQ ID NO: 262) show 96.1% identity in 228 aa overlap:

```
orf66-1.pep  MYAFTAAQQQKALFRLVLFHILIIAASNYLVQFPFQIFGIHTTWGAFSFPFIFLATDLTV    60
             |||:||||||||||||||||||||||||||||:||||||||||||||||||||||||||
orf66ng      MYALTAAQQQKALFRLVLFHILIIAASNYLVQFPFRIFGIHTTWGAFSFPFIFLATDLTV    60 orf66-1.pep  RIFGSHLARRIIFWVMFPALLLSYVFSVLFHNGSWTGLGALSEFNTFVGRIALASFAAYA   120
             ||||||||||||||||||||||||||||||||||||||||||:|||||||||||||||||
orf66ng      RIFGSHLARRIIFWVMFPALLLSYVFSVLFHNGSWTGLGALSQFNTFVGRIALASFAAYA   120 orf66-1.pep  IGQILDIFVFNKLRRLKAWWIAPTASTVIGNALDTLVFFAVAFYASSDGFMAANWQGIAF   180
             :||||||||||:||||||||||||:||||||||||||||||||||||| |||||||||||
orf66ng      LGQILDIFVFDKLRRLKAWWIAPAASTVIGNALDTLVFFAVAFYASSDEFMAANWQGIAF   180 orf66-1.pep  VDYLFKLTVCTLFFLPAYGVILNLLTKKLTTLQTKQAQDRPAPSLQNPX            229
             ||||||||||||||||||||||||||||||:|||||||||||:||||||
orf66ng      VDYLFKLTVCTLFFLPAYGVILNLLTKKLTALQTKQAQDRPVPSLQNPX            229
```

Furthermore, ORF66ng (SEQ ID NO: 266) shows significant homology with an *E.coli* ORF (SEQ ID NO: 1130):

```
sp|P37619|YHHQ_ECOLI HYPOTHETICAL 25.3 KD PROTEIN IN FTSY-NIKA INTERGENIC REGION
(O221)
)gi|1073495|pir||S47690 hypothetical protein o221 - Escherichia coli )gi|466607
(U00039) No definition line found [Escherichia coli] )gi|1789882 (AE000423)
hypothetical 25.3 kD protein in ftsY-nikA intergenic region [Escherichia coli]
Length = 221
Score = 273 bits (692), Expect = 5e-73
Identities = 132/203 (65%), Positives = 155/203 (76%)

Query:    1 MYALTAAQQQKALFRLVLFHILIIAASNYLVQFPFRIFGIHTTWGAFSFPFIFLATDLTV   60
            M   + Q+ KALF L LFH+L+I +SNYLVQ P   I G HTTWGAFSFPFIFLATDLTV
Sbjct:    1 MNVFSQTQRYKALFWLSLFHLLVITSSNYLVQLPVSILGFHTTWGAFSFPFIFLATDLTV   60

Query:   61 RIFGSHLARRIIFWVMFPALLLSYVFSVLFHNGSWTGLGALSQFNTFVGRIALASFAAYA  120
            RIFG+ LARRIIF VM PALL+SYV S LF+ GSW G GAL+ FN FV RIA ASF AYA
Sbjct:   61 RIFGAPLARRIIFAVMIPALLISYVISSLFYMGSWQGFGALAHFNLFVARIATASFMAYA  120

Query:  121 LGQILDIFVFDKLRRLKAWWIAPAASTVIGNALDTLVFFAVAFYASSDEFMAANWQGIAF  180
            LGQILD+ VF++LR+ + WW+AP AST+ GN  DTL FF +AF+ S D FMA +W  IA
Sbjct:  121 LGQILDVHVFNRLRQSRRWWLAPTASTLFGNVSDTLAFFFIAFWRSPDAFMAEHWMEIAL  180

Query:  181 VDYLFKLTVCTLFFLPAYGVILN                                      203
            VDY FK+ +  +FFLP YGV+LN
Sbjct:  181 VDYCFKVLISIVFFLPMYGVLLN                                      203
```

Based on this analysis, including the homology with the *E.coli* protein and the presence of several putative transmembrane domains in the gonococcal protein, it is predicted that these proteins from *N.meningitidis* and *N.gonorrhoeae*, and their epitopes, could be useful antigens for vaccines or diagnostics, or for raising antibodies.

Example 32

The following partial DNA sequence was identified in *N.meningitidis* (SEQ ID NO: 267):

```
  1 ATGGTCATAA AATATACAAA TTTGAATTTT GCGAAATTGT CGATAATTGC
 51 AATTTTGATG ATGTATTCGT TGAAGCGAA TGCAAAyGCA GTmwrAATAT
101 CTGAAACTGT TTCAGTTGAT ACCGGACAAG GTGCGAAAAT TCATAAGTTT
151 GTACCTAAAA ATAGTAAAAC TTATTCATCT GATTTAATAA AAACGGTAGA
201 TTTAACACAC AyyCCTACGG GCGCAAAAGC CCGAATCAAC GCCAAAATAA
251 CCGCCAGCGT ATCCCGCGCC GGCGTATTGG CGGGGGTCGG CAAACTTGCC
301 CGCTTAGgCG CGAAATTCAG CACAAGGGCG GTtCCCTATG TCGGAACAGC
351 CcTTTTAGCC CACGACGTAT ACGAAAcTTT CAAAGAAGAC ATACAGGCAC
401 GAGGCTACCA ATACGACCCC GAAACCGACA AATTTGTAAA AGGCTACGAA
```

-continued

```
451  TATAGTAATT GCCTTTGGTA CGAAGACAAA AGACGTATTA ATAGAACCTA
501  TGGCTGCTAC GGCGTTGAT..
```

This corresponds to the amino acid sequence (SEQ ID NO: 268; ORF72):

```
  1  MVIKYTNLNF AKLSIIAILM MYSFEANANA VXISETVSVD TGQGAKIHKF
 51  VPKNSKTYSS DLIKTVDLTH XPTGAKARIN AKITASVSRA GVLAGVGKLA
101  RLGAKFSTRA VPYVGTALLA HDVYETFKED IQARGYQYDP ETDKFVKGYE
151  YSNCLWYEDK RRINRTYGCY GVD..
```

Further work revealed the complete nucleotide sequence (SEQ ID NO: 269):

```
  1  ATGGTCATAA AATATACAAA TTTGAATTTT GCGAAATTGT CGATAATTGC
 51  AATTTTGATG ATGTATTCGT TTGAAGCGAA TGCAAATGCA CTAAAAATAT
101  CTGAAACTGT TTCAGTTGAT ACCGGACAAG GTGCGAAAAT TCATAAGTTT
151  GTACCTAAAA ATAGTAAAAC TTATTCATCT GATTTAATAA AAACGGTAGA
201  TTTAACACAC ATCCCTACGG GCGCAAAAGC CCGAATCAAC GCCAAAATAA
251  CCGCCAGCGT ATCCCGCGCC GGCGTATTGG CGGGGGTCGG CAAACTTGCC
301  CGCTTAGGCG CGAAATTCAG CACAAGGGCG GTTCCCTATG TCGGAACAGC
341  CCTTTTAGCC CACGACGTAT ACGAAACTTT CAAAGAAGAC ATACAGGCAC
401  GAGGCTACCA ATACGACCCC GAAACCGACA AATTTGCAAA GGTCTCAGGC
451  TAA
```

This corresponds to the amino acid sequence (SEQ ID NO: 270; ORF72-1):

```
  1  MVIKYTNLNF AKLSIIAILM MYSFEANANA VKISETVSVD TGQGAKIHKF
 51  VPKNSKTYSS DLIKTVDLTH IPTGAKARIN AKITASVSRA GVLAGVGKLA
101  RLGAKFSTRA VPYVGTALLA HDVYETFKED IQARGYQYDP ETDKFAKVSG
151  *
```

Computer analysis of this amino acid sequence gave the following results:
Homology with a Predicted ORF from *N.meningitidis* (Strain A)

ORF72 (SEQ ID NO: 268) shows 98.0% identity over a 147aa overlap with an ORF (ORF72a) (SEQ ID NO: 272) from strain A of *N. meningitidis*:

```
                        10         20         30         40         50         60
orf72.pep  MVIKYTNLNFAKLSIIAILMMYSFEANANAVXISETVSVDTGQGAKIHKFVPKNSKTYSS
           ||||||||||||||||||||||||||||| |||||||||||||||||||||||||||||
orf72a     MVIKYTNLNFAKLSIIAILMMYSFEANANAVKISETVSVDTGQGAKIHKFVPKNSKTYSS
                        10         20         30         40         50         60

70         80         90        100        110        120
orf72.pep  DLIKTVDLTHXPTGAKARINAKITASVSRAGVLAGVGKLARLGAKFSTRAVPYVGTALLA
           ||||||||||  |||||||||||||||||||||||||||||||||||||||||||||||
orf72a     DLIKTVDLTHIPTGAKARINAKITASVSRAGVLAGVGKLARLGAKFSTRAVPYVGTALLA
                        70         80         90        100        110        120
```

```
                       -continued
                  130          140          150          160          170
orf72.pep  HDVYETFKEDIQARGYQYDPETDKFVKGYEYSNCLWYEDKRRINRTYGCYGVD
           ||||||||||||||||||||||||||:|
orf72a     HDVYETFKEDIQARGYQYDPETDKFAKVSGX
                  130          140          150
```

The complete length ORF72a nucleotide sequence (SEQ ID NO: 271) is:

```
  1  ATGGTCATAA AATATACAAA TTTGAATTTT GCGAAATTGT CGATAATTGC

51  AATTTTGATG ATGTATTCGT TTGAAGCGAA TGCAAATGCA GTAAAAATAT

101  CTGAAACTGT TTCAGTTGAT ACCGGACAAG GTGCGAAAAT TCATAAGTTT

151  GTACCTAAAA ATAGTAAAAC TTATTCATCT GATTTAATAA AAACGGTAGA

201  TTTAACACAC ATCCCTACGG GCGCAAAAGC CCGAATCAAC GCCAAAATAA

251  CCGCCAGCGT ATCCCGCGCC GGCGTATTGG CGGGGGTCGG CAAACTTGCC

301  CGCTTAGGCG CGAAATTCAG CACAAGGGCG GTTCCCTATG TCGGAACAGC

351  CCTTTTAGCC CACGACGTAT ACGAAACTTT CAAAGAAGAC ATACAGGCAC

401  GAGGCTACCA ATACGACCCC GAAACCGACA AATTTGCAAA GGTCTCAGGC

451  TAA
```

This encodes a protein having amino acid sequence (SEQ ID NO: 272):

```
  1  MVIKYTNLNF AKLSIIAILM MYSFEANANA VKISETVSVD TGQGAKIHKF

51  VPKNSKTYSS DLIKTVDLTH IPTGAKARIN AKITASVSRA GVLAGVGKLA

101  RLGAKFSTRA VPYVGTALLA HDVYETFKED IQARGYQYDP ETDKFAKVSG

151  *
```

ORF72a (SEQ ID NO: 272) and ORF72-1 (SEQ ID NO: 270) show 100.0% identity in 150 aa overlap:

```
                  10         20         30         40         50         60
orf72a.pep  MVIKYTNLNFAKLSIIAILMMYSFEANANAVKISETVSVDTGQGAKIHKFVPKNSKTYSS
            ||||||||||||||||||||||||||||||||||||||||||||||||||||||||||||
orf72-1     MVIKYTNLNFAKLSIIAILMMYSFEANANAVKISETVSVDTGQGAKIHKFVPKNSKTYSS
                  10         20         30         40         50         60

70         80         90        100        110        120
orf72a.pep  DLIKTVDLTHIPTGAKARINAKITASVSRAGVLAGVGKLARLGAKFSTRAVPYVGTALLA
            ||||||||||||||||||||||||||||||||||||||||||||||||||||||||||||
orf72-1     DLIKTVDLTHIPTGAKARINAKITASVSRAGVLAGVGKLARLGAKFSTRAVPYVGTALLA
                  70         80         90        100        110        120

130        140        150
orf72a.pep  HDVYETFKEDIQARGYQYDPETDKFAKVSGX
            |||||||||||||||||||||||||||||||
orf72-1     HDVYETFKEDIQARGYQYDPETDKFAKVSGX
                 130        140        150
```

Homology with a Predicted ORF from *N.gonorrhoeae*

ORF72 (SEQ ID NO: 268) shows 89% identity over a 173aa overlap with a predicted ORF (ORF72.ng) SEQ ID NO: 274) from *N. gonorrhoeae*:

```
orf72.pep  MVIKYTNLNFAKLSIIAILMMYSFEANANAVXISETVSVDTGQGAKIHKFVPKNSKTYSS   60
           || |:|||||||||||||||||||||||| ||||:||||||||:||||||:|: |||
orf72ng    MVTKHTNLNFAKLSIIAILMMYSFEANANAVKISETLSVDTGQGAKVHKFVPKSSNIYSS   60 orf72.pep  DLIKTVDLTHXPTGAKARINAKITASVSRAGVLAGVGKLARLGAKFSTRAVPYVGTALLA  120
           || |:|||| |||||||||||||||||||||||:|||||:| ||||:||||||||||||
orf72ng    DLTKAVDLTHIPTGAKARINAKITASVSRAGVLSGVGKLVRQGAKFGTRAVPYVGTALLA  120 orf72.pep  HDVYETFKEDIQARGYQYDPETDKFVKGYEYSNCLWYEDKRRINRTYGCYGVD        173
           ||||||||||||||| :|||||||||||||||:||||||:||||||||||||
orf72ng    HDVYETFKEDIQARGCRYDPETDKFVKGYEYANCLWYEDERRINRTYGCYGVDSSIMRLM  180
```

An ORF72ng nucleotide sequence (SEQ ID NO: 273) was predicted to encode a protein having amino acid sequence (SEQ ID NO: 274):

```
  1 MVTKHTNLNF AKLSIIAILM MYSFEANANA VKISETLSVD TGQGAKVHKF

51 VPKSSNIYSS DLTKAVDLTH IPTGAKARIN AKITASVSRA GVLSGVGKLV

101 RQGAKFGTRA VPYVGTALLA HDVYETFKED IQARGCRYDP ETDKFVKGYE

151 YANCLWYEDE RRINRTYGCY GVDSSIMRLM PDRSRFPEVK QLMESQMYRL

201 ARPFWNWRKE ELNKLSSLDW NNFVLNRCTF DWNGGGCAVN KGDDFRAGAS

251 FSLGRNPKYK EEMDAKKPEE ILSLKVDADP DKYIEATGYP GYSEKVEVAP

301 GTKVNMGPVT DRNGNPVQVA ATFGRDAQGN TTADVQVIPR PDLTPASAEA

351 PHAQPLPEVS PAENPANNPD PDENPGTRPN PEPDPDLNPD ANPDTDGQPG

401 TSPDSPAVPD RPNGRNRKER KEGEDGGLSC DYFPEILACQ EMGKPSDRMF

451 HDISIPQVTD DKTWSSHNFL PSNGVCPQPK TFHVFGRQYR ASYEPLCVFA

501 EKIRFAVLLA FIIMSAFVVF GSLGGE*
```

After further analysis, the following gonococcal DNA sequence (SEQ ID NO: 275) was identified:

```
  1 ATGGTCACAA AACATACAAA TTTGAATTTT GCGAAATTGT CGATAATTGC

51 AATTTTGATG ATGTATTCGT TTGAAGCGAA TGCAAATGCA GTAAAAATAT

101 CTGAAACTCT TTCGGTTGAT ACCGGACAAG GCGCGAAAGT TCATAAGTTC

151 GTTCCTAAAT CAAGTAATAT TTATTCATCT GATTTAACAA AAGCGGTAGA

201 TTTAACGCAT ATCCCCACGG GCGCAAAAGC CCGAATCAAC GCCAAAATAA

251 CCGCCAGCGT ATCCCGCGCC GGCGTATTGT CGGGGGTCGG CAAACTTGTC

301 CGCCAAGGCG CGAAATTCGG CACAAGGGCG GTTCCCTATG TCGGAACAGC

351 CCTTTTAGCC CACGACGTAT ACGAAACTTT CAAAGAAGAC ATACAGGCAC

401 GAGGCTGCCG ATACGATCCC GAAACCGACA AATTT
```

This corresponds to the amino acid sequence (SEQ ID NO: 276; ORF72ng-1):

```
  1 MVTKHTNLNF AKLSIIAILM MYSFEANANA VKISETLSVD TGQGAKVHKF

51 VPKSSNIYSS DLTKAVDLTH IPTGAKARIN AKITASVSRA GVLSGVGKLV

101 RQGAKFGTRA VPYVGTALLA HDVYETFKED IQARGCRYDP ETDKF
```

ORF72ng-1 (SEQ ID NO: 276) and ORF721-1 (SEQ ID NO: 270) show 89.7% identity in 145 aa overlap:

```
                    10        20        30        40        50        60
orf72ng-1.pe  MVTKHTNLNFAKLSIIAILMMYSFEANANAVKISETLSVDTGQGAKVHKFVPKSSNIYSS
              || |:|||||||||||||||||||||||||||||:||||||||:||||||:|: |||
orf72-1       MVIKYTNLNFAKLSIIAILMMYSFEANANAVKISETVSVDTGQGAKIHKFVPKNSKTYSS
                    10        20        30        40        50        60

70        80        90       100       110       120
orf72ng-1.pe  DLTKAVDLTHIPTGAKARINAKITASVSRAGVLSGVGKLVRQGAKFGTRAVPYVGTALLA
              || |:||||||||||||||||||||||||||||:|||||:| ||||:|||||||||||||
orf72-1       DLIKTVDLTHIPTGAKARINAKITASVSRAGVLAGVGKLARLGAKFSTRAVPYVGTALLA
                    70        80        90       100       110       120

130       140
orf72ng-1.pe  HDVYETFKEDIQARGCRYDPETDKF
              |||||||||||||||| :|||||||
orf72-1       HDVYETFKEDIQARGYQYDPETDKFAKVSGX
                   130       140       150
```

Based on analysis, including the presence of a putative leader sequence and transmembrane domains in gonococcal protein, it is predicted that the proteins from *N.meningitidis* and *N.gonorrhoeae*, and their epitopes, could be useful antigens for vaccines or diagnostics, or for raising antibodies.

Example 33

The following partial DNA sequence was identified in *N.meningitidis* (SEQ ID NO: 277):

```
  1  ATGAGATTTT TCGGTATCGG TTTTTTGGTG CTGCTGTTTT TGGAGATTAT
 51  GTCGATTGTG TGGGTTGCCG ATTGGCTGGG CGGCGGCTGG ACGTTGTTTT
101  TGATGGCGGC AGGTTTTGCC GCCGGCGTGC TGATGCTCAG GCAAACCGGG
151  GCTGACCGGT CTTTTATTGG CGGGCGCGGC AATGAGAAGC GGCGGGAAGG
201  TATCCGTTTA TCAGATGTTG TGGCCTATC..
```

This corresponds to the amino acid sequence (SEQ ID NO: 278; ORF73):

```
  1  MRFFGIGFLV LLFLEIMSIV WVADWLGGGW TLFLMAAGFA AGVLMLRQTG
 51  LTGLLLAGAA MRSGGKVSVY QMLWPI..
```

Further work revealed the complete nucleotide sequence (SEQ ID NO: 279):

```
  1  ATGAGATTTT TCGGTATCGG TTTTTTGGTG CTGCTGTTTT TGGAGATTAT
 51  GTCGATTGTG TGGGTTGCCG ATTGGCTGGG CGGCGGCTGG ACGTTGTTTT
101  TGATGGCGGC AGGTTTTGCC GCCGGCGTGC TGATGCTCAG GCATACGGGG
151  CTGTCCGGTC TTTTATTGGC GGGCGCGGCA ATGAGAAGCG GCGGGAGGGT
201  ATCCGTTTAT CAGATGTTGT GGCCTATCCG TTATCGGTG GCGGCTGTGT
251  GTCTGATGAG TCCGGGATTC GTATCCTCGG TGTTGGCGGT ATTGCTGCTG
301  CTGCCGTTTA AGGGAGGGGC AGTGTTGCAG GCAGGAGGTG CGGAAAATTT
351  TTTCAACATG AACCAATCGG GCAGAAAAGA GGGCTTTTCC CGCGATGACG
401  ATATTATCGA GGGAGAATAT ACGGTTGAAG AGCCTTACGG CGGCAATCGT
451  TCCCGAAACG CCATCGAACA CAAAAAAGAC GAATAA
```

This corresponds to the amino acid sequence (SEQ ID NO: 280; ORF73-1):

```
  1  MRFFGIGFLV LLFLEIMSIV WVADWLGGGW TLFLMAAGFA AGVLMLRHTG

51  LSGLLLAGAA MRSGGRVSVY QMLWPIRYTV AAVCLMSPGF VSSVLAVLLL

101  LPFKGGAVLQ AGGAENFFNM NQSGRKEGFS RDDDIIEGEY TVEEPYGGNR

151  SRNAIEHKKD E*
```

Computer analysis of this amino acid sequence gave the following results:
Homology with a Predicted ORF from N.meningitidis (Strain A)

ORF73 (SEQ ID NO: 278) shows 90.8% identity over a 76aa overlap with an ORF (ORF73a) (SEQ ID NO: 282) from strain A of N. meningitidis:

```
                     10         20         30         40         50         60
orf73.pep  MRFFGIGFLVLLFLEIMSIVWVADWLGGGWTLFLMAAGFAAGVLMLRQTGLTGLLLAGAA
           ||||||||||||||||||||||||||||||  ||||:||:|||:||||||||
orf73a     MRFFGIGFLVLLFLEIMSIVWVADWLGGGWTLFLMAATFAAGVVMLRHTGLSGLLLAGAA
                     10         20         30         40         50         60 orf73.pep  MRSGGKVSVYQMLWPI
           |||||:|||| ||| |
orf73a     MRSGGRVSVYXMLWXIRYTVAAVCXMSPGFVSSVXAVLLXLPFKGGAVLQAGGAENFFNM
                     25
```

The complete length ORF73a nucleotide sequence (SEQ ID NO: 281) is:

```
  1  ATGAGATTTT TCGGTATCGG TTTTTTGGTG CTGCTGTTTT TGGAGATTAT

51  GTCGATTGTG TGGGTTGCCG ATTGGTTGGG CGGCGGTTGG ACGCTGTTTC

101  TAATGGCGGC AACCTTTGCC GCCGGCGTGG TGATGCTCAG GCATACGGGG

151  CTGTCCGGTC TTTTATTGGC GGGCGCGGCA ATGAGAAGCG GCGGGAGGGT

201  ATCCGTTTAT CANATGTTGT GGCNTATCCG TTATACGGTG GCGGCGGTGT

251  GTCNGATGAG TCCGGGATTC GTATCCTCGG TGTNGGCGGT ATTGCTGNTG

301  CTNCCGTTTA AGGGAGGTGC AGTGTTGCAG GCAGGAGGTG CGGAAAATTT

351  TTTCAACATG AACCANTCGG GCAGAAAAGA NGGCNTTTCC CGCGATGACG

401  ATATTATCGA GGGGGAATAT ACGGTTGAAG ANCCTTACGG CGGCANTCGT

451  TTCCGAAACG CCNTNGAACA CAAAAAAGAC GAATAA
              45
```

This encodes a protein having amino acid sequence (SEQ ID NO: 282):

```
  1  MRFFGIGFLV LLFLEIMSIV WVADWLGGGW TLFLMAATFA AGVVMLRHTG

51  LSGLLLAGAA MRSGGRVSVY XMLWXIRYTV AAVCXMSPGF VSSVXAVLLX

101  LPFKGGAVLQ AGGAENFFNM NXSGRKXGXS RDDDIIEGEY TVEXPYGGXR

151  FRNAXEHKKD E*
```

ORF73a (SEQ ID NO: 282) and ORF73-1 (SEQ ID NO: 280) show 91.3% identity in 161 aa overlap

```
                     10         20         30         40         50         60
orf73a.pep MRFFGIGFLVLLFLEIMSIVWVADWLGGGWTLFLMAATFAAGVVMLRHTGLSGLLLAGAA
           |||||||||||||||||||||||||||||||||||:||||||||||||
orf73-1    MRFFGIGFLVLLFLEIMSIVWVADWLGGGWTLFLMAAGFAAGVMLRHTGLSGLLLAGAA
                     10         20         30         40         50         60
```

```
                      -continued
                  70        80        90       100       110       120
orf73a.pep   MRSGGRVSVYXMLWXIRYTVAAVCXMSPGFVSSVXAVLLXLPFKGGAVLQAGGAENFFNM
             ||||||||||  |||  ||||||||||| |||||||||||| ||||  |||||||||||||||||||||||
orf73-1      MRSGGRVSVYQMLWPIRYTVAAVCLMSPGFVSSVLAVLLLLPFKGGAVLQAGGAENFFNM
                  70        80        90       100       110       120

130       140       150       160
orf73a.pep   NXSGRKXGXSRDDDIIEGEYTVEXPYGGXRFRNAXEHKKDEX
             |  ||||  |  ||||||||||||||  ||||  |  |  |||||||||
orf73-1      NQSGRKEGFSRDDDIIEGEYTVEEPYGGNRSRNAIEHKKDEX
                 130       140       150       160
```

Homology with a Predicted ORF from *N.gonorrhoeae*

ORF73 (SEQ ID NO: 278) shows 92.1% identity over a 76aa overlap with a predicted ORF (ORF73.ng) (SEQ ID NO: 284) from *N. gonorrhoeae*:

```
orf73.pep   MRFFGIGFLVLLFLEIMSIVWVADWLGGGWTLFLMAAGFAAGVLMLRQTGLTGLLLAGAA   60
            ||||||||||||||||||||||||||||||||||||||||| |||||||||||:|||:|||||||||
orf73ng     MRFFGIGFLVLLFLEIMSIVWVADWLGGGWTLFLMAATFAAGVLMLRHTGLSGLLLAGAA   60 orf73.pep   MRSGGKVSVYQMLWPI                                             76
            ::|:||||||||||||
orf73ng     VKSSGKVSVYQMLWPIRYTVAAVCLMSPGFVSSVLAVLLLLPFKGGAVLQAGGAENFFNM  120
```

The complete length ORF73ng nucleotide sequence (SEQ ID NO: 283) is:

```
  1  ATGAGATTTT TCGGTATCGG TTTTTTGGTG CTGCTGTTTT TGGAAATTAT

51  GTCGATTGTG TGGGTTGCCG ATTGGCTGGG CGGCGGTTGG AcgcTGTTTC

101  TAATGGCGGC AACCTTTGCC GCCGGTGTGC TGATGCTCAG GCATAcggGG

151  CTGTCCGGTC TTTTATTGGC TGGCGCGGCG GTAAAAagta gtgGGAAGGT

201  ATCTGTTTAT CagatgtTGT GGCCTATCCG TTATAcggtg gcggcggtgT

251  GTCTGatgag tCcggGATTC GTATCCTccg tgttggCGGT ATTGCTGCTG

301  CTGCCgttta aggGaggGgc agtgttgcag gcaggaggtg cggaaaATTT

351  TTTCAACATg aaCcaatcgg gcagaaAaga gggattttc  cacgatgacg 401  atattatcga gggagaatat acggttgaaa aacctgacgg cggcaatcgt 451  tcccgaAAcg ccatcgaaca cgaaaAagac gaataA
```

This encodes a protein having amino acid sequence (SEQ ID NO: 284):

```
  1  MRFFGIGFLV LLFLEIMSIV WVADWLGGGW TLFLMAATFA AGVLMLRHTG

51  LSGLLLAGAA VKSSGKVSVY QMLWPIRYTV AAVCLMSPGF VSSVLAVLLL

101  LPFKGGAVLQ AGGAENFFNM NQSGRKEGFF HDDDIIEGEY TVEKPDGGNR

151  SRNAIEHEKD E*
```

ORF73ng (SEQ ID NO: 284) and ORG73-1 (SEQ ID NO: 280) show 93.8% identity in 161 aa overlap

```
                  10        20        30        40        50        60
orf73-1.pep  MRFFGIGFLVLLFLEIMSIVWVADWLGGGWTLFLMAAGFAAGVLMLRHTGLSGLLLAGAA
             |||||||||||||||||||||||||||||||||||||| ||||||||||||||||||||||||
orf73ng      MRFFGIGFLVLLFLEIMSIVWVADWLGGGWTLFLMAATFAAGVLMLRHTGLSGLLLAGAA
                  10        20        30        40        50        60
```

```
                       70         80         90        100        110        120
orf73-1.pep  MRSGGRVSVYQMLWPIRYTVAAVCLMSPGFVSSVLAVLLLLPFKGGAVLQAGGAENFFNM
             ::|:|:||||||||||||||||||||||||||||||||||||||||||||||||||||||
orf73ng      VKSSGKVSVYQMLWPIRYTVAAVCLMSPGFVSSVLAVLLLLPFKGGAVLQAGGAENFFNM
                       70         80         90        100        110        120

130        140        150        160
orf73-1.pep  NQSGRKEGFSRDDDIIEGEYTVEEPYGGNRSRNAIEHKKDEX
             |||||||||:||||||||||||||:|:|||||||||||:|||
orf73ng      NQSGRKEGFFHDDDIIEGEYTVEKPDGGNRSRNAIEHEKDEX
                      130        140        150        160
```

Based on this analysis, including the presence of a putative leader sequence and putative transmembrane domain in the gonococcal protein, it is predicted that the proteins from *N.meningitidis* and *N.gonorrhoeae*, and their epitopes, could be useful antigens for vaccines or diagnostics, or for raising antibodies.

Example 34

The following partial DNA sequence was identified in *N.meningitidis* (SEQ ID NO: 285):

```
  1  ATGTTTGTTT TTCAGACGGC ATTCTT.ATG TTTCAGAAAC ATTTGCAGAA
 51  AGCCTCCGAC AGCGTCGTCG GAGGGACATT ATACGTGGTT GCCACGCCCA
101  TCGGCCATTT GGCGGACATT ACCCTGCGCG CTTTGGCGGT ATTGCAAAAG
151  GCG....... .....GCCGA AGACACGCGC GTTACCGCAC AGCTTTTGAG
201  CGCGTACGGC ATTCAGGGCA AACTCGTCAG TGTGCGCGAA CACAACGAAC
251  GGCAGATGGC GGACAAGATT GTCGGCTATC TTTCAGACGG CATGGTTGTG
301  GCACAGGTTT CCGATGCGGG TACGCCGGCC GTGTGCGACC CGGGCGCGAA
351  ACTCGCCCGC CGCGTGCGTG AGGCCGGGTT TAAAGTCGTT CCCGTCGTGG
401  GCGCAAC.GC GGTGATGGCG GCTTTGAGCG TGGCCGGTGT GGAAGGATCC
451  GATTTTTATT TCAACGGTTT TGTACCGCCG AAATCGGGAG AACGCAGGAA
501  ACTGTTTGCC AAATGGGTGC GGGCGGCGTT TCCTATCGTC ATGTTTGAAA
551  CGCCGCACCG CATCGGTGCA GCGCTTGCCG ATATGGCGGA ACTGTTCCCC
601  GAACGCCGAT TAATGCTGGC GCGCGAAATT ACGAAAACGT TTGAAACGTT
651  CTTAAGCGGC ACGGTTGGGG AAATTCAGAC GGCATTGTCT GCCGACGGCG
701  ACCAATCGCG CGGCGAGATG GTGTTGGTGC TTTATCCGGC GCAGGATGAA
751  AAACACGAAG GCTTGTCCGA GTCCGCGCAA AACATCATGA AAATCCTCAC
801  AGCCGAGCTG CCGACCAAAC AGGCGGCGGA GCTTGCTGCC AAAATCACGG
851  GCGAGGGAAA GAAAGCTTTG TACGAT..
```

This corresponds to the amino acid sequence (SEQ ID NO: 286; ORF75):

```
  1  MFVFQTAFXM FQKHLQKASD SVVGGTLYVV ATPIGNLADI TLRALAVLQK
 51  A....AEDTR VTAQLLSAYG IQGKLVSVRE HNERQMADKI VGYLSDGMVV
101  AQVSDAGTPA VCDPGAKLAR RVREAGFKVV PVVGAXAVMA ALSVAGVEGS
151  DFYFNGFVPP KSGERRKLFA KWVRAAFPIV MFETPHRIGA ALADMAELFP
201  ERRLMLAREI TKTFETFLSG TVGEIQTALS ADGDQSRGEM VLVLYPAQDE
251  KHEGLSESAQ NIMKILTAEL PTKQAAELAA KITGEGKKAL YD..
```

Further work revealed the complete nucleotide sequence (SEQ ID NO: 287):

```
  1 ATGTTTCAGA AACATTTGCA GAAAGCCTCC GACAGCGTCG TCGGAGGGAC
 51 ATTATACGTG GTTGCCACGC CCATCGGCAA TTTGGCGGAC ATTACCCTGC
101 GCGCTTTGGC GGTATTGCAA AAGGCGGACA TCATCTGTGC CGAAGACACG
151 CGCGTTACCG CACAGCTTTT GAGCGCGTAC GGCATTCAGG GCAAACTCGT
201 CAGTGTGCGC GAACACAACG AACGGCAGAT GGCGGACAAG ATTGTCGGCT
251 ATCTTTCAGA CGGCATGGTT GTGGCACAGG TTTCCGATGC GGGTACGCCG
301 GCCGTGTGCG ACCCGGGCGC GAAACTCGCC CGCCGCGTGC GTGAGGCCGG
351 GTTTAAAGTC GTTCCCGTCG TGGGCGCAAG CGCGGTGATG GCGGCTTTGA
401 GCGTGGCCGG TGTGGAAGGA TCCGATTTTT ATTTCAACGG TTTTGTACCG
451 CCGAAATCGG GAGAACGCAG GAAACTGTTT GCCAAATGGG TGCGGGCGGC
501 GTTTCCTATC GTCATGTTTG AAACGCCGCA CCGCATCGGT GCGACGCTTG
551 CCGATATGGC GGAACTGTTC CCCGAACGCC GATTAATGCT GGCGCGCGAA
601 ATTACGAAAA CGTTTGAAAC GTTCTTAAGC GGCACGGTTG GGGAAATTCA
651 GACGGCATTG TCTGCCGACG GCAACCAATC GCGCGGCGAG ATGGTGTTGG
701 TGCTTTATCC GGCGCAGGAT GAAAAACACG AAGGCTTGTC CGAGTCCGCG
751 CAAAACATCA TGAAAATCCT CACAGCCGAG CTGCCGACCA AACAGGCGGC
801 GGAGCTTGCT GCCAAAATCA CGGGCGAGGG AAAGAAAGCT TTGTACGATC
851 TGGCTCTGTC TTGGAAAAAC AAATAG
```

This corresponds to the amino acid sequence (SEQ ID NO: 288; ORF75-1):

```
  1 MFQKHLQKAS DSVVGGTLYV VATPIGNLAD ITLRALAVLQ KADIICAEDT
 51 RVTAQLLSAY GIQGKLVSVR EHNERQMADK IVGYLSDGMV VAQVSDAGTP
101 AVCDPGAKLA RRVREAGFKV VPVVGASAVM AALSVAGVEG SDFYFNGFVP
151 PKSGERRKLF AKWVRAAFPI VMFETPHRIG ATLADMAELF PERRLMLARE
201 ITKTFETFLS GTVGEIQTAL SADGNQSRGE MVLVLYPAQD EKHEGLSESA
251 QNIMKILTAE LPTKQAAELA AKITGEGKKA LYDLALSWKN K*
```

Computer analysis of this amino acid sequence gave the following results:
Homology with a Predicted ORF from *N.meningitidis* (Strain A)

ORF75 (SEQ ID NO: 286) shows 95.8% identity over a 283aa overlap with an ORF (ORF75a) (SEQ ID NO: 290) from strain A of *N. meningitidis*:

```
                        10         20         30         40         50         60
orf75.pep  MFVFQTAFXMFQKHLQKASDSVVGGTLYVVATPIGNLADITLRALAVLQKAXXXXXAEDTR
                    ||||||||||||||||||||||||||||||||||||||||||     |||||
orf75a              MFQKHLQKASDSVVGGTLYVVATPIGNLADITLRALAVLQKADIICAEDTR
                            10         20         30         40         50

70         80         90        100        110        120
orf75.pep  VTAQLLSAYGIQGKLVSVREHNERQMADKIVGYLSDGMVVAQVSDAGTPAVCDPGAKLAR
           ||||||||||||||||||||||||||||||||||||||||||||||||||||||||||||
orf75a     VTAQLLSAYGIQGKLVSVREHNERQMADKIVGYLSDGMVVAQVSDAGTPAVCDPGAKLAR
                    60         70         80         90        100        110
```

```
                  130        140        150        160        170        180
orf75.pep RVREAGFKVVPVVGAXAVMAALSVAGVEGSDFYFNGFVPPKSGERRKLFAKWVRAAFPIV
          ||||:|||||||||| |||||||||| |||||||||||||||||||||||||||:|||:|
orf75a    RVREVGFKVVPVVGASAVMAALSVAGVAGSDFYFNGFVPPKSGERRKLFAKWVRVAFPIV
                  120        130        140        150        160        170

190        200        210        220        230        240
orf75.pep MFETPHRIGAALADMAELFPERRLMLAREITKTFETFLSGTVGEIQTALSADGDQSRGEM
          ||||||||||:|||||||||||||||||||||||||||||||||||||||:|||:|||||
orf75a    MFETPHRIGATLADMAELFPERRLMLAREITKTFETFLSGTVGEIQTALAADGNQSRGEM
                  180        190        200        210        220        230

250        260        270        280        290
orf75.pep VLVLYPAQDEKHEGLSESAQNIMKILTAELPTKQAAELAAKITGEGKKALYD
          ||||||||||||||||||||||||||||||||||||||||||||||||||||
orf75a    VLVLYPAQDEKHEGLSESAQNIMKILTAELPTKQAAELAAKITGEGKKALYDLALSWKNK
                  240        250        260        270        280        290 orf75a    X
```

The complete length ORF75a nucleotide sequence (SEQ ID NO: 289) is:

```
  1 ATGTTTCAGA AACATTTGCA GAAAGCCTCC GACAGCGTCG TCGGAGGGAC

51 ATTATACGTG GTTGCCACGC CCATCGGCAA TTTGGCGGAC ATTACCCTGC

101 GCGCTTTGGC GGTATTGCAA AAGGCGGACA TCATCTGTGC CGAAGACACG

151 CGCGTTACCG CGCAGCTTTT GAGCGCGTAC GGCATTCAGG GCAAACTCGT

201 CAGCGTGCGC GAACACAACG AACGGCAGAT GGCGGACAAG ATTGTCGGCT

251 ATCTTTCAGA CGGCATGGTT GTGGCACAGG TTTCCGATGC GGGTACGCCG

301 GCCGTGTGCG ACCCGGGCGC GAAACTCGCC CGCCGCGTGC GTGAGGTCGG

351 GTTTAAAGTT GTCCCTGTTG TCGGCGCAAG CGCGGTGATG GCGGCTTTGA

401 GTGTGGCTGG TGTGGCGGGA TCCGATTTTT ATTTCAACGG TTTTGTACCG

451 CCGAAATCGG GCGAACGTAG GAAATTGTTT GCCAAATGGG TGCGGGTGGC

501 GTTTCCCGTC GTGATGTTTG AAACGCCGCA CCGCATCGGG GCGACGCTTG

551 CCGATATGGC GGAACTGTTC CCCGAACGCC GATTAATGCT GGCGCGCGAA

601 ATCACGAAAA CGTTTGAAAC GTTCTTAAGC GGCACGGTTG GGGAAATTCA

651 GACGGCATTG GCGGCGGACG GCAACCAATC GCGCGGCGAG ATGGTGTTGG

701 TGCTTTATCC GGCGCAGGAT GAAAAACACG AAGGCTTGTC CGAGTCCGCG

751 CAAAACATCA TGAAAATCCT CACAGCCGAG CTGCCGACCA AACAGGCGGC

801 GGAGCTTGCC GCCAAAATCA CGGGCGAGGG AAAAAAAGCT TTGTACGATC

851 TGGCACTGTC TTGGAAAAAC AAATGA
```

This encodes a protein having amino acid sequence (SEQ ID NO: 290):

```
  1 MFQKHLQKAS DSVVGGTLYV VATPIGNLAD ITLRALAVLQ KADIICAEDT

51 RVTAQLLSAY GIQGKLVSVR EHNERQMADK IVGYLSDGMV VAQVSDAGTP

101 AVCDPGAKLA RRVREVGFKV VPVVGASAVM AALSVAGVAG SDFYFNGFVP

151 PKSGERRKLF AKWVRVAFPV VMFETPHRIG ATLADMAELF PERRLMLARE

201 ITKTFETFLS GTVGEIQTAL AADGNQSRGE MVLVLYPAQD EKHEGLSESA

251 QNIMKILTAE LPTKQAAELA AKITGEGKKA LYDLALSWKN K*
```

ORF75a (SEQ ID NO: 290) and ORF75-1 (SEQ ID NO: 288) show 98.3% identity in 291 aa overlap:

```
                    10         20         30         40         50         60
orf75a.pep  MFQKHLQKASDSVVGGTLYVVATPIGNLADITLRALAVLQKADIICAEDTRVTAQLLSAY
            ||||||||||||||||||||||||||||||||||||||||||||||||||||||||||||
orf75-1     MFQKHLQKASDSVVGGTLYVVATPIGNLADITLRALAVLQKADIICAEDTRVTAQLLSAY
                    10         20         30         40         50         60

70         80         90        100        110        120
orf75a.pep  GIQGKLVSVREHNERQMADKIVGYLSDGMVVAQVSDAGTPAVCDPGAKLARRVREVGFKV
            |||||||||||||||||||||||||||||||||||||||||||||||||||||:||||
orf75-1     GIQGKLVSVREHNERQMADKIVGYLSDGMVVAQVSDAGTPAVCDPGAKLARRVREAGFKV
                    70         80         90        100        110        120

130        140        150        160        170        180
orf75a.pep  VPVVGASAVMAALSVAGVAGSDFYFNGFVPPKSGERRKLFAKWVRVAFPVVMFETPHRIG
            |||||||||||||||||||| |||||||||||||||||||||||:|||:|||||||||||
orf75-1     VPVVGASAVMAALSVAGVEGSDFYFNGFVPPKSGERRKLFAKWVRAAFPIVMFETPHRIG
                   130        140        150        160        170        180

190        200        210        220        230        240
orf75a.pep m ATLADMAELFPERRLMLAREITKTFETFLSGTVGEIQTALAADGNQSRGEMVLVLYPAQD
            ||||||||||||||||||||||||||||||||||||||||:|||||||||||||||||||
orf75-1     ATLADMAELFPERRLMLAREITKTFETFLSGTVGEIQTALSADGNQSRGEMVLVLYPAQD
                   190        200        210        220        230        240

250        260        270        280        290
orf75a.pep  EKHEGLSESAQNIMKILTAELPTKQAAELAAKITGEGKKALYDLALSWKNKX
            ||||||||||||||||||||||||||||||||||||||||||||||||||||
orf75-1     EKHEGLSESAQNIMKILTAELPTKQAAELAAKITGEGKKALYDLALSWKNKX
                   250        260        270        280        290
```

Homology with a Predicted ORF from N.gonorrhoeae ORF75 (SEQ ID NO: 286) shows 93.2% identity over a 292aa overlap with a predicted ORF (ORF75ng) (SEQ ID NO: 292) from N. gonorrhoeae:

```
orf75.pep   MFVFQTAFXMFQKHLQKASDSVVGGTLYVVATPIGNLADITLRALAVLQKA----AEDTR    56
            |  ||||| ||||||||||||||||||||||||||||||||||||||||||    |||||
orf75ng     MSVFQTAFFMFQKHLQKASDSVVGGTLYVVATPIGNLADITLRALAVLQKADIICAEDTR    60 orf75.pep   VTAQLLSAYGIQGKLVSVREHNERQMADKIVGYLSDGMVVAQVSDAGTPAVCDPGAKLAR   116
            |||||||||||:|||||||||||||||::|:||||:||||||||||||||||||||||||
orf75ng     VTAQLLSAYGIQGRLVSVREHNERQMADKVIGFLSDGLVVAQVSDAGTPAVCDPGAKLAR   120 orf75.pep   RVREAGFKVVPVVGAXAVMAALSVAGVEGSDFYFNGFVPPKSGERRKLFAKWVRAAFPIV   176
            |||||||||||||||  |||||||||||| |||||||||||||||||||||||||||:|
orf75ng     RVREAGFKVVPVVGASAVMAALSVAGVAESDFYFNGFVPPKSGERRKLFAKWVKAAPPVV   180 orf75.pep   MFETPHRIGAALADMAELFPERRLMLAREITKTFETFLSGTVGEIQTALSADGDQSRGEM   236
            |||||||||| |||||||||||||||||||||||||||||||||||||:|||:||||||
orf75ng     MFETPHRIGATLADMAELFPERRLMLAREITKTFETFLSGTVGEIQTALAADGNQSRGEM   240 orf75.pep   VLVLYPAQDEKHEGLSESAQNIMKILTAELPTKQAAELAAKITGEGKKALYD           288
            ||||||||||||||||||||| ||||:|||||||||||||||||||||||||
orf75ng     VLVLYPAQDEKHEGLSESAQNAMKILAAELPTKQAAELAAKITGEGKKALYDLALSWKNK   300
```

An ORF75ng nucleotide sequence (SEQ ID NO: 291) was predicted to encode a protein having amino acid sequence (SEQ ID NO: 292):

```
  1 MSVFQTAFFM FQKHLQKASD SVVGGTLYVV ATPIGNLADI TLRALAVLQK

51 ADIICAEDTR VTAQLLSAYG IQGRLVSVRE HNERQMADKV IGFLSDGLVV

101 AQVSDAGTPA VCDPGAKLAR RVREAGFKVV PVVGASAVMA ALSVAGVAES

151 DFYFNGPVPP KSGERRKLPA KWVRAAFPVV MFETPHRIGA TLADMAELFP

201 ERRLMLAREI TKTFETFLSG TVGEIQTALA ADGNQSRGEM VLVLYPAQDE

251 KHEGLSESAQ NAMKILAAEL PTKQAAELAA KITGEGKKAL YDLALSWKNK

301 *
```

After further analysis, the following gonococcal DNA sequence (SEQ ID NO: 293) was identified:

```
  1 ATGTTTCAGA AACACTTGCA GAAAGCCTCC GACAGCGTCG TCGGAGGGAC

51 ATTATACGTG GTTGCCACGC CCATCGGCAA TTTGGCAGAC ATTACCCTGC

101 GCGCTTTGGC GGTATTGCAA AAGGCGGACA TCATTTGTGC CGAAGACACG

151 CGCGTTACTG CGCAGCTTTT GAGCGCGTAC GGCATTCAGG GCAGGTTGGT

201 CAGTGTGCGC GAACACAACG AGCGGCAGAT GGCGGACAAG GTAATCGGTT

251 TCCTTTCAGA CGGCCTGGTT GTGGCGCAGG TTTCCGATGC GGGTACGCCG

301 GCCGTGTGCG ACCCGGGCGC GAAACTCGCC CGCCGCGTGC GCGAAGCAGG

351 GTTCAAAGTC GTTCCCGTCG TGGGCGCAAG CGCGGTAATG GCGGCGTTGA

401 GTGTGGCCGG TGTGGCGGAA TCCGATTTTT ATTTCAACGG TTTTGTACCG

451 CCGAAATCGG GCGAACGTAG GAAATTGTTT GCCAAATGGG TGCGGGCGGC

501 ATTTCCTGTC GTCATGTTTG AAACGCCGCA CCGAATCGGG GCAACGCTTG

551 CCGATATGGC GGAATTGTTC CCCGAACGCC GTCTGATGCT GGCGCGCGAA

601 ATCACGAAAA CGTTTGAAAC GTTCTTAAGC GGCACGGTTG GGGAAATTCA

651 GACGGCATTG GCGGCGGACG GCAACCAATC GCGCGGCGAG ATGGTGTTGG

701 TGCTTTATCC GGCGCAGGAT GAAAAACACG AAGGCTTGTC CGAGTCTGCG

751 CAAAATGCGA TGAAAATCCT TGCGGCCGAG CTGCCGACCA AGCAGGCGGC

801 GGAGCTTGCC GCCAAGATTA CAGGTGAGGG CAAAAAGGCT TTGTACGATT

851 TGGCACTGTC GTGGAAAAAC AAATGA
```

This corresponds to the amino acid sequence (SEQ ID NO: 294; ORF75ng-1):

```
  1 MFQKHLQKAS DSVVGGTLYV VATPIGNLAD ITLRALAVLQ KADIICAEDT

51 RVTAQLLSAY GIQGRLVSVR EHNERQMADK VIGFLSDGLV VAQVSDAGTP

101 AVCDPGAKLA RRVREAGFKV VPVVGASAVM AALSVAGVAE SDFYFNGFVP

151 PKSGERRKLF AKWVRAAFPV VMFETPMRIG ATLADMAELF PERRLMLARE

201 ITKTFETFLS GTVGEIQTAL AADGNQSRGE MVLVLYPAQD EKHEGLSESA

251 QNAMKILAAE LPTKQAAELA AKITGEGKKA LYDLALSWKN K*
```

ORF75ng-1 (SEQ ID NO: 294) and ORF75-1 (SEQ ID NO: 288) show 96.2% identity in 291 aa overlap:

```
                  10         20         30         40         50         60
orf75-1.pep   MFQKHLQKASDSVVGGTLYVVATPIGNLADITLRALAVLQKADIICAEDTRVTAQLLSAY
              ||||||||||||||||||||||||||||||||||||||||||||||||||||||||||||
orf75ng-1     MFQKHLQKASDSVVGGTLYVVATPIGNLADITLRALAVLQKADIICAEDTRVTAQLLSAY
                  10         20         30         40         50         60

70         80         90        100        110        120
orf75-1.pep   GIQGKLVSVREHNERQMADKIVGYLSDGMVVAQVSDAGTPAVCDPGAKLARRVREAGFKV
              ||||:|||||||||||||||::::|||||:||||||||||||||||||||||||||||||
orf75ng-1     GIQGRLVSVREHNERQMADKVIGFLSDGLVVAQVSDAGTPAVCDPGAKLARRVREAGFKV
                  70         80         90        100        110        120

130        140        150        160        170        180
orf75-1.pep   VPVVGASAVMAALSVAGVEGSDFYFNGFVPPKSGERRKLFAKWVRAAFPIVMFETPHRIG
              ||||||||||||||||||  ||||||||||||||||||||||||||||||:|||||||||
orf75ng-1     VPVVGASAVMAALSVAGVAESDFYFNGFVPPKSGERRKLFAKWVRAAFPVVMFETPHRIG
                 130        140        150        160        170        180
```

```
                     190        200        210        220        230        240
orf75-1.pep   ATLADMAELFPERRLMLAREITKTFETFLSGTVGEIQTALSADGNQSRGEMVLVLYPAQD
              ||||||||||||||||||||||||||||||||||||||||||:|||||||||||||||||
orf75ng-1     ATLADMAELFPERRLMLAREITKTFETFLSGTVGEIQTALAADGNQSRGEMVLVLYPAQD
                     190        200        210        220        230        240

250        260        270        280        290
orf75-1.pep   EKHEGLSESAQNIMKILTAELPTKQAAELAAKITGEGKKALYDLALSWKNKX
              |||||||||||| ||||:||||||||||||||||||||||||||||||||||
orf75ng-1     EKHEGLSESAQNAMKILAAELPTKQAAELAAKITGEGKKALYDLALSWKNKX
                     250        260        270        280        290
```

Furthermore, ORG75ng-1 (SEQ ID NO: 294) shows significant homology to a hypothetical *E.coli* protein (SEQ ID NO: 1131):

```
sp|P45528|YRAL_ECOLI HYPOTHETICAL 31.3 KD PROTEIN IN AGAI-MTR INTERGENIC REGION
(F286)
)gi|606086 (U18997) ORF_f286 [Escherichia coli]
)gi|1789535 (AE000395) hypothetical 31.3 kD protein in agai-mtr intergenic region
[Escherichia coli] Length = 286
Score = 218 bits (550), Expect = 3e-56
Identities = 128/284 (45%), Positives = 171/284 (60%), Gaps = 4/284 (1%)

Query:     4 KHLQKASDSVVGGTLYVVATPIGNLADITLRALAVLQKADIICAEDTRVTAQLLSAYGIQ       63
             K  Q A +S    G LY+V TPIGNLADIT RAL VLQ  D+I AEDTR T LL  +GI
Sbjct:     2 KQHQSADNSQ--GQLYIVPTPIGNLADITQRALEVLQAVDLIAAEDTRHTGLLLQHFGIN       59

Query:    64 GRLVSVREHNERQMADKVIGFLSDGLVVAQVSDAGTPAVCDPGAKLARRVREAGFKVVPV      123
                RL ++ +HNE+Q A+ ++  L +G  +A VSDAGTP + DPG  L R  REAG +VVP+
Sbjct:    60 ARLFALHDHNEQQKAETLLAKLQEGQNIALVSDAGTPLINDPGYHLVRTCREAGIRVVPL      119

Query:   124 VGASAVMAALSVAGVAESDFYFNGFVPPKSGERRKLFAKWVRAAFPVVMFETPHRIGATL      183
             G  A + ALS AG+    F + GF+P KS  RR            ++ +E+ HR+  +L
Sbjct:   120 PGPCAAITALSAAGLPSDRFCYEGFLPAKSKGRRDALKAIEAEPRTLIFYESTHRLLDSL      179

Query:   184 ADMAELFPERR-LMLAREITKTFETFLSGTVGEIQTALAADGNQSRGEMVLVLYPAQDEK      242
                 D+  + E R ++LARE+TKT+ET     VGE+  + D N+ +GEMVL++       +
Sbjct:   180 EDIVAVLGESRYVVLARELTKTWETIHGAPVGELLAWVKEDENRRKGEMVLIV-EGHKAQ      238

Query:   243 HEGLSESAQNAMKILAAELPTKQAAELAAKITGEGKKALYDLAL                  286
                E L   A    + +L AELP K+AA LAA+I  G K ALY  AL
Sbjct:   239 EEDLPADALRTLALLQAELPLKKAAALAAEIHGVKKNALYKYAL                  282
```

Based on this analysis, including the presence of a putative transmembrane domain in the gonococcal protein, it is predicted that the proteins from *N.meningitidis* and *N.gonorrhoeae*, and their epitopes, could be useful antigens for vaccines or diagnostics, or for raising antibodies.

Example 35

The following partial DNA sequence was identified in *N.meningitidis* (SEQ ID NO: 295):

```
  1 ATGAAACAGA AAAAACCGC TGCCGCAGTT ATTGCTGCAA TGTTGGCAGG

51 TTTTGCGGCA GC.AAAGCAC CGAAATCGA CCCGGCTTTG ..........

//

651 .......... ...GAGTTGG TCAGAAACCA GTTGGAGCAG GGTTTGAGAC

701 AGGAAAAAGC CCGCTTGAAA ATCGATGCCC TTTTGGAAGA AAACGGTGTC

751 AAACCGTAA
```

This corresponds to the amino acid sequence (SEQ ID NO: 296; ORF16):

```
  1 MKQKKTAAAV IAAMLAGFAA XKAPEIDPAL .......... ..........

//

201 .......... .......... ELVRNQLEQG LRQEKARLKI DALLEENGVK

251 P*
```

Further work revealed the complete nucleotide sequence (SEQ ID NO: 297):

```
  1 ATGAAACAGA AAAAAACCGC TGCCGCAGTT ATTGCTGCAA TGTTGGCAGG

51 TTTTGCGGCA GCCAAAGCAC CCGAAATCGA CCCGGCTTTG GTGGATACGC

101 TGGTGGCGCA GATCATGCAG CAGGCAGACC GGCATGCGGA GCAGTCCCAA

151 AAACCGGACG GCAGGCAAT CCGAAACGAT GCCGTCCGCC GGCTACAAAC

201 TTTGGAAGTT TTGAAAAACA GGGCATTGAA GGAAGGTTTG GATAAGGATA

251 AGGATGTCCA AAACCGCTTT AAAATCGCCG AAGCGTCTTT TTATGCCGAG

301 GAGTACGTCC GTTTTCTGGA ACGTTCGGAA ACGGTTTCCG AAGACGAGCT

351 GCACAAGTTT TACGAACAGC AAATCCGCAT GATCAAATTG CAGCAGGTCA

401 GCTTCGCAAC CGAAGAGGAG GCGCGTCAGG CGCAGCAGCT CCTGCTCAAA

451 GGGCTGTCTT TTGAAGGGCT GATGAAGCGT TATCCGAACG ACGAGCAGGC

501 TTTTGACGGT TTCATTATGG CGCAGCAGCT TCCCGAGCCG CTGGCTTCGC

551 AGTTTGCCGC GATGAATCGG GGCGACGTTA CCCGCGATCC GGTCAAATTG

601 GGCGAACGCT ATTATCTGTT CAAACTCAGC GAGGTCGGGA AAAACCCCGA

651 CGCGCAGCCT TTCGAGTTGG TCAGAAACCA GTTGGAGCAG GGTTTGAGAC

701 AGGAAAAAGC CCGCTTGAAA ATCGATGCCC TTTTGGAAGA AAACGGTGTC

751 AAACCGTAA
```

This corresponds to the amino acid sequence (SEQ ID NO: 298; ORF76-1):

```
  1 MKQKKTAAAV IAAMLAGFAA AKAPEIDPAL VDTLVAQIMQ QADRHAEQSQ

51 KPDGQAIRND AVRRLQTLEV LKNRALKEGL DKDKDVQNRF KIAEASFYAE

101 EYVRFLERSE TVSEDELHKF YEQQIRMIKL QQVSFATEEE ARQAQQLLLK

151 GLSFEGLMKR YPNDEQAFDG FIMAQQLPEP LASQFAAMNR GDVTRDPVKL

201 GERYYLFKLS EVGKNPDAQP FELVRNQLEQ GLRQEKARLK IDALLEENGV

251 KP*
```

Computer analysis of this amino acid sequence gave the following results:
Homology with a Predicted ORF from *N.meningitidis* (Strain A)

ORF76 (SEQ ID NO: 296) shows 96.7% identity over a 30aa overlap and 96.8% identity over a 31aa overlap with an ORF (ORF76a) (SEQ ID NO: 300) from strain A of *N. meningiridis*:

```
                           10        20        30
orf76.pep MKQKKTAAAVIAAMLAGFAAXKAPEIDPAL
          |||||||||||||||||||| |||||||||
orf76a    MKQKKTAAAVIAAMLAGFAAAKAPEIDPALVDTLVAQIMQQADRHAEQSQKPDGQAIRND
                    10        20        30        40        50        60
                                     //
```

```
                              70         80         90
orf76.pep               XELVRNQLEQGLRQEKARLKIDALLEENGVKPX
                        ||||||||||||||||||||||||:||||||||
orf76a      DVTRDPVKLGERYYLFKLSEVGKNPDAQPFELVRNQLEQGLRQEKARLKIDAILEENGVKPX
                200       210       220       230       240       250
```

The complete length ORF76a nucleotide sequence (SEQ ID NO: 299) is:

```
  1  ATGAAACAGA AAAAAACCGC TGCCGCAGTT ATTGCTGCAA TGTTGGCAGG
 51  TTTTGCGGCA GCCAAAGCAC CCGAAATCGA CCCGGCTTTG GTGGATACGC
101  TGGTGGCGCA GATCATGCAG CAGGCAGACC GGCATGCGGA GCAGTCCCAA
151  AAACCGGACG GGCAGGCAAT CCGAAACGAT GCCGTCCGTC GGCTGCAAAC
201  TTTGGAAGTT TTGAAAAACA GGGCATTGAA GGAAGGTTTG GATAAGGATA
251  AGGATGTCCA AAACCGCTTT AAAATCGCCG AAGCGTCTTT TTATGCCGAG
301  GAGTACGTCC GTTTTCTGGA ACGTTCGGAA ACGGTTTCCG AAAGCGCACT
351  GCGTCAGTTT TATGAGCGGC AAATCCGCAT GATCAAATTG CAGCAGGTCA
401  GCTTCGCAAC CGAAGAGGAG GCGCGTCAGG CGCAGCAGCT CCTGCTCAAA
451  GGGCTGTCTT TTGAAGGGCT GATGAAGCGT TATCCGAACG ACGAGCAGGC
501  TTTTGACGGT TTCATTATGG CGCAGCAGCT TCCCGAGCCG CTGGCTTCGC
551  AGTTTGCAGC GATGAATCGG GGCGACGTTA CCCGCGATCC GGTCAAATTG
601  GGCGAACGCT ATTATCTGTT CAAACTCAGC GAGGTCGGGA AAAACCCCGA
651  CGCGCAGCCT TTCGAGTTGG TCAGAAACCA GTTGGAACAA GGTTTGAGAC
701  AGGAAAAAGC CCGCTTGAAA ATCGATGCCA TTTTGGAAGA AAACGGTGTC
751  AAACCGTAA
```

This encodes a protein having amino acid sequence (SEQ ID) NO: 300):

```
  1  MKQKKTAAAV IAAMLAGFAA AKAPEIDPAL VDTLVAQIMQ QADRHAEQSQ
 51  KPDGQAIRND AVRRLQTLEV LKNRALKEGL DKDKDVQNRF KIAEASFYAE
101  EYVRFLERSE TVSESALRQF YERQIRMIKL QQVSFATEEE ARQAQQLLLK
151  GLSFEGLMKR YPNDEQAFDG FIMAQQLPEP LASQFAAMNR GDVTRDPVKL
201  GERYYLFKLS EVGKNPDAQP FELVRNQLEQ GLRQEKARLK IDAILEENGV
251  KP*
```

ORF76a (SEQ ID NO: 300) and ORF76-1 (SEQ ID NO: 298) show 97.6% identity in 252 aa overlap:

```
                10         20         30         40         50         60
orf76a.pep  MKQKKTAAAVIAAMLAGFAAAKAPEIDPALVDTLVAQIMQQADRHAEQSQKPDGQAIRND
            ||||||||||||||||||||||||||||||||||||||||||||||||||||||||||||
orf76-1     MKQKKTAAAVIAAMLAGFAAAKAPEIDPALVDTLVAQIMQQADRHAEQSQKPDGQAIRND
                10         20         30         40         50         60

70         80         90        100        110        120
orf76a.pep  AVRRLQTLEVLKNRALKEGLDKDKDVQNRFKIAEASFYAEEYVRFLERSETVSESALRQF
            |||||||||||||||||||||||||||||||||||||||||||||||||||||||:|::|
orf76-1     AVRRLQTLEVLKNRALKEGLDKDKDVQNRFKIAEASFYAEEYVRFLERSETVSEDELHKF
                70         80         90        100        110        120
```

-continued

```
             130        140        150        160        170        180
orf76a.pep   YERQIRMIKLQQVSFATEEEARQAQQLLLKGLSFEGLMKRYPNDEQAFDGFIMAQQLPEP
             ||:|||||||||||||||||||||||||||||||||||||||||||||||||||||||
orf76-1      YEQQIRMIKLQQVSFATEEEARQAQQLLLKGLSFEGLMKRYPNDEQAFDGFIMAQQLPEP
             130        140        150        160        170        180

190        200        210        220        230        240
orf76a.pep   LASQFAAMNRGDVTRDPVKLGERYYLFKLSEVGKNPDAQPFELVRNQLEQGLRQEKARLK
             ||||||||||||||||||||||||||||||||||||||||||||||||||||||||||||
orf76-1      LASQFAAMNRGDVTRDPVKLGERYYLFKLSEVGKNPDAQPFELVRNQLEQGLRQEKARLK
             190        200        210        220        230        240

250
orf76a.pep   IDAILEENGVKPX
             |||:|||||||||
orf76-1      IDALLEENGVKPX
             250
```

Homolopy with a Predicted ORF from N.gonorrhoeae

The aligned aa sequences of ORF76 (SEQ ID NO: 296) and a predicted ORF (ORF76.ng) (SEQ ID NO: 302) from N. gonorrhoeae of the N- and C-termini show 96.7% and 100% identity in 30 and 31 overlap, respectively:

```
orf76.pep   MKQKKTAAAVIAAMLAGFAAXKAPEIDPAL                                30
            |||||||||||||||||||| |||||||||
orf76ng     MKQKKTAAAVIAAMLAGFAAAKAPEIDPALVDTLVAQIMQQADRHAEQSQRPDGQAIRND  60

// orf76.pep                          ELVRNQLEQGLRQEKARLKIDALLEENGVKP  251
                                   |||||||||||||||||||||||||||||||
orf76ng     VTRNPVKLGERYYLFKLGAVGKNPDAQPFELVRNQLEQGLRQEKARLKIDALLEENGVKP  251
```

The complete length ORF76ng nucleotide sequence (SEQ ID NO: 301) is:

```
  1  ATGAAACAGA AAAAGACCGC TGCCGCAGTT ATTGCTGCAA TGTTGGCAGG

51  TTTTGCGGCA GCCAAAGCAC CCGAAATCGA CCCGGCTTTG GTGGATACGC

101  TGGTGGCGCA GATCATGCAG CAGGCAGACC GGCATGCGGA GCAGTCCCAA

151  AGACCGGACG GGCAGGCAAT CCGAAACGAT GCCGTCCGCC GGCTGCAAAC

201  TTTGGAAGTT TTGAAAAACA GGGCATTGAA GGAAGGTTTG GATAAGGATA

251  AGGATGTCCA AAACCGCTTT AAAATCGCCG AAGCGTCTTT TTATGCCGAG

301  GAGTACGTCC GTTTTCTGGA ACGTTCGGAA ACGGTTTCCG AAAGCGGACT

351  GCGTCAGTTT TATGAGCGGC AAATCCGCAT GATCAAATTG CAGCAGGTCA

401  GCTTCGCAAC CCAAGAGGAG GCGCGTCAGG CGGAGCAGCT CCTGCTCAAA

451  GGGCTGTCTT TTGAAGGGCT GATGAAGCGT TATCCGAACG ACGAGCAGGC

501  GTTCGACGGT TTCATTATGG CGCAGCAGCT TCCCGAGCCG CTGGCTTcgc 551  agtttgCCGG TATGAACCGT GGCGACGTTA CCCGCAATCC GGTCAAATTG

601  GGCGAACGCT ATTACCTGTT CAAACTCGGC GCGGTCGGGA AAAACCCCGA

651  CGCGCAGCCT TTCGAGTTGG TCAGAAACCA GTTGGAACAA GGTTTGAGGC

701  AGGAAAAAGC CCGCTTGAAA ATCGATGCCC TTTTGGAaga Aaacggtgtc

751  AaacCGTAA
```

This encodes a protein having amino acid sequence (SEQ ID NO: 302):

```
  1  MKQKKTAAAV IAAMLAGFAA AKAPEIDPAL VDTLVAQIMQ QADRHAEQSQ

51  RPDGQAIRND AVRRLQTLEV LKNRALKEGL DKDKDVQNRF KIAEASFYAE

101  EYVRFLERSE TVSESALRQF YERQIRMIKL QQVSFATEEE ARQAQQLLLK

151  GLSFEGLMKR YPNDEQAFDG FIMAQQLPEP LASQFAGMNR GDVTRNPVKL

201  GERYYLFKLG AVGKNPDAQP FELVRNQLEQ GLRQEKARLK IDALLEENGV

251  KP*
```

ORF76ng (SEQ ID NO: 302) and ORF76-1 (SEQ ID NO: 298) show 96.0% identity in 252 aa overlap

```
                  10         20         30         40         50         60
orf76-1.pep  MKQKKTAAAVIAAMLAGFAAAKAPEIDPALVDTLVAQIMQQADRHAEQSQKPDGQAIRND
             ||||||||||||||||||||||||||||||||||||||||||||||||||:||||||||
orf76ng      MKQKKTAAAVIAAMLAGFAAAKAPEIDPALVDTLVAQIMQQADRHAEQSQRPDGQAIRND
                  10         20         30         40         50         60

70         80         90        100        110        120
orf76-1.pep  AVRRLQTLEVLKNRALKEGLDKDKDVQNRPKIAEASFYAEEYVRFLERSETVSEDELHKF
             ||||||||||||||||||||||||||||||:||||||||||||||||||||||||:|::|
orf76ng      AVRRLQTLEVLKNRALKEGLDKDKDVQNRFKIAEASFYAEEYVRFLERSETVSESALRQF
                  70         80         90        100        110        120

130        140        150        160        170        180
orf76-1.pep  YEQQIRMIKLQQVSFATEEEARQAQQLLLKGLSFEGLMKRYPNDEQAFDGFIMAQQLPEP
             ||:|||||||||||||||||||||||||||||||||||||||||||||||||||||||||
orf76ng      YERQIRMIKLQQVSFATEEEARQAQQLLLKGLSFEGLMKRYPNDEQAFDGFIMAQQLPEP
                 130        140        150        160        170        180

190        200        210        220        230        240
orf76-1.pep  LASQFAAMNRGDVTRDPVKLGERYYLFKLSEVGKNPDAQPFELVRNQLEQGLRQEKARLK
             ||||||:||||||||:|||||||||||||:||||||||||||||||||||||||||||||
orf76ng      LASQFAGMNRGDVTRNPVKLGERYYLFKLGAVGKNPDAQPFELVRNQLEQGLRQEKARLK
                 190        200        210        220        230        240

250
orf76-1.pep  IDALLEENGVKPX
             |||||||||||||
orf76ng      IDALLEENGVKPX
                 250
```

Furthermore, ORF76ng (SEQ ID NO: 302) shows significant homology to a *B.subtilis* export protein precursor (SEQ ID NO: 1132):

```
sp|P24327|PRSA_BACSU PROTEIN EXPORT PROTEIN PRSA PRECURSOR )gi|98227|pir||S15269
33K lipoprotein - Bacillus subtilis )gi|39782 (X57271) 33kDa lipoprotein [Bacillus subtilis]
)gi|2226124|gnl|PID|e325181 (Y14077) 33kDa lipoprotein [Bacillus subtilis]
)gi|2633331|gnl|PID|e1182997 (Z99109) molecular chaperonin [Bacillus subtilis]
Length = 292
Score = 50.4 bits (118), Expect = 1e-05
Identities = 48/199 (24%), Positives = 82/199 (41%), Gaps = 32/199 (16%)

Query:  70 VLKNRALKEGLDK-----DKDVQNRFKIAEASF----------YAEEYVRFLERSETVSE  114
           VL      ++ LDK     DK++ N+ K  +              Y ++Y++   + E +++
Sbjct:  53 VLTQLVQEKVLDKKYKVSDKEIDNKLKEYKTQLGDQYTALEKQYGKDYLKEQVKYELLTQ  112

Query: 115 SA-----------LRQFYERQIRNIKLQQVSFATEEEARQAQQLLLKGLSFEGLMKRYPN  163
           A              +++++E    I+     A ++  A + ++ L KG  FE L K Y
Sbjct: 113 KAAKDNIKVTDADIKEYWEGLKGKIRASHILVADKKTAEEVEKKLKKGEKFEDLAKEYST  172

Query: 164 DEQAFDG-----FIMAQQLPEPLASQFAAMNRGDVTRDPVKLGERYYLFKLSEVGKNPDA  218
              D  A  G    F    Q+ E +     + G+V+  DPVK    Y++  K +E         D
Sbjct: 173 DSSASKGGDLGWFAKEGQMDETFSKAAFKLKTGEVS-DPVKTQYGYHIIKKTEERGKYDD  231

Query: 219 QPFELVRNQLEQGLRQEKA                                          237
               EL    LEQ L    A
Sbjct: 232 MKKELKSEVLEQKLNDAA                                           250
```

Based on this analysis, including the presence of a putative leader sequence and a RGD motif in the gonococcal protein, it was predicted that the proteins from *N.meningitidis* and *N.gonorrhoeae*, and their epitopes, could be useful antigens for vaccines or diagnostics, or for raising antibodies. ORF76-1 (SEQ ID NO: 298) (27.8 kDa) was cloned in the pET vector and expressed in *E.coli*, as described above. The products of protein expression and purification were analyzed by SDS-PAGE. FIG. 10A shows the results of affinity purification of the His-fusion protein, Purified His-fusion protein was used to immunise mice, whose sera were used for Western blot (FIG. 10B), ELISA (positive result), and FACS analysis (FIG. 10C). These experiments confirm that ORF76-1 (SEQ ID NO: 298) is a surface-exposed protein, and that it is a useful immunogen.

Example 36

The following partial DNA sequence was identified in *N.meningitidis* (SEQ ID NO: 303):

```
   1 ATGAAAAAAT CTTTCCTTAC GCTTGTTCTG TATTCGTCTT TACTTACCGC
  51 CAGCGAAATT GCCTTACCCC TTGGAATTGG GGATTGAAAC CTTACCGGCG
 101 GCAAAAATTG CGGAAACGTT TGCGCTGACA TTTGTGATTG CTGCGCTGTA
 151 TCTGTTTGCG CGTAATAAGG TGACGCGTTT GTTGATTGCG GTGTTTTTTG
 201 CGTTCAGCAT TATTGCCAAC AATGTGCATT ACGCGGATTA TCAAAGCTGG
 251 ATGACG....  ..........  ..........  ..........  ..........
                                //
1201 ..........  CAAACCGTAT TCGAGCAGCT GCAAAAGACT CCTGACGGCA
1251 ACTGGCTGTT TGCCTATACC TCCGATCATG GCCAGTATGT TCGCCAAGAT
1301 ATCTACAATC AAGGCACGGT GCAGCCCGAC AGCTATCTCG TGCCGCTAGT
1351 GTTGTACAGC CCGGATAAGG CCGTGCAACA GGCTGCCAAC CAGGCTTTTG
1401 CGCCTTGCGA GATTGCCTTC CATCAGCAGC TTTCAACGTT CCTGATTCAC
1451 ACGTTGGGCT ACGATATGCC GGTTTCAGGT TGTCGCGAAG GCTCGGTAAC
1501 GGGCAACCTG ATTACGGGTG ATGCAGGCAG CTTGAACATT CGCGACGGCA
1551 AGGCGGAATA TGTTTATCCG CAATGA
```

This corresponds to the amino acid sequence (SEQ ID NO: 304; ORF81):

```
  1 MKKSFLTLVL YSSLLTASEI AYPLELGIET LPAAKIAETF ALTFVIAALY
 51 LFARNKVTRL LIAVFPAFSI IANNVHYADY QSWMT.....  ..........
                                //
401 ...QTVFEQL QKTPDGNWLF AYTSDHGQYV RQDIYNQGTV QPDSYLVPLV
451 LYSPDKAVQQ AANQAFAPCE IAFHQQLSTF LIHTLGYDMP VSGCREGSVT
501 GNLITGDAGS LNIRDGKAEY VYPQ*
```

Further work revealed the complete nucleotide sequence (SEQ ID NO: 305):

```
   1 ATGAAAAAAT CTTTCCTTAC GCTTGTTCTG TATTCGTCTT TACTTACCGC
  51 CAGCGAAATT GCCTATCGCT TTGTATTTGG GATTGAAACC TTACCGGCGG
 101 CAAAAATTGC GGAAACGTTT GCGCTGACAT TGTGATTGC TGCGCTGTAT
 151 CTGTTTGCGC GTTATAAGGT GACGCGTTTG TTGATTGCGG TGTTTTTTGC
 201 GTTCAGCATT ATTGCCAACA ATGTGCATTA CGCGGTTTAT CAAAGCTGGA
 251 TGACGGGCAT CAATTATTGG CTGATGCTGA AAGAGGTTAC CGAAGTCGGC
```

-continued

```
 301   AGCGCGGGTG CGTCGATGTT GGATAAGTTG TGGCTGCCTG TGTTGTGGGG
 351   CGTGTTGGAA GTCATGTTGT TTTGCAGCCT TGCCAAGTTC CGCCGTAAGA
 401   CGCATTTTTC TGCCGATATA CTGTTTGCCT TCCTAATGCT GATGATTTTC
 451   GTGCGTTCGT TCGACACGAA ACAAGAGCAC GGTATTTCGC CCAAACCGAC
 501   ATACAGCCGC ATCAAAGCCA ATTATTTCAG CTTCGGTTAT TTTGTCGGAC
 551   GCGTGTTGCC GTATCAGTTG TTTGATTTAA GCAGGATTCC CGCCTTTAAG
 601   CAGCCTGCTC AAGCAAAAT CGGGCAGGGC AGTGTTCAAA ATATCGTCCT
 651   GATTATGGGC GAAAGCGAAA GCGCGGCGCA TTTGAAGCTG TTTGGCTACG
 701   GACGCGAAAC TTCGCCGTTT TTAACCCGGC TGTCGCAAGC CGATTTTAAG
 751   CCGATTGTGA AACAAAGTTA TTCCGCAGGC TTTATGACTG CAGTGTCCCT
 801   GCCCAGTTTT TTCAATGCGA TACCGCACGC CAACGGCTTG AACAAATCA
 851   GCGGCGGCGA TACCAATATG TTCCGCCTCG CCAAAGAGCA GGGCTATGAA
 901   ACGTATTTTT ACAGCGCGCA GGCGGAAAAC GAGATGGCGA TTTTGAACTT
 951   AATCGGTAAG AAATGGATAG ACCATCTGAT TCAGCCGACG CAACTTGGCT
1001   ACGGCAACGG CGACAATATG CCCGATGAGA AGCTGCTGCC GTTGTTCGAC
1051   AAAATCAATT TGCAGCAGGG CAAGCATTTT ATCGTGTTGC ACCAACGCGG
1101   TTCGCACGCC CCATACGGCG CATTGTTGCA GCCTCAAGAT AAAGTATTCG
1151   GCGAAGCCGA TATTGTGGAT AAGTACGACA ACACCATCCA CAAAACCGAC
1201   CAAATGATTC AAACCGTATT CGAGCAGCTG CAAAAGCAGC CTGACGGCAA
1251   CTGGCTGTTT GCCTATACCT CCGATCATGG CCAGTATGTT CGCCAAGATA
1301   TCTACAATCA AGGCACGGTG CAGCCCGACA GCTATCTCGT GCCGCTAGTG
1351   TTGTACAGCC CGGATAAGGC CGTGCAACAG GCTGCCAACC AGGCTTTTGC
1401   GCCTTGCGAG ATTGCCTTCC ATCAGCAGCT TTCAACGTTC CTGATTCACA
1451   CGTTGGGCTA CGATATGCCG GTTTCAGGTT GTCGCGAAGG CTCGGTAACG
1501   GGCAACCTGA TTACGGGTGA TGCAGGCAGC TTGAACATTC GCGACGGCAA
1551   GGCGGAATAT GTTTATCCGC AATGA
```

This corresponds to the amino acid sequence (SEQ ID NO: 306; ORF81-1):

```
  1   MKKSFLTLVL YSSLLTASEI AYRFVFGIET LPAAKIAETF ALTFVIAALY
 51   LFARYKVTRL LIAVFFAFSI IANNVHYAVY QSWMTGINYW LMLKEVTEVG
101   SAGASMLDKL WLPVLWGVLE VMLFCSLAKF RRKTHFSADI LFAFLMLMIF
151   VRSFDTKQEH GISPKPTYSR IKANYFSFGY FVGRVLPYQL FDLSRIPAFK
201   QPAPSKIGQG SVQNIVLIMG ESESAAHLKL FGYGRETSPF LTRLSQADFK
251   PIVKQSYSAG FMTAVSLPSF FNAIPHANGL EQISGGDTNM FRLAKEQGYE
301   TYFYSAQAEN EMAILNLIGK KWIDHLIQPT QLGYGNGDNM PDEKLLPLFD
351   KINLQQGKHF IVLHQRGSHA PYGALLQPQD KVFGEADIVD KYDNTIHKTD
401   QMIQTVFEQL QKQPDGNWLF AYTSDHGQYV RQDIYNQGTV QPDSYLVPLV
451   LYSPDKAVQQ AANQAFAPCE IAFHQQLSTF LIHTLGYDMP VSGCREGSVT
501   GNLITGDAGS LNIRDGKAEY VYPQ*
```

Computer analysis of this amino acid sequence gave the following results:
Homology with a Predicted ORF from *N.meningitidis* (Strain A)

ORF81 (SEQ ID NO: 304) shows 84.7% identity over a 85aa overlap and 99.2% identity over a 121aa overlap with an ORF (ORF81a) (SEQ ID NO: 308) from strain A of *N. meningitidis*:

```
                 10        20        30        40        50        60
orf81.pep  MKKSFLTLVLYSSLLTASEIAYPLELGIETLPAAKIAETFALTFVIAALYLFARNKVTRL
           ||||:::| ||||||||||||| : :|||||||||:||||||||||||||||| |:|||
orf81a     MKKSLFVLFLYSSLLTASEIAYRFVFGIETLPAAKMAETFALTFVIAALYLFARYKATRL
                 10        20        30        40        50        60

70        80
orf81.pep  LIAVFFAFSIIANNVHYADYQSWMT
           ||||||||||||||||||| ||||:|
orf81a     LIAVFFAFSIIANNVHYAVYQSWITGINYWLMLKEITEVGGAGASMLDKLWLPALWGVLE
                 70        80        90       100       110       120

//

120       130       140
orf81.pep                              QTVFEQLQKTPDGNWLFAYTSDHGQYVRQD
                                       |||||||||| |||||||||||||||||||
orf81a     IPHANGLEQISGGDIVDKYDNTIHKTDQMIQTVFEQLQKQPDGNWLFAYTSDHGQYVRQD
                280       290       300       310       320       330

150       160       170       180       190       200
orf81.pep  IYNQGTVQPDSYLVPLVLYSPDKAVQQAANQAFAPCEIAFHQQLSTFLIHTLGYDMPVSG
           ||||||||||||||||||||||||||||||||||||||||||||||||||||||||||||
orf81a     IYNQGTVQPDSYLVPLVLYSPDKAVQQAANQAFAPCEIAFHQQLSTFLIHTLGYDMPVSG
                340       350       360       370       380       390

210       220       230
orf81.pep  CREGSVTGNLITGDAGSLNIRDGKAEYVYPQX
           |||||||||||||||||||||||||||||||
orf81a     CREGSVTGNLITGDAGSLNIRDGKAEYVYPQX
                400       410       420
```

The complete length ORF81 a nucleotide sequence (SEQ ID NO: 307) is:

```
  1   ATGAAAAAAT CCCTTTTCGT TCTCTTTCTG TATTCGTCCC TACTTACTGC
 51   CAGCGAAATT GCTTATCGCT TTGTATTCGG AATTGAAACC TTACCGGCTG
101   CAAAAATGGC AGAAACGTTT GCGCTGACAT TTGTGATTGC TGCGCTGTAT
151   CTGTTTGCGC GTTATAAGGC AACGCGTTTG TTGATTGCGG TGTTTTTCGC
201   GTTCAGCATT ATTGCCAACA ATGTGCATTA CGCGGTTTAT CAAAGCTGGA
251   TAACGGGCAT TAATTATTGG CTGATGCTGA AAGAGATTAC CGAAGTTGGC
301   GGCGCAGGGG CGTCGATGTT GGATAAGTTG TGGCTGCCTG CGTTGTGGGG
351   CGTGTTGGAA GTCATGTTGT TTTGCAGCCT TGCCAAGTTC CGCCGTAAGA
401   CGCATTTTTC TGCCGATATA CTGTTTGCCT TCCTAATGCT GATGATTTTC
451   GTGCGTTCGT TCGACACGAA ACAAGAACAC GGTATTTCGC CCAAACCGAC
501   ATACAGCCGC ATCAAAGCCA ATTATTTCAG CTTCGGTTAT TTTGTCGGAC
551   GCGTGTTGCC GTATCAGTTG TTTGATTTAA GCAAGATTCC TGTGTTCAAA
601   CAGCCTGCTC AAGCAGAAT CGGGCAAGGC AGTATTCAAA ATATCGTCCT
651   GATTATGGGC GAAAGCGAAA GCGCGGCGCA TTTGAAATTG TTTGGCTACG
701   GGCGCGAAAC TTCGCCGTTT TTGACCCAGC TTTCGCAAGC CGATTTTAAG
751   CCGATTGTGA AACAAAGTTA TTCCGCAGGC TTTATGACGG CAGTATCCCT
801   GCCCAGTTTC TTTAACGTCA TACCGCATGC CAACGGCTTG AACAAATCA
851   GCGGCGGCGA TATTGTGGAT AAGTACGACA ACACCATCCA CAAAACCGAC
```

```
-continued
 901   CAAATGATTC AAACCGTATT CGAGCAGCTG CAAAAGCAGC CTGACGGCAA
 951   CTGGCTGTTT GCCTATACCT CCGATCATGG CCAGTATGTT CGCCAAGATA
1001   TCTACAATCA AGGCACGGTG CAGCCCGACA GCTATCTCGT GCCGCTGGTG
1051   TTGTACAGCC CGGATAAGGC CGTGCAACAG GCTGCCAACC AGGCTTTTGC
1101   GCCTTGCGAG ATTGCCTTCC ATCAGCAGCT TTCAACGTTC CTGATTCACA
1151   CGTTGGGCTA CGATATGCCG GTTTCAGGTT GTCGCGAAGG CTCGGTAACG
1201   GGCAACCTGA TTACGGGTGA TGCAGGCAGC TTGAACATTC GCGACGGCAA
1251   GGCGGAATAT GTTTATCCGC AATGA
```

This encodes a protein having amino acid sequence (SEQ ID NO: 308):

```
  1   MKKSLFVLFL YSSLLTASEI AYRFVFGIET LPAAKMAETF ALTFVIAALY
 51   LFARYKATRL LIAVFFAFSI IANNVHYAVY QSWITGINYW LMLKEITEVG
101   GAGASMLDKL WLPALWGVLE VMLFCSLAKF RRKTHFSADI LFAFLMLMIF
151   VRSFDTKQEH GISPKPTYSR IKANYFSFGY FVGRVLPYQL FDLSKIPVFK
201   QPAPSRIGQG SIQNIVLIMG ESESAAHLKL FGYGRETSPF LTQLSQADFK
251   PIVKQSYSAG FMTAVSLPSF FNVIPHANGL EQISGGDIVD KYDNTIHKTD
301   QMIQTVFEQL QKQPDGNWLF AYTSDHGQYV RQDIYNQGTV QPDSYLVPLV
351   LYSPDKAVQQ AANQAFAPCE IAFHQQLSTF LIHTLGYDMP VSGCREGSVT
401   GNLITGDAGS LNIRDGKAEY VYPQ*
```

ORF81-1 (SEQ ID NO: 306) show 77.9% identity in 524 aa overlap:

```
                  10         20         30         40         50         60
orf81a.pep  MKKSLFVLFLYSSLLTASEIAYRFVFGIETLPAAKMAETFALTFVIAALYLFARYKATRL
            ||||:::| |||||||||||||||||||||||||:|||||||||||||||||||||:|||
orf81-1     MKKSFLTLVLYSSLLTASEIAYRFVFGIETLPAAKIAETFALTFVIAALYLFARYKVTRL
                  10         20         30         40         50         60

70         80         90        100        110        120
orf81a.pep  LIAVFFAFSIIANNVHYAVYQSWITGINYWLMLKEITEVGGAGASMLDKLWLPALWGVLE
            |||||||||||||||||||||||:||||||||||||:||||:|||||||||:||||||
orf81-1     LIAVFFAFSIIANNVHYAVYQSWMTGINYWLMLKEVTEVGSAGASMLDKLWLPVLWGVLE
                  70         80         90        100        110        120

130        140        150        160        170        180
orf81a.pep  VMLFCSLAKFRRKTHFSADILFAFLMLMIFVRSFDTKQEHGISPKPTYSRIKANYFSFGY
            ||||||||||||||||||||||||||||||||||||||||||||||||||||||||||||
orf81-1     VMLFCSLAKFRRKTHFSADILFAFLMLMIFVRSFDTKQEHGISPKPTYSRIKANYFSFGY
                 130        140        150        160        170        180

190        200        210        220        230        240
orf81a.pep  FVGRVLPYQLFDLSKIPVFKQPAPSRIGQGSIQNIVLIMGESESAAHLKLFGYGRETSPF
            ||||||||||||||:||:|||||||:|||||:||||||||||||||||||||||||||||
orf81-1     FVGRVLPYQLFDLSRIPAFKQPAPSKIGQGSVQNIVLIMGESESAAHLKLFGYGRETSPF
                 190        200        210        220        230        240

250        260        270        280
orf81a.pep  LTQLSQADFKPIVKQSYSAGFMTAVSLPSFFNVIPHANGLEQISGGD--------------
            ||:|||||||||||||||||||||||||||||:|||||||||||||
orf81-1     LTRLSQADFKPIVKQSYSAGFMTAVSLPSFFNAIPHANGLEQISGGDTNMFRLAKEQGYE
                 250        260        270        280        290        300 orf81a.pep  ------------------------------------------------------------
orf81-1     TYFYSAQAENEMAILNLIGKKWIDHLIQPTQLGYGNGDNMPDEKLLPLFDKINLQQGKHF
                 310        320        330        340        350        360
```

```
                                   290        300        310        320
orf81a.pep  --------------------------IVDKYDNTIHKTDQMIQTVFEQLQKQPDGNWLF
                                      ||||||||||||||||||||||||||||||
orf81-1     IVLHQRGSHAPYGALLQPQDKVFGEADIVDKYDNTIHKTDQMIQTVFEQLQKQPDGNWLF
                370        380        390        400        410        420

330        340        350        360        370        380
orf81a.pep  AYTSDHGQYVRQDIYNQGTVQPDSYLVPLVLYSPDKAVQQAANQAFAPCEIAFHQQLSTF
            ||||||||||||||||||||||||||||||||||||||||||||||||||||||||||
orf81-1     AYTSDHGQYVRQDIYNQGTVQPDSYLVPLVLYSPDKAVQQAANQAFAPCEIAFHQQLSTF
               430        440        450        460        470        480

390        400        410        420
orf81a.pep  LIHTLGYDMPVSGCREGSVTGNLITGDAGSLNIRDGKAEYVYPQX
            ||||||||||||||||||||||||||||||||||||||||||||
orf81-1     LIHTLGYDMPVSGCREGSVTGNLITGDAGSLNIRDGKAEYVYPQX
               490        500        510        520
```

Homology with a Predicted ORF from *N.gonorrhoeae*

The aligned aa sequences of ORF81 (SEQ ID NO: 304) and a predicted ORF (ORF81.ng) (SEQ ID NO: 310) from *N. gonorrhoeae* of the N- and C-termini show 82.4% and 97.5% identity in 85 and 121 overlap, respectively:

```
orf81.pep   MKKSFLTLVLYSSLLTASEIAYPLELGIETLPAAKIAETFALTFVIAALYLFARNKVTRL    60
            ||||:::| ||||||||||||| : :||||||||||:||||||||:||||||||| |::||
orf81ng     MKKSLFVLFLYSSLLTASEIAYRFVFGIETLPAAKMAETFALTFMIAALYLFARYKASRL    60 orf81.pep   LIAVFFAFSIIANNVHYADYQSWMT                                       85
            ||||||||||:||||||||| ||||||
orf81ng     LIAVFFAFSMIANNVHYAVYQSWMTGINYWLMLKEVTEVGSAGASMLDKLWLPALWGVAE   120

// orf81.pep                             QTVFEQLQKTPDGNWLFAYTSDHGQYVRQD   433
                                      ||||||||| ||||||||||||||||||||
orf81ng     ALLQPQDKVFGEADIVDKYDNTIHKTDQMIQTVFEQLQKQPDGNWLFAYTSDHGQYVRQD   433 orf81.pep   IYNQGTVQPDSYLVPLVLYSPDKAVQQAANQAFAPCEIAFHQQLSTFLIHTLGYDMPVSG   493
            ||||||||||||:|||||||||||||||||||||||||||||||||||||||||||||||
orf81ng     IYNQGTVQPDSYIVPLVLYSPDKAVQQAANQAFAPCEIAFHQQLSTFLIHTLGYDMPVSG   493 orf81.pep   CREGSVTGNLITGDAGSLNIRDGKAEYVYPQ                               524
            |||||||||||||||||||||:|||||||||
orf81ng     CREGSVTGNLITGDAGSLNIRNGKAEYVYPQ                               524
```

The complete length ORF81ng nucleotide sequence (SEQ ID NO: 309) is:

```
  1 ATGAAAAAAT CCCTTTTCGT TCTCTTTCTG TATTCATCCC TACTTACCGC

51 CAGCGAAATC GCCTATCGCT TTGTATTCGG AATTGAAACC TTACCGGCTG

101 CAAAAATGGC GGAAACGTTT GCGCTGACAT TTATGATTGC TGCGCTGTAT

151 CTGTTTGCGC GTTATAAGGC TTCGCGGCTG CTGATTGCGG TGTTTTTCGC

201 GTTCAGCATG ATTGCCAACA ATGTGCATTA CGCGCTTTAT CAAAGCTGGA

251 TGACGGGTAT TAACTATTGG CTGATGCTGA AAGAGGTTAC CGAAGTCGGC

301 AGCGCGGGCG CGTCGATGTT GGATAAGTTG TGGCTGCCTG CTTTGTGGGG

351 CGTGGCGGAA GTCATGTTGT TTTGCAGCCT TGCCAAGTTC CGCCGTAAGA

401 CGCATTTTTC TGCCGATATA CTGTTTGCCT TCCTAATGCT GATGATTTTC

451 GTGCGTTCGT TCGACACGAA ACAAGAGCAC GGTATTTCGC CCAAACCGAC

501 ATACAGCCGC ATCAAAGCCA ATTATTTCAG CTTCGGTTAT TTTGTCGGGC

551 GCGTGTTGCC GTATCAGTTG TTTGATTTAA GCAAGATCCC TGTGTTCAAA
```

-continued

```
 601  CAGCCTGCTC CAAGCAAAAT CGGGCAAGGC AGTATTCAAA ATATCGTCCT
 651  GATTATGGGC GAAAGCGAAA GCGCGGCGCA TTTGAAATTG TTTGGTTACG
 701  GGCGCGAAAC TTCGCCGTTT TTAACCCGGC TGTCGCAAGC CGATTTTAAG
 751  CCGATTGTGA AACAAAGTTA TTCCGCAGGC TTTATGACGG CAGTATCCCT
 801  GCCCAGTTTC TTTAACGTCA TACCGCACGC CAACGGCTTG AACAAATCA
 851  GCGGCGGCGA TACCAATATG TTCCGCCTCG CCAAAGAGCA GGGCTATGAA
 901  ACGTATTTTT ACAGTGCCCA GGCTGAAAAC CAAATGGCAA TTTTGAACTT
 951  AATCGGTAAG AAATGGATAG ACCATCTGAT TCAGCCGACG CAACTTGGCT
1001  ACGGCAACGG CGACAATATG CCCGATGAGA AGCTGCTGCC GTTGTTCGAC
1051  AAAATCAATT TGCAGCAGGG CAGGCATTTT ATCGTGTTGC ACCAACGCGG
1101  TTCGCACGCC CCATACGGCG CATTGTTGCA GCCTCAAGAT AAAGTATTCG
1151  GCGAAGCCGA TATTGTGGAT AAGTACGACA ACACCATCCA CAAAACCGAC
1201  CAAATGATTC AAACCGTATT CGAGCAGCTG CAAAAGCAGC CTGACGGCAA
1251  CTGGCTGTTT GCCTATACCT CCGATCATGG CCAGTATGTG CGCCAAGATA
1301  TCTACAATCA AGGCACGGTG CAGCCCGACA GCTATATTGT GCCTCTGGTT
1351  TTGTACAGCC CGGATAAGGC CGTGCAACAG GCTGCCAACC AGGCTTTTGC
1401  GCCTTGCGAG ATTGCCTTCC ATCAGCAGCT TTCAACGTTC CTGATTCACA
1451  CGTTGGGCTA CGATATGCCG GTTTCAGGTT GTCGCGAAGG CTCGGTAACA
1501  GGCAACCTGA TTACGGGCGA TGCAGGCAGC TTGAACATTC GCAACGGCAA
1551  GGCGGAATAT GTTTATCCGC AATAA
```

This encodes a protein having amino acid sequence (SEQ ID NO: 310):

```
  1 MKKSLFVLFL YSSLLTASEI AYRFVFGIET LPAAKMAETF ALTFMIAALY
 51 LFARYKASRL LIAVFFAFSM IANNVHYAVY QSWMTGINYW LMLKEVTEVG
101 SAGASMLDKL WLPALWGVAE VMLFCSLAKF RRKTHFSADI LFAFLMLMIF
151 VRSFDTKQEH GISPKPTYSR IKANYFSFGY FVGRVLPYQL FDLSKIPVFK
201 QPAPSKIGQG SIQNIVLIMG ESESAAHLKL FGYGRETSPF LTRLSQADFK
251 PIVKQSYSAG FMTAVSLPSF FNVIPHANGL EQISGGDTNM FRLAKEQGYE
301 TYFYSAQAEN QMAILNLIGK KWIDHLIQPT QLGYGNGDNM PDEKLLPLFD
351 KINLQQGRHF IVLHQRGSHA PYGALLQPQD KVFGEADIVD KYDNTIHKTD
401 QMIQTVFEQL QKQPDGNWLF AYTSDHGQYV RQDIYNQGTV QPDSYIVPLV
451 LYSPDKAVQQ AANQAFAPCE IAFHQQLSTF LIHTLGYDMP VSGCREGSVT
501 GNLITGDAGS LNIRNGKAEY VYPQ*
```

ORF81ng (SEQ ID NO: 310) and ORF81-1 (SEQ ID NO: 306) show 96.4% identity in 524 aa overlap:

```
                        10         20         30         40         50         60
orf81ng-1.pep  MKKSLFVLFLYSSLLTASEIAYRFVFGIETLPAAKMAETFALTFMIAALYLFARYKASRL
               ||||:::| ||||||||||||||||||||||||||:|||||||||:||||||||||::||
orf81-1        MKKSFLTLVLYSSLLTASEIAYRFVFGIETLPAAKIAETFALTFVIAALYLFARYKVTRL
                        10         20         30         40         50         60
```

```
                 70        80        90       100       110       120
orf81ng-1.pep LIAVFFAFSMIANNVHYAVYQSWMTGINYWLMLKEVTEVGSAGASMLDKLWLPALWGVAE
              ||||||||||:|||||||||||||||:|||||||||||||||||||||||||||:||||  |
orf81-1       LIAVFFAFSIIANNVHYAVYQSWNTGINYWLMLKEVTEVGSAGASMLDKLWLPVLWGVLE
                 70        80        90       100       110       120

130       140       150       160       170       180
orf81ng-1.pep VMLFCSLAKFRRKTHFSADILFAFLMLMIFVRSFDTKQEHGISPKPTYSRIKANYFSFGY
              |||||||||||||||||||||||||||||||||||||||||||||||||||||||||||
orf81-1       VMLFCSLAKFRRKTHFSADILFAFLMLMIFVRSFDTKQEHGISPKPTYSRIKANYFSFGY
                130       140       150       160       170       180

190       200       210       220       230       240
orf81ng-1.pep FVGRVLPYQLFDLSKIPVFKQPAPSKIGQGSIQNIVLIMGESESAAHLKLFGYGRETSPF
              ||||||||||||||:||:||||||||||||||:||||||||||||||||||||||||||
orf81-1       FVGRVLPYQLFDLSRIPAFKQPAPSKIGQGSVQNIVLIMGESESAAHLKLFGYGRETSPF
                190       200       210       220       230       240

250       260       270       280       290       300
orf81ng-1.pep LTRLSQADFKPIVKQSYSAGFMTAVSLPSFFNVIPHANGLEQISGGDTNMFRLAKEQGYE
              |||||||||||||||||||||||||||||||||:||||||||||||||||||||||||||
orf81-1       LTRLSQADFKPIVKQSYSAGFMTAVSLPSFFNAIPHANGLEQISGGDTNMFRLAKEQGYE
                250       260       270       280       290       300

310       320       330       340       350       360
orf81ng-1.pep TYFYSAQAENQMAILNLIGKKWIDHLIQPTQLGYGNGDNMPDEKLLPLFDKINLQQGRHF
              ||||||||||:|||||||||||||||||||||||||||||||||||||||||||||:||
orf81-1       TYFYSAQAENEMAILNLIGKKWIDHLIQPTQLGYGNGDNMPDEKLLPLFDKINLQQGKHF
                310       320       330       340       350       360

370       380       390       400       410       420
orf81ng1.pep  IVLHQRGSHAPYGALLQPQDKVFGEADIVDKYDNTIHKTDQMIQTVFEQLQKQPDGNWLF
              ||||||||||||||||||||||||||||||||||||||||||||||||||||||||||
orf81-1       IVLHQRGSHAPYGALLQPQDKVFGEADIVDKYDNTIHKTDQMIQTVFEQLQKQPDGNWLF
                370       380       390       400       410       420

430       440       450       460       470       480
orf81ng-1.pep AYTSDHGQYVRQDIYNQGTVQPDSYIVPLVLYSPDKAVQQAANQAFAPCEIAFHQQLSTF
              |||||||||||||||||||||||||||:||||||||||||||||||||||||||||||
orf81-1       AYTSDHGQYVRQDIYNQGTVQPDSYLVPLVLYSPDKAVQQAANQAFAPCEIAFHQQLSTF
                430       440       450       460       470       480

490       500       510       520
orf81ng-1.pep LIHTLGYDMPVSGCREGSVTGNLITGDAGSLNIRNGKAEYVYPQX
              |||||||||||||||||||||||||||||||||:|||||||||||
orf81-1       LIHTLGYDMPVSGCREGSVTGNLITGDAGSLNIRDGKAEYVYPQX
                490       500       510       520
```

Furthermore, ORF81ng (SEQ ID NO: 310) shows significant homology to an *E.coli* OMP (SEQ ID NO: 1133):

```
gi|1256380 (U50906) outer membrane adherence protein-associated protein [E. coli]
Length = 547
Score = 87.4 bits (213), Expect = 2e-16
Identities = 122/468 (26%), Positives = 198/468 (42%), Gaps = 70/468 (14%)

Query:     25 VFGIETLPAAKMAETFA-LTFMIAALYLFARYKAS--RLLIAVFFAFSMIANNVHYAVYQ    81
              VFGI  L A+  A      L F + + +  R +    RLL+A  F    + A ++  ++Y
Sbjct:     29 VFGITNLVASSGAHMVQRLLFFVLTILVVKRISSLPLRLLVAAPFVL-LTAADMSISLY-    86

Query:     82 SWMT-------GINYWLMLKEVTEVGSAGASMLDKLWLPALWGVAEVMLFCSLAKFRRKT   134
              SW T       G     ++   + EV     A  ML  ++ P L    A  +L       +
Sbjct:     87 SWCTFGTTFNDGFAISVLQSDPDEV----AKMLG-MYSPYLCAFAFLSLLFLAVIIKYDV   141

Query:    135 HFSADILFAFLMLMIFVRSF---------DTKQEHGISPKPTYSRIKAN--YFSFGYFVG   183
                 + L+L++   S                 D K  ++   SP        SR     +F+   YF
Sbjct:    142 SLPTKKVTGILLLIVISGSLFSACQFAYKDAKNKNAFSPYILASRFATYTPFFNLNYFAL   201

Query:    184 RVLPYQ-LFDLSKIPVFKQPAPSKIGQGSIQNIVLIMGESESAAHLKLFGYGRETSPFL   241
                    +Q  L   + +P  F+          +       I      VLI+GES    ++ L+GY R  T+P +
Sbjct:    202 AAKEHQRLLSIANTVPYFQL----SVRDTGIDTYVLIVGESVRVDNMSLYGYTRSTTPQV   257

Query:    242 TRLSQADFKPIVKQSYSAGFMTAVSLP---SFFNVIPHANGLEQISGGDTNMFRLAKEQG   298
                 +Q    +  Q+ S      TA+S+P      + +V+ H       I          N+   +A + G
Sbjct:    258 E--AQRKQIKLFNQAISGAPYTALSVPLSLTADSVLSH-----DIHNYPDNIINMANQAG   310
```

-continued

```
gi|1256380 (U50906) outer membrane adherence protein-associated protein [E. coli]
Length = 547
Score = 87.4 bits (213), Expect = 2e-16
Identities = 122/468 (26%), Positives = 198/468 (42%), Gaps = 70/468 (14%)

Query:  299  YETYFYSAQA---ENQMAILNLIGKKWIDHLIQPTQLGYGNGDNMPDEKLLPLFDKINLQ  355
             ++T++ S+Q+   +N A+ ++        ++ + Y G   DE LLP  +   Q
Sbjct:  311  FQTFWLSSQSAFRQNGTAVTSI--------AMRAMETVYVRGF---DELLLPHLSQALQQ  359

Query:  356  --QGRHFIVLHQRGSHAPYGALLQPDKVFGEADIVDK-YDNTIHKTDQMIQTVFEQLQK  412
               Q +  IVLH  GSH P +       VF  D  D  YDN+IH TD ++  VFE L+
Sbjct:  360  NTQQKKLIVLHLNGSHEPACSAYPQSSAVFQPQDDQDACYDNSIHYTDSLLGQVFELLK-  418

Query:  413  QPDGNWLFAYTSDHG---QYVRQDIYNQG--TVQPDSYIVPL-VLYSP  454
              D        Y +DHG    ++++Y G       +Y VP+ + YSP
Sbjct:  419  --DRRASVMYFADHGLERDPTKKNVYFHGGREASQQAYHVPMPIWYSP  464
```

Based on this analysis, including the presence of a putative leader sequence (double-underlined) and several putative transmembrane domains (single-underlined) in the gonococcal protein, it is predicted that the proteins from *N.meningitidis* and *N.gonorrhoeae*, and their epitopes, could be useful antigens for vaccines or diagnostics, or for raising antibodies.

Example 37

The following partial DNA sequence was identified in *N.meningitidis* (SEQ ID NO: 311):

```
  1  ...ACCCTGCTCC TCTTCATCCC CCTCGTCCTC ACAC.GTGCG GCACACTGAC
 51     CGGCATACTC GCCCaCGGCG GCGGCAAACG CTTTGCCGTC GAACAAGAAC
101     TCGTCGCCGC ATCGTCCCGC GCCGCCGTCA AAGAAATGGA TTTGTCCGCC
151     yTAAAAGGAC GCAAAGCCGC CyTTTACGTC TCCGTTATGG GCGACCAAGG
201     TTCGGGCAAC ATAAGCGGCG GACGCTACTC TATCGACGCA CTGATACGCG
251     GCGGCTACCA CAACAACCCC GAAAGTGCCA CCCAATACAG CTACCCCGCC
301     TACGACACTA CCGCCACCAC CAAATCCGAC GCGCTCTCCA GCGTAACCAC
351     TTCCACATCG CTTTTGAACG CCCCCGCCGC CGyCyTGACG AAAAACAGCG
401     GACGCAAAGG CGAACGcTCC GCCGGACTGT CCGTCAACGG CACGGGCGAC
451     TACCGCAACG AAACCCTGCT CGCCAACCCC CGCGACGTTT CCTTCCTGAC
501     CAACCTCATC CAAACCGTCT TCTACCTGCG CGGCATCGAA GTCgTACCGC
551     CCGrATACGC CGACACCGAC GTATTCGTAA CCGTCGACGT A...
```

This corresponds to the amino acid sequence (SEQ ID NO: 312; ORF83):

```
  1  ..TLLLFIPLVL TXCGTLTGIL AHGGGKRFAV EQELVAASSR AAVKEMDLSA
 51    LKGRKAAXYV SVMGDQGSGN ISGGRYSIDA LIRGGYHNNP ESATQYSYPA
101    YDTTATTKSD ALSSVTTSTS LLNAPAAXLT KNSGRKGERS AGLSVNGTGD
151    YRNETLLANP RDVSFLTNLI QTVFYLRGIE VVPPXYADTD VFVTVDV..
```

Further work revealed the complete nucleotide sequence (SEQ ID NO: 313):

```
  1  ATGAAAACCC TGCTCCTCCT CATCCCCCTC GTCCTCACAG CCTGCGGCAC
 51  ACTGACCGGC ATACCCGCCC ACGGCGGCGG CAAACGCTTT GCCGTCGAAC
```

-continued

```
101 AAGAACTCGT CGCCGCATCG TCCCGCGCCG CCGTCAAAGA AATGGATTTG

151 TCCGCCCTAA AAGGACGCAA AGCCGCCCTT TACGTCTCCG TTATGGGCGA

201 CCAAGGTTCG GGCAACATAA GCGGCGGACG CTACTCTATC GACGCACTGA

251 TACGCGGCGG CTACCACAAC AACCCCGAAA GTGCCACCCA ATACAGCTAC

301 CCCGCCTACG ACACTACCGC CACCACCAAA TCCGACGCGC TCTCCAGCGT

351 AACCACTTCC ACATCGCTTT TGAACGCCCC CGCCGCCGCC CTGACGAAAA

401 ACAGCGGACG CAAAGGCGAA CGCTCCGCCG GACTGTCCGT CAACGGCACG

451 GGCGACTACC GCAACGAAAC CCTGCTCGCC AACCCCCGCG ACGTTTCCTT

501 CCTGACCAAC CTCATCCAAA CCGTCTTCTA CCTGCGCGGC ATCGAAGTCG

551 TACCGCCCGA ATACGCCGAC ACCGACGTAT TCGTAACCGT CGACGTATTC

601 GGCACCGTCC GCAGCCGTAC CGAACTGCAC CTCTACAACG CCGAAACCCT

651 TAAAGCCCAA ACCAAGCTCG AATATTTCGC CGTTGACCGC GACAGCCGGA

701 AACTGCTGAT TACCCCTAAA ACCGCCGCCT ACGAATCCCA ATACCAAGAA

751 CAATACGCCC TTTGGACCGG CCCTTACAAA GTCAGCAAAA CCGTCAAAGC

801 CTCAGACCGC CTGATGGTCG ATTTCTCCGA CATTACCCCC TACGGCGACA

851 CAACCGCCCA AAACCGTCCC GACTTCAAAC AAAACAACGG TAAAAAACCC

901 GATGTCGGCA ACGAAGTCAT CCGCCGCCGC AAAGGAGGAT AA
```

This corresponds to the amino acid sequence (SEQ ID NO. 314; ORF83-1):

```
  1 MKTLLLLIPL VLTACGTLTG IPAHGGGKRF AVEQELVAAS SRAAVKEMDL

51 SALKGRKAAL YVSVMGDQGS GNISGGRYSI DALIRGGYHN NPESATQYSY

101 PAYDTTATTK SDALSSVTTS TSLLNAPAAA LTKNSGRKGE RSAGLSVNGT

151 GDYRNETLLA NPRDVSFLTN LIQTVFYLRG IEVVPPEYAD TDVFVTVDVF

201 GTVRSRTELH LTNAETLKAQ TKLEYFAVDR DSRKLLITPK TAAYESQYQE

251 QYALWTGPYK VSKTVKASDR LMVDFSDITP YGDTTAQNRP DFKQNNGKKP

301 DVGNEVIRRR KGG*
```

Computer analysis of this amino acid sequence gave the following results:
Homology with a Predicted ORF from *N.meningitidis* (Strain A)

ORF83 (SEQ ID NO: 312) shows 96.4% identity over a 197aa overlap with an ORF (ORF83a) (SEQ ID NO: 316) from strain A of *N. meningitidis*:

```
                    10        20        30        40        50
orf83.pep   TLLLFIPLVLTXCGTLTGILAHGGGKRFAVEQELVAASSRAAVKEMDLSALKGRKAAX
            ||| :|||||| |||||| ||||||||||||||||||||||||||||||||||||||
orf83a      MKTLLXLIPLVLTACGTLTGIPAHGGGKRFAVEQELVAASSRAAVKEMDLSALKGRKAAL
                    10        20        30        40        50        60

60        70        80        90       100       110
orf83.pep   YVSVMGDQGSGNISGGRYSIDALIRGGYHNNPESATQYSYPAYDTTATTKSDALSSVTTS
            ||||||||||||||||||||||||||||||||||||||||||||||||||||||||||||
orf83a      YVSVMGDQGSGNISGGRYSIDALIRGGYHNNPESATQYSYPAYDTTATTKSDALSSVTTS
                    70        80        90       100       110       120

120       130       140       150       160       170
orf83.pep   TSLLNAPAAXLTKNSGRKGERSAGLSVNGTGDYRNETLLANPRDVSFLTNLIQTVFYLRG
            ||||||||| ||||||||||||||||||||||||||||||||||||||||||||||||||
orf83a      TSLLNAPAAALTKNSGRKGERSAGLSVNGTGDYRNETLLANPRDVSFLTNLIQTVFYLRG
                   130       140       150       160       170       180
```

```
                 180         190
orf83.pep  IEVVPPXYADTDVFVTVDV
           ||||||  ||||||||||||
orf83a     IEVVPPEYADTDVFVTVDVFGTVRSRTELHLYNAETLKAQTKLEYFAVDRDSRKLLIAPK
                  190       200       210       220       230       240
```

The complete length ORF83a nucleotide sequence (SEQ ID NO: 315) is:

```
  1  ATGAAAACCC TGCTCNTCCT CATCCCCCTC GTCCTCACAG CCTGCGGCAC
 51  ACTGACCGGC ATACCCGCCC ACGGCGGCGG CAAACGCTTT GCCGTCGAAC
101  AAGAACTCGT CGCCGCATCG TCCCGCGCCG CCGTCAAAGA AATGGACTTG
151  TCCGCCCTGA AAGGACGCAA AGCCGCCCTT TACGTCTCCG TTATGGGCGA
201  CCAAGGTTCG GGCAACATAA GCGGCGGACG CTACTCTATC GACGCACTGA
251  TACGCGGCGG CTACCACAAC AACCCCGAAA GTGCCACCCA ATACAGCTAC
301  CCCGCCTACG ACACTACCGC CACCACCAAA TCCGACGCGC TCTCCAGCGT
351  AACCACTTCC ACATCGCTTT TGAACGCCCC CGCCGCCGCC CTGACGAAAA
401  ACAGCGGACG CAAAGGCGAA CGCTCCGCCG GACTGTCCGT CAACGGCACG
451  GGCGACTACC GCAACGGAAC CCTGCTCGCC AACCCCCGCG ACGTTTCCTT
501  CCTGACCAAC CTCATCCAAA CCGTCTTCTA CCTGCGCGGC ATCGAAGTCG
551  TACCGCCCGA ATACGCCGAC ACCGACGTAT TCGTAACCGT CGACGTATTC
601  GGCACCGTCC GCAGCCGCAC CGAACTGCAC CTCTACAACG CCGAAACCCT
651  TAAAGCCCAA ACCAAGCTCG AATATTTCGC CGTTGACCGC GACAGCCGGA
701  AACTGCTGAT TGCCCCTAAA ACCGCCGCCT ACGAATCCCA ATACCAAGAA
751  CAATACGCCC TCTGGATGGG ACCTTACAGC GTCGGCAAAA CCGTCAAAGC
801  CTCAGACCGC CTGATGGTCG ATTTCTCCGA CATCACCCCC TACGGCGACA
851  CAACCGCCCA AAACCGTCCC GACTTCAAAC AAAACAACGG TAAAAAACCC
901  GATGTCGGCA ACGAAGTCAT CCGCCGCCGC AAAGGAGGAT AA
```

This encodes a protein having amino acid sequence (SEQ ID NO: 316):

```
  1  MKTLLXLIPL VLTACGTLTG IPAHGGGKRF AVEQELVAAS SRAAVKEMDL
 51  SALKGRKAAL YVSVMGDQGS GNISGGRYSI DALIRGGYHN NPESATQYSY
101  PAYDTTATTK SDALSSVTTS TSLLNAPAAA LTKNSGRKGE RSAGLSVNGT
151  GDYRNETLLA NPRDVSFLTN LIQTVFYLRG IEVVPPEYAD TDVFVTVDVF
201  GTVRSRTELH LYNAETLKAQ TKLEYFAVDR DSRKLLIAPK TAAYESQYQE
251  QYALHMGPYS VGKTVKASDR LMVDFSDITP YGDTTAQNRP DFKQNNGKKP
301  DVGNEVIRRR KGG*
```

ORF83a (SEQ ID NO: 316) and ORF83-1 (SEQ ID NO: 314) show 98.4% identity in 313 aa overlap:

```
                 10          20         30         40         50         60
orf83a.pep  MKTLLXLIPLVLTACGTLTGIPAHGGGKRFAVEQELVAASSRAAVKEMDLSALKGRKAAL
            |||||  |||||||||||||||||||||||||||||||||||||||||||||||||||||
orf83-1     MKTLLLLIPLVLTACGTLTGIPAHGGGKRFAVEQELVAASSRAAVKEMDLSALKGRKAAL
                 10          20         30         40         50         60
```

```
                           70          80         90         100        110        120
orf83a.pep    YVSVMGDQGSGNISGGRYSIDALIRGGYHNNPESATQYSYPAYDTTATTKSDALSSVTTS
              ||||||||||||||||||||||||||||||||||||||||||||||||||||||||||||
orf83-1       YVSVMGDQGSGNISGGRYSIDALIRGGYHNNPESATQYSYPAYDTTATTKSDALSSVTTS
                           70          80         90         100        110        120

130        140        150        160        170        180
orf83a.pep    TSLLNAPAAALTKNSGRKGERSAGLSVNGTGDYRNETLLANPRDVSFLTNLIQTVFYLRG
              ||||||||||||||||||||||||||||||||||||||||||||||||||||||||||||
orf83-1       TSLLNAPAAALTKNSGRKGERSAGLSVNGTGDYRNETLLANPRDVSFLTNLIQTVFYLRG
                          130        140        150        160        170        180

190        200        210        220        230        240
orf83a.pep    IEVVPPEYADTDVFVTVDVFGTVRSRTELHLYNAETLKAQTKLEYFAVDRDSRKLLIAPK
              |||||||||||||||||||||||||||||||||||||||||||||||||||||||:||
orf83-1       IEVVPPEYADTDVFVTVDVFGTVRSRTELHLYNAETLKAQTKLEYFAVDRDSRKLLITPK
                          190        200        210        220        230        240

250        260        270        280        290        300
orf83a.pep    TAAYESQYQEQYALWMGPYSVGKYVKASDRLMVDFSDITPYGDTTAQNRPDFKQNNGKKP
              ||||||||||||||||   |:|:|||||||||||||||||||||||||||||||||||||
orf83-1       TAAYESQYQEQYALWTGPYKVSKTVKASDRLMVDFSDITPYGDTTAQNRPDFKQNNGKKP
                          250        260        270        280        290        300

310
orf83a.pep    DVGNEVIRRRKGGX
              ||||||||||||||
orf83-1       DVGNEVIRRRKGGX
                          310
```

Homology with a Predicted ORF from *N.gonorrhoeae*

ORF83 (SEQ ID NO: 312) shows 94.9% identity over a 197aa overlap with a predicted ORF (ORF83.ng) (SEQ ID NO: 318) from *N. gonorrhoeae*:

```
orf83.pep     TLLLFIPLVLTXCGTLTGILAHGGGKRFAVEQELVAASSRAAVKEMDLSALKGRKAAX    58
              ||||:||||||  ||||||||| |||||||||||||||||||||||||||||||||||
orf83ng       MKTLLLLIPLVLTACGTLTGIPAHGGGKRFAVEQELVAASSRAAVKEMDLSALKGRKAAL  60 orf83.pep     YVSVMGDQGSGNISGGRYSIDALIRGGYHNNPESATQYSYPAYDTTATTKSDALSSVTTS 118
              |||||||||||||||||||||||||||||||:|||:||||||||||||||||||:||||
orf83ng       YVSVMGDQGSGNISGGRYSIDALIRGGYHNNPDSATRYSYPAYDTTATTKSDALSGVTTS 120 orf83.pep     TSLLNAPAAXLTKNSGRKGERSAGLSVNGTGDYRNETLLANPRDVSFLTNLIQTVFYLRG 178
              |||||||||  ||||:|||||||||||||||||||||||||||||||||||||||||||
orf83ng       TSLLNAPAAALTKNNGRKGERSAGLSVNGTGDYRNETLLANPRDVSFLTNLIQTVFYLRG 180 orf83.pep     IEVVPPXYADTDVFVTVDV                                          197
              ||||||  |||||||||||
orf83ng       IEVVPPEYADTDVFVTVDVFGTVRSRTELHLYNAETLKAQTKLEYFAVDRDSRKLLIAPK 240
```

The complete length ORF83ng nucleotide sequence (SEQ ID NO: 317) is:

```
  1  ATGAAAACCC TGCTCCTCCT CATCCCCCTC GTACTCACCG CCTGCGGCAC

51  ACTGACCGGC ATACCCGCCC ACGGCGGCGG CAAACGCTTT GCCGTCGAAC

101  AGGAACTCGT CGCCGCATCG TCCCGCGCCG CCGTCAAAGA AATGGACTTG

151  TCCGCCCTGA AAGGACGCAA AGCCGCCCTT TACGTCTCCG TTATGGGCGA

201  CCAAGGTTCG GGCAACATAA GCGGCGGACG CTACTCCATC GACGCACTGA

251  TACGCGGCGG CTACCACAAC AACCCCGACA GCGCCACCCG ATACAGCTAC

301  CCCGCCTATG ACACTACCGC CACCACCAAA TCCGACGCGC TCTCCGGCGT

351  AACCACTTCC ACATCGCTTT TGAACGCCCC CGCCGCCGCC CTGACGAAAA

401  ACAACGGACG CAAAGGCGAA CGCTCCGCCG GACTGTCCGT CAACGGCACG
```

```
                          -continued
451  GGCGACTACC GCAACGAAAC CCTGCTCGCC AACCCCGCG  ACGTTTCCTT

501  CCTGACCAAC CTCATCCAAA CCGTCTTCTA CCTGCGCGGC ATCGAAGTCG

551  TACCGCCCGA ATACGCCGAC ACCGACGTAT TCGTAACCGT CGACGTATTC

601  GGCACCGTCC GCAGCCGTAC CGAACTGCAC CTCTACAACG CCGAAACCCT

651  TAAAGCCCAA ACCAAGCTCG AATATTTCGC CGTCGACCGC GACAGCCGGA

701  AACTGCTGAT TGCCCCTAAA ACCGCCGCCT ACGAATCCCA ATACCAAGAA

751  CAATACGCCC TCTGGATGGG ACCTTACAGC GTCGGCAAAA CCGTCAAAGC

801  CTCAGACCGC CTGATGGTCG ATTTCTCCGA CATCACCCCC TACGGCGACA

851  CAACCGCCCA AAACCGTCCC GACTTCAAAC AAAACAACGG TAAAAACCCC

901  GATGTCGGCA ACGAAGTCAT CCGCCGCCGC AAAGGAGGAT AA
```

This encodes a protein having amino acid sequence (SEQ ID NO: 318):

```
  1  MKTLLLLIPL VLTACGTLTG IPAHGGGKRF AVEQELVAAS SRAAVKEMDL

51  SALKGRKAAL YVSVMGDQGS GNISGGRYSI DALIRGGYHN NPDSATRYSY

101  PAYDTTATTK SDALSGVTTS TSLLNAPAAA LTKNNGRKGE RSAGLSVNGT

151  GDYRNETLLA NPRDVSFLTN LIQTVFYLRG IEVVPPEYAD TDVFVTVDVF

201  GTVRSRTELH LYNAETLKAQ TKLEYFAVDR DSRKLLIAPK TAAYESQYQE

251  QYALWMGPYS VGKTVKASDR LMVDFSDITP YGDTTAQNRP DFKQNNGKNP

301  DVGNEVIRRR KGG*
```

ORF83ng (SEQ ID NO: 318) and ORF83-1 (SEQ ID NO: 314) show 97.1% identity in 313 aa overlap

```
                     10         20         30         40         50         60
orf83-1.pep MKTLLLLIPLVLTACGTLTGIPAHGGGKRFAVEQELVAASSRAAVKEMDLSALKGRKAAL
            ||||||||||||||||||||||||||||||||||||||||||||||||||||||||||||
orf83ng     MKTLLLLIPLVLTACGTLTGIPAHGGGKRFAVEQELVAASSRAAVKEMDLSALKGRKAAL
                     10         20         30         40         50         60

70         80         90        100        110        120
orf83-1.pep YVSVMGDQGSGNISGGRYSIDALIRGGYHNNPESATQYSYPAYDTTATTKSDALSSVTTS
            |||||||||||||||||||||||||||||||||:|||:|||||||||||||||||:||||
orf83ng     YVSVMGDQGSGNISGGRYSIDALIRGGYHNNPDSATRYSYPAYDTTATTKSDALSGVTTS
                     70         80         90        100        110        120

130        140        150        160        170        180
orf83-1.pep TSLLNAPAAALTKNSGRKGERSAGLSVNGTGDYRNETLLANPRDVSFLTNLIQTVFYLRG
            |||||||||||||:||||||||||||||||||||||||||||||||||||||||||||||
orf83ng     TSLLNAPAAALTKNNGRKGERSAGLSVNGTGDYRNETLLANPRDVSFLTNLIQTVFYLRG
                    130        140        150        160        170        180

190        200        210        220        230        240
orf83-1.pep IEVVPPEYADTDVFVTVDVFGTVRSRTELHLYNAETLKAQTKLEYFAVDRDSRKLLITPK
            |||||||||||||||||||||||||||||||||||||||||||||||||||||||||:||
orf83ng     IEVVPPEYADTDVFVTVDVFGTVRSRTELHLYNAETLKAQTKLEYFAVDRDSRKLLIAPK
                    190        200        210        220        230        240

250        260        270        280        290        300
orf83-1.pep TAAYESQYQEQYALWTGPYKVSKTVKASDRLMVDFSDITPYGDTTAQNRPDFKQNNGKKP
            |||||||||||||||:|||:|:||||||||||||||||||||||||||||||||||||:|
orf83ng     TAAYESQYQEQYALWMGPYSVGKTVKASDRLMVDFSDITPYGDTTAQNRPDFKQNNGKNP
                    250        260        270        280        290        300

310
orf83-1.pep DVGNEVIRRRKGGX
            ||||||||||||||
orf83ng     DVGNEVIRRRKGGX
                    310
```

Based on this analysis, including the presence of a putative ATP/GTP-binding site motif A (P-loop) in the gonococcal protein (double-underlined) and a putative prokaryotic membrane lipoprotein lipid attachment site (single-underlined), it is predicted that the proteins from *N.meningitidis* and *N.gonorrhoeae*, and their epitopes, could be useful antigens for vaccines or diagnostics, or for raising antibodies.

Example 38

The following DNA sequence, believed to be complete, was identified in *N.meningitidis* (SEQ ID NO: 319):

```
   1 ATGGCAGAGA TCTGTTTGAT AACCGGCACG CCCGGTTCAG GGAAAACATT
  51 AAAAATGGTT TCCATGATGG CGAATGATGA AATGTTTAAG CCTGATGAAA
 101 AAGCCATACG CCGTAAAGTA TTTACGAACA TAAAAGGCTT GAAAATACCG
 151 CACACCTACA TAGAAACGGA CGCAAAAAAG CTGCCGAAAT CGACAGATGA
 201 GCAGCTTTCG GCGCATGATA TGTACGAATG GATAAAGAAG CCCGAAAATA
 251 TCGGGTCTAT TGTCATTGTA GATGAAGCTC AAGACGTATG GCCGGCACGC
 301 TCGGCAGGTT CAAAAATCCC TGAAAATGTC CAATGGCTGA ATACGCACAG
 351 ACATCAGGGC ATTGATATAT TTGTTTTGAC TCAAGGTCCT AAGCTTCTAG
 401 ATCAAAATCT TAGAACGCTT GTACGGAAAC ATTACCACAT CGCTTCAAAC
 451 AAGATGGGTA TGCGTACGCT TTTAGAATGG AAAATATGCG CGGACGATCC
 501 CGTAAAAATG GCATCAAGCG CATTCTCCAG TATCTATACA CTGGATAAAA
 551 AAGTTTATGA CTTGTAysrr TmmGCGGAAG TTCATACCGT AAATAAGGTC
 601 AAGCGGTCAA AGTGGTTTTA CACTCTGCCa GTAATAGTAT TGCTGATTCC
 651 CGTGTTTGTC GGCCTGTCCT ATAAAATGTT GagCaGTTAC GGAAAAAAAC
 701 aGGAAGAACC CGCAGCACAA GAATCGGCGG CAACAGAACA GCAGGCAGTA
 751 CTTCCGGATA AAACAGAAGG CGAGCCGGTA AATAACGGCA ACCTTACCGC
 801 AGATATGTTT GTTCCGACAT TGTCCGAaAA ACCCGrAAGC AAGCcgaTTT
 851 ATAACGGTGT AAGGCAGGTA AGAACCTTTG AATATATAGC AGGCTGTATA
 901 GAAGGCGGAA GAACCGGATG CGCCTGCTAT TCGCaTCAAG GGACGGCATt
 951 gaAAGAAGTG ACGGaGTTGA TGTGccaAgG aCTATGTaAA AAacGGCTTG
1001 CCGTTTAACC CaTACAAAGA AGAAAGCCAA GGGCAGGAAG TTCAGCAAAG
1051 CGCGCAgCAA CATTCGGACA GGGCGcCAAG TTGCCACATT GGGCGGAAAA
1101 CCGTAGCAGA ACCTAATGTA CGATAATTGG GAAGAACGCG GAAACCGTT
1151 TGAAGGAATC GGaCGGGGGC GTGGTCGGAT CGGCAAACTG A
```

This corresponds to the amino acid sequence (SEQ ID NO: 320; ORF84):

```
  1 MAEICLITGT PGSGKTLKMV SMMANDEMFK PDEKAIRRKV FTNIKGLKIP
 51 HTYIETDAKK LPKSTDEQLS AHDMYEWIKK PENIGSIVIV DEAQDVWPAR
101 SAGSKIPENV QWLNTHRHQG IDIFVLTQGP KLLDQNLRTL VRKHYHIASN
151 KMGMRTLLEW KICADDPVKM ASSAFSSIYT LDKKVYDLYX XAEVHTVNKV
201 KRSKWFYTLP VIVLLIPVFV GLSYKMLSSY GKKQEEPAAQ ESAATEQQAV
251 LPDKTEGEPV NNGNLTADMF VPTLSEKPXS KPIYNGVRQV RTFEYIAGCI
301 EGGRTGCACY SMQGTALKEV TELMCKDYVK NGLPFNPYKE ESQGQEVQQS
351 AQQHSDRAQV ATLGGKPXQN LMYDNWEERG KPFEGIGGGV VGSAN*
```

Further work revealed the complete nucleotide sequence (SEQ ID NO: 321):

```
   1  ATGGCAGAGA TCTGTTTGAT AACCGGCACG CCCGGTTCAG GGAAAACATT
  51  AAAAATGGTT TCCATGATGG CGAATGATGA AATGTTTAAG CCTGATGAAA
 101  ACGGCATACG CCGTAAAGTA TTTACGAACA TAAAAGGCTT GAAAATACCG
 151  CACACCTACA TAGAAACGGA CGCAAAAAAG CTGCCGAAAT CGACAGATGA
 201  GCAGCTTTCG GCGCATGATA TGTACGAATG GATAAAGAAG CCCGAAAATA
 251  TCGGGTCTAT TGTCATTGTA GATGAAGCTC AAGACGTATG GCCGGCACGC
 301  TCGGCAGGTT CAAAAATCCC TGAAAATGTC AATGGCTGA ATACGCACAG
 351  ACATCAGGGC ATTGATATAT TTGTTTTGAC TCAAGGTCCT AAGCTTCTAG
 401  ATCAAAATCT TAGAACGCTT GTACGGAAAC ATTACCACAT CGCTTCAAAC
 451  AAGATGGGTA TGCGTACGCT TTTAGAATGG AAAATATGCG CGGACGATCC
 501  CGTAAAAATG GCATCAAGCG CATTCTCCAG TATCTATACA CTGGATAAAA
 551  AAGTTTATGA CTTGTACGAA TCAGCGGAAG TTCATACCGT AAATAAGGTC
 601  AAGCGGTCAA AGTGGTTTTA CACTCTGCCA GTAATAGTAT TGCTGATTCC
 651  CGTGTTTGTC GGCCTGTCCT ATAAAATGTT GAGCAGTTAC GGAAAAAAAC
 701  AGGAAGAACC CGCAGCACAA GAATCGGCGG CAACAGAACA GCAGGCAGTA
 751  CTTCCGGATA AAACAGAAGG CGAGCCGGTA AATAACGGCA ACCTTACCGC
 801  AGATATGTTT GTTCCGACAT TGTCCGAAAA ACCCGAAAGC AAGCCGATTT
 851  ATAACGGTGT AAGGCAGGTA AGAACCTTTG AATATATAGC AGGCTGTATA
 901  GAAGGCGGAA GAACCGGATG CGCCTGCTAT TCGCATCAAG GGACGGCATT
 951  GAAAGAAGTG ACGGAGTTGA TGTGCAAGGA CTATGTAAAA AACGGCTTGC
1001  CGTTTAACCC ATACAAAGAA GAAAGCCAAG GGCAGGAAGT TCAGCAAAGC
1051  GCGCAGCAAC ATTCGGACAG GGCGCAAGTT GCCACATTGG GCGGAAAACC
1101  GTAGCAGAAC CTAATGTACG ATAATTGGGA AGAACGCGGG AAACCGTTTG
1151  AAGGAATCGG CGGGGGCGTG GTCGGATCGG CAAACTGA
```

This corresponds to the amino acid sequence (SEQ ID NO: 322; ORF84-1):

```
  1  MAEICLITGT PGSGKTLKMV SMMANDEMFK PDENGIRRKV FTNIKGLKIP
 51  HTYIETDAKK LPKSTDEQLS AHDMYEWIKK PENIGSIVIV DEAQDVWPAR
101  SAGSKIPENV QWLNTHRHQG IDIFVLTQGP KLLDQNLRTL VRKHYHIASN
151  KMGMRTLLEW KICADDPVKM ASSAFSSIYT LDKKVYDLYE SAEVHTVNKV
201  KRSKWFYTLP VIVLLIPVFV GLSYKMLSSY GKKQEEPAAQ ESAATEQQAV
251  LPDKTEGEPV NNGNLTADMF VPTLSEKPES KPIYNGVRQV RTFEYIAGCI
301  EGGRTGCACY SHQGTALKEV TELMCKDYVK NGLPFNPYKE ESQGQEVQQS
351  AQQHSDRAQV ATLGGKP*QN LMYDNWEERG KPFEGIGGGV VGSAN*
```

Computer analysis of this amino acid sequence gave the following results:
Homology with a Predicted ORF from *N.meningitidis* (Strain A)

ORF84 (SEQ ID NO: 320) shows 93.9% identity over a 395aa overlap with an ORF (ORF84a) (SEQ ID NO: 324) from strain A of *N. meningitidis*:

```
              10        20        30        40        50        60
orf84.pep MAEICLITGTPGSGKTLKMVSMMANDEMFKPDEKAIRRKVFTNIKGLKIPHTYIETDAKK
          ||||||||||||||||||||||||||||||||||::||||||||||||||||||||||||
orf84a    MAEICLITGTPGSGKTLKMVSMMANDEMFKPDENGIRRKVFTNIKGLKIPHTYIETDAKK
              10        20        30        40        50        60

70        80        90       100       110       120
orf84.pep LPKSTDEQLSAHDMYEWIKKPENIGSIVIVDEAQDVWPARSAGSKIPENVQWLNTHRHQG
          ||||||||||||||||||||||||||||||||||||||||||||||||||||||||||||
orf84a    LPKSTDEQLSAHDMYEWIKKPENIGSIVIVDEAQDVWPARSAGSKIPENVQWLNTHRHQG
              70        80        90       100       110       120

130       140       150       160       170       180
orf84.pep IDIFVLTQGPKLLDQNLRTLVRKHYHIASNKMGMRTLLEWKICADDPVKMASSAFSSIYT
          ||||||||| ||||||||||||||||||||||||||||||||||||||||||||||||||
orf84a    IDIFVLTQGSKLLDQNLRTLVRKHYHIASNKMGMRTLLEWKICADDPVKMASSAFSSIYT
             130       140       150       160       170       180

190       200       210       220       230       240
orf84.pep LDKKVYDLYXXAEVHTVNKVKRSKWFYTLPVIVLLIPVFVGLSYKMLSSYGKKQEEPAAQ
          |||||||||| |||||||||||||||||||||||:|||||||||||||||||||||||||
orf84a    LDKKVYDLYESAEVHTVNKVKRSKWFYTLPVIILLIPVFVGLSYKMLSSYGKKQEEPAAQ
             190       200       210       220       230       240

250       260       270       280       290       300
orf84.pep ESAATEQQAVLPDKTEGEPVNNGNLTADMFVPTLSEKPXSKPIYNGVRQVRTFEYIAGCI
          ||||||:|||:|||||||||||||||||||||||||||| |||||||||||||||||||:
orf84a    ESAATEHQAVFQDKTEGEPVNNGNLTADMFVPTLSEKPESKPIYNGVRQVRTFEYIAGCV
             250       260       270       280       290       300

310       320       330       340       350       360
orf84.pep EGGRTGCACYSHQGTALKEVTELMCKDYVKNGLPFNPYKEESQGQEVQQSAQQHSDRAQV
          |||||||:|||||||||||:|:||||::|||||||||||||||||::||||:||||:|||
orf84a    EGGRTGCTCYSHQGTALKEITKEMCKDYARNGLPFNPYKEESQGRDVQQSEQHHSDRPQV
             310       320       330       340       350       360

370       380       390
orf84.pep ATLGGKPXQNLMYDNWEERGKPFEGIGGGVVGSANX
          ||||||| |||||||:|||||||||||||||||||
orf84a    ATLGGKPWQNLMYDNWQERGKPFEGIGGGVVGSANX
             370       380       390
```

The complete length ORF84a nucleotide sequence (SEQ ID NO: 323) is:

```
  1  ATGGCAGAGA TCTGTTTGAT AACCGGCACG CCCGGTTCAG GGAAAACATT
 51  AAAAATGGTT TCCATGATGG CAAACGATGA AATGTTTAAG CCGGATGAAA
101  ACGGCATACG CCGTAAAGTA TTTACGAACA TCAAAGGCTT GAAGATACCG
151  CACACCTACA TAGAAACGGA CGCGAAAAAG CTGCCGAAAT CGACAGATGA
201  GCAGCTTTCG GCGCATGATA TGTACGAATG GATAAAGAAG CCCGAAAATA
251  TCGGGTCTAT TGTCATTGTA GATGAAGCTC AAGACGTATG GCCGGCACGC
301  TCGGCAGGTT CAAAAATCCC TGAAAATGTC AATGGCTGA ATACGCACAG
351  ACATCAGGGC ATTGATATAT TTGTTTTGAC TCAAGGCTCT AAGCTTCTAG
401  ATCAAAATCT TAGAACGCTT GTACGGAAAC ATTACCACAT CGCTTCAAAC
451  AAGATGGGTA TGCGTACGCT TTTAGAATGG AAAATATGCG CGGACGATCC
501  CGTAAAAATG GCATCAAGCG CATTCTCCAG TATCTATACA CTGGATAAAA
551  AAGTTTATGA CTTGTACGAA TCAGCGGAAG TTCATACCGT AAATAAGGTC
601  AAGCGGTCAA AATGGTTTTA TACTCTGCCA GTAATAATAT TGCTGATTCC
651  CGTTTTTGTC GGCCTGTCCT ATAAAATGTT AAGTAGTTAT GGAAAAAAAC
701  AGGAAGAACC CGCAGCACAA GAATCGGCGG CAACAGAACA TCAGGCAGTA
751  TTTCAGGATA AACAGAAGG CGAGCCGGTA ACAACGGTA ACCTTACCGC
```

```
-continued
 801  AGATATGTTT GTTCCGACAT TGTCCGAAAA ACCCGAAAGC AAGCCGATTT

851  ATAACGGTGT AAGGCAGGTA AGAACCTTTG AATATATAGC AGGCTGTGTA

901  GAAGGCGGAA GAACCGGATG CACATGCTAT TCGCATCAAG GGACGGCATT

951  GAAAGAAATT ACAAAGGAAA TGTGCAAGGA TTACGCAAGA AACGGATTGC

1001  CGTTTAACCC ATATAAAGAA GAAAGCCAAG GGCGGGATGT CCAGCAAAGT

1051  GAGCAGCACC ATTCGGACAG ACCGCAAGTT GCCACGTTGG GCGGAAAGCC

1101  GTGGCAAAAT CTTATGTATG ATAATTGGCA GGAGCGCGGA AAACCGTTTG

1151  AAGGAATCGG CGGGGGCGTG GTCGGATCGG CAAACTGA
                                               15
```

This encodes a protein having amino acid sequence (SEQ ID NO: 324):

```
  1  MAEICLITGT PGSGKTLKMV SMMANDEMFK PDENGIRRKV FTNIKGLKIP

51  HTYIETDAKK LPKSTDEQLS AHDMYEWIKK PENIGSIVIV DEAQDVWPAR

101  SAGSKIPENV QWLNTHRHQG IDIFVLTQGS KLLDQNLRTL VRKHYHIASN

151  KMGMRTLLEW KICADDPVKM ASSAFSSIYT LDKKVYDLYE SAEVHTVNKV

201  KRSKWFYTLP VIILLIPVFV GLSYKMLSSY GKKQEEPAAQ ESAATEHQAV

251  FQDKTEGEPV NNGNLTADMF VPTLSEKPES KPIYNGVRQV RTFEYIAGCV

301  EGGRTGCTCY SHQGTALKEI TKEMCKDYAR NGLPFNPYKE ESQGRDVQQS

351  EQHHSDRPQV ATLGGKPWQN LMYDNWQERG KPFEGIGGGV VGSAN*
```

ORF84a (SEQ ID NO: 324) and ORF84-1 (SEQ ID NO: 322) show 95.2% identity in 395 aa overlap:

```
                    10         20         30         40         50         60
orf84a.pep  MAEICLITGTPGSGKTLKMVSMMANDEMFKPDENGIRRKVFTNIKGLKIPHTYIETDAKK
            ||||||||||||||||||||||||||||||||||||||||||||||||||||||||||||
orf84-1     MAEICLITGTPGSGKTLKMVSMMANDEMFKPDENGIRRKVFTNIKGLKIPHTYIETDAKK
                    10         20         30         40         50         60

70         80         90        100        110        120
orf84a.pep  LPKSTDEQLSAHDMYEWIKKPENIGSIVIVDEAQDVWPARSAGSKIPENVQWLNTHRHQG
            ||||||||||||||||||||||||||||||||||||||||||||||||||||||||||||
orf 84-1    LPKSTDEQLSAHDMYEWIKKPENIGSIVIVDEAQDVWPARSAGSKIPENVQWLNTHRHQG
                    70         80         90        100        110        120

130        140        150        160        170        180
orf84a.pep  IDIFVLTQGSKLLDQNLRTLVRKHYHIASNKMGMRTLLEWKICADDPVKMASSAFSSIYT
            |||||||||| |||||||||||||||||||||||||||||||||||||||||||||||||
orf84-1     IDIFVLTQGPKLLDQNLRTLVRKHYHIASNKMGMRTLLEWKICADDPVKMASSAFSSIYT
                   130        140        150        160        170        180

190        200        210        220        230        240
orf84a.pep  LDKKVYDLYESAEVHTVNKVKRSKWFYTLPVIILLIPVFVGLSYKMLSSYGKKQEEPAAQ
            |||||||||||||||||||||||||||||||||||:||||||||||||||||||||||||
orf84-1     LDKKVYDLYESAEVHTVNKVKRSKWFYTLPVIVLLIPVFVGLSYKMLSSYGKKQEEPAAQ
                   190        200        210        220        230        240

250        260        270        280        290        300
orf84a.pep  ESAATEHQAVFQDKTEGEPVNNGNLTADMFVPTLSEKPESKPIYNGVRQVRTFEYIAGCV
            ||||||:|||:|||||||||||||||||||||||||||||||||||||||||||||||:
orf84-1     ESAATEQQAVLPDKTEGEPVNNGNLTADMFVPTLSEKPESKPIYNGVRQVRTFEYIAGCI
                   250        260        270        280        290        300

310        320        330        340        350        360
orf84a.pep  EGGRTGCTCYSHQGTALKEITKEMCKDYARNGLPFNPYKEESQGRDVQQSEQHHSDRPQV
            ||||||:|||||||||||||:|: ||||::|||||||||||||||::||| |:|||| ||
orf84-1     EGGRTGCACYSHQGTALKEVTELMCKDYVKNGLPFNPYKEESQGQEVQQSAQQHSDRAQV
                   310        320        330        340        350        360
```

```
                   370        380        390
orf84a.pep  ATLGGKPWQNLMYDNWQERGKPPEGIGGGVVGSANX
            |||||||  |||||||||:||||||||||||||||
orf84-1     ATLGGKPXQNLMYDNWEERGKPFEGIGGGVVGSANX
                   370        380        390
```

Homology with a Predicted ORF from *N.gonorrhoeae*

ORF84 (SEQ ID NO: 320) shows 94.2% identity over a 395aa overlap with a predicted ORF (ORF84.ng) (SEQ ID NO: 326) from *N. gonorrhoeae*:

```
orf84.pep  MAEICLITGTPGSGKTLKMVSMMANDEMFKPDEKAIRRKVFTNIKGLKIPHTYIETDAKK    60
           ||||||||||||||||||||||||||||||||:::|||||||||||||||||:|||||||
orf84ng    MAEICLITGTPGSGKTLKMVSMMANDEMFKPDENGVRRKVFTNIKGLKIPHTHIETDAKK    60 orf84.pep  LPKSTDEQLSAHDMYEWIKKPENIGSIVIVDEAQDVWPARSAGSKIPENVQWLNTHRHQG   120
           |||||||||||||||||||||||||:|:||||||||||||||||||||||||||||||||
orf84ng    LPKSTDEQLSAHDMYEWIKKPENVGAIVIVDEAQDVWPARSAGSKIPENVQWLNTHRHQG   120 orf84.pep  IDIFVLTQGPKLLDQNLRTLVRKHYHIASNKMGMRTLLEWKICADDPVKMASSAFSSIYT   180
           ||||||||||||||||||||||::|||||:||||:|||||||:|||||||||||||||||
orf84ng    IDIFVLTQGPKLLDQNLRTLVKRHYHIAANKMGLRTLLEWKVCADDPVKMASSAFSSIYT   180 orf84.pep  LDKKKYDLYXXAEVHTVNKVKRSKWFYTLPVIVLLIPVFVGLSYKMLSSYGKKQEEPAAQ   240
           |||||||||   ||:|||||||||||||:||||:||||:|||||||||:|||||||||||
orf84ng    LDKKVYDLYESAEIHTVNKVKRSKWFYALPVIILLIPLFVGLSYKMLGSYGKKQEEPAAQ   240 orf84.pep  ESAATEQQAVLPDKTEGEPVNNGNLTADMFVPTLSEKPXSKPIYNGVRQVRTFEYIAGCI   300
           ||||||||||||||||||| |||||||||||||||| ||| |||||||||||||||||||
orf84ng    ESAATEQQAVLPDKTEGESVNNGNLTADMFVPTLPEKPESKPIYNGVRQVRTFEYIAGCI   300 orf84.pep  EGGRTGCACYSHQGTALKEVTELMCKDYVKNGLPFNPYKEESQGQEVQQSAQQHSDRAQV   360
           |||||||:||||||||||||||||||||||||||||||||||||||||||||||||||||
orf84ng    EGGRTGCTCYSHQGTALKEVTELMCKDYVKNGLPFNPYKEESQGQEVQQSAQQHSDRAQV   360 orf84.pep  ATLGGKPXQNLMYDNWEERGKPFEGIGGGVVGSAN                            395
           |||||||  ||||||||||||||||||||||||||
orf84ng    ATLGGKPQQNLMYDNWEERGKPFEGIGGGVVGSAN                            395
```

The complete length ORF84ng nucleotide sequence (SEQ ID NO: 325) is:

```
  1  ATGGCAGAAA TCTGTTTGAT AACCGGCACG CCCGGTTCAG GGAAAACATT

51  AAAAATGGTT TCCATGATGG CAAACGATGA AATGTTTAAG CCAGATGAAA

101  ACGGCGTACG CCGTAAAGTA TTTACGAACA TCAAAGGTTT GAAGATACCG

151  CACACCCACA TAGAAACAGA CGCAAAGAAG CTGCCGAAAT CAACCGATGA

201  ACAGCTTTCG GCGCATGATA TGTATGAATG GATCAAGAAG CCTGAAAacg 251  tcggcgCAAT CGTTATTGTC GATGAGGCGC AAGACGTATG GCCCGCACGC 301  TccgCAGGTT CGAAAATCCC CGAAAACGTC CAATGGCTGA ACACACACAG

351  GCATCAGGGC ATAGATATAT TTGTATTGAC ACAAGGTCCT AAACTCTTAG

401  ATCAGAACTT GCGAACATTG GTTAAAAGAC ATTACCACAT TGCCGGCCAAC

451  AAAATGGGTT TGCGTACCCT GCTTGAATGG AAAGTATGCG CGGATGACCC

501  GGTAAAAATG GCATCAAGTG CATTTTCCAG TATCTACACA CTGGATAAAA

551  AAGTTTATGA CTTGTACGAA TCCGCAGAAA TTCACACGGT AAACAAAGTC

601  AAGCGTTCAA AATGGTTTTA TGCATTGCCC GTCATCATAT TATTGATTCC

651  GCTATTTGTC GGTTTGTCTT ACAAAATGTT GGGCAGTTAC GGAAAAAAAC

701  AGGAAGAACC CGCAGCACAA GAATCGGCGG CAACAGAACA GCAGGCAGTA
```

```
-continued
 751   CTTCCGGATA AAACAGAAGG AGAATCGGTG AATAACGGAA ACCTTACGGC

801   AGATATGTTT GTTCCGACAT TGCCCGAAAA ACCCGAAAGC AAGCCGATTT

851   ATAACGGTGT AAGGCAGGTA AGGACCTTTG AATATATAGC AGGCTGTATA

901   GAAGGCGGAA GAACCGGATG CACCTGCTAT TCGCATCAAG GGACGGCATT

951   GAAAGAAGTG ACGGAGTTGA TGTGCAAGGA CTATGTAAAA AACGGCTTGC

1001   CGTTTAACCC ATACAAAGAA GAAAGCCAAG GGCAGGAAGT TCAGCAAAGC

1051   GCGCAGCAAC ATTCGGACAG GGCGCAAGTT GCCACCTTGG GCGGAAAACC

1101   GCAGCAGAAC CTAATGTACG ACAATTGGGA AGAACGCGGG AAACCGTTTG

1151   AAGGAATCGG CGGGGGCGTG GTCGGATCGG CAAACTGA
```

This encodes a protein having amino acid sequence (SEQ ID NO: 326):

```
  1    MAEICLITGT PGSGKTLKMV SMMANDEMFK PDENGVRRKV FTNIKGLKIP

51    HTHIETDAKK LPKSTDEQLS AHDMYEWIKK PENVGAIVIV DEAQDVWPAR

101    SAGSKIPENV QWLNTHRHQG IDIFVLTQGP KLLDQNLRTL VKRHYHIAAN

151    KMGLRTLLEW KVCADDPVKM ASSAFSSIYT LDKKVYDLYE SAEIHTVNKV

201    KRSKWFYALP VIILLIPLFV GLSYKMLGSY GKKQEEPAAQ ESAATEQQAV

251    LPDKTEGESV NNGNLTADMF VPTLPEKPES KPIYNGVRQV RTFEYIAGCI

301    EGGRTGCTCY SHQGTALKEV TELMCKDYVK NGLPFNPYKE ESQGQEVQQS

351    AQQHSDRAQV ATLGGKPQQN LMYDNWEERG KPFEGIGGGV VGSAN*
```

ORF84-1 (SEQ ID NO: 322) show 95.4% identity in 395 aa

```
                 10         20         30         40         50         60
orf84a.pep  MAEICLITGTPGSGKTLKMVSMMANDEMFKPDENGIRRKVFTNIKGLKIPHTYIETDAKK
            ||||||||||||||||||||||||||||||||||||:|||||||||||||||:|||||||
orf84ng     MAEICLITGTPGSGKTLKMVSMMANDEMFKPDENGVRRKVFTNIKGLKIPHTYIETDAKK
                 10         20         30         40         50         60

70         80         90        100        110        120
orf84a.pep  LPKSTDEQLSAHDMYEWIKKPENIGSIVIVDEAQDVWPARSAGSKIPENVQWLNTHRHQG
            |||||||||||||||||||||||:|:||||||||||||||||||||||||||||||||||
orf84ng     LPKSTDEQLSAHDMYEWIKKPENVGAIVIVDEAQDVWPARSAGSKIPENVQWLNTHRHQG
                 70         80         90        100        110        120

130        140        150        160        170        180
orf84a.pep  IDIFVLTQGSKLLDQNLRTLVRKHYHIASNKMGMRTLLEWKICADDPVKMASSAFSSIYT
            |||||||||::|||||||||||||||||||||||||||||||||||||||||||||||||
orf84ng     IDIFVLTQGPKLLDQNLRTLVRKHYHIASNKMGMRTLLEWKICADDPVKMASSAFSSIYT
                130        140        150        160        170        180

190        200        210        220        230        240
orf84a.pep  LDKKVYDLYESAEVHTVNKVKRSKWFYTLPVIVLLIPVFVGLSYKMLSSYGKKQEEPAAQ
            ||||||||||||:|||||||||||||:||||:||||:||||||||||:||||||||||||
orf84ng     LDKKVYDLYESAEIHTVNKVKRSKWFYALPVIILLIPLFVGLSYKMLGSYGKKQEEPAAQ
                190        200        210        220        230        240

250        260        270        280        290        300
orf84a.pep  ESAATEQQAVLPDKTEGEPVNNGNLTADMFVPTLSEKPESKPIYNGVRQVRTFEYIAGCI
            |||||||||||||||||||:||||||||||||||:|||||||||||||||||||||||||
orf84ng     ESAATEQQAVLPDKTEGESVNNGNLTADMFVPTLPEKPESKPIYNGVRQVRTFEYIAGCI
                250        260        270        280        290        300
```

```
                      310        320        330        340        350        360
orf84a.pep    EGGRTGCACYSHQGTALKEVTELMCKDYVKNGLPFNPYKEESQGQEVQQSAQQHSDRAQV
              ||||||:|||||||||||||||||||||||||||||||||||||||||||||||||||
orf84ng       EGGRTGCTCYSHQGTALKEVTELMCKDYVKNGLPFNPYKEESQGQEVQQSAQQHSDRAQV
                      310        320        330        340        350        360

370        380        390
orf84a.pep    ATLGGKPXQNLMYDNWEERGKPFEGIGGGVVGSANX
              |||||||  ||||||||||||||||||||||||||
orf84ng       ATLGGKPQQNLMYDNWEERGKPFEGIGGGVVGSANX
                      370        380        390
```

Based on this analysis, including the presence of a putative transmembrane domain (single-underlined) in the gonococcal protein, and a putative ATP/GTP-binding site motif A (P-loop, double-underlined), it is predicted that the proteins from *N.meningitidis* and *N.gonorrhoeae*, and their epitopes, could be useful antigens for vaccines or diagnostics, or for raising antibodies.

Example 39

The following partial DNA sequence was identified in *N.meningitidis* (SEQ ID NO: 327):

```
   1  GTGGTTTTCC TGAATGCCGA CAACGGGATA TTGGTTCAGG ACTTGCCTTT
  51  TGAAGTCAAA CTGAAAAAAT TCCATATCGA TTTTTACAAT ACGGGTATGC
 101  CGCGTGATTT CGCCAGCGAT ATTGAAGTGA CGGACAAGGC AACCGGTGAG
 151  AAACTCGAGC GCACCATCCG CGTGAACCAT CCTTTGACCT TGCACGGCAT
 201  CACGATTTAT CAGGCGAGTT TTGCCGACGG CGGTTCGGAT TTGACATTCA
 251  AGGCGTGGAA TTTGGGTGAT GCTTCGCGCG AGCCTGTCGT GTTGAAGGCA
 301  ACATCCATAC ACCAGTTTCC GTTGGAAATT GGCAAACACA AATATCGTCT
 351  TGAGTTCGAT CAGTTCACTT CTATGAATGT GGAGGACATG AGCGAGGGCG
 401  CGGAACGGGA AAAAAGCCTG AAATCCACGC TGCCCGATGT CCGCGCCGTT
 451  ACTCAGGAAG GTCACAAATA CACCAAT... .......... .....TACCG
 501  TATCCGTGAT GCGCCAGGCC AGGCGGTCGA ATATAAAAAC TATATGCTGC
 551  CGGTTTTGCA GGAACAGGAT TATTTTTGGA TTACCGGCAC GCGCAGCGC.
 601  TTGCAGCAGC AATACCGCTG GCTGCGTATC CCCTTGGACA AGCAGTTGAA
 651  AGCGGACACC TTTATGGCAT TGCGTGAGTT TTTGAAAGAT GGGGAAGGGC
 701  GCAAACGTCT .GTTGCCGAC GCAACCAAAG GCGCACCTGC CGAAATCCGC
 751  GAACAATTCA TGCTGGCTGC GGAAAACACG CTGAACATCT TTGCACAAAA
 801  AGGCTATTTG GGATTGGACG AATTTATTAC GTCCAATATC CCGAAAGAGC
 851  AGCAGGATAA GATGCAGGGC TATTTCTACG AAATGCTTTA CGGCGTGATG
 901  AACGCTGCTT TGGATGAAAC CAT.ACCCGG TACGGCTTGC CCGAATGGCA
 951  GCAGGATGAA GCGCGGAATC GTTTCCTGCT GCACAGTATG GATGCGTACA
1001  CGGGTTTGAC CGAATATCCC GCGCCTATGC TGCTGCAACT TGATGGGTTT
1051  TCCGAGGTGC GTTCGTCGGG TTTGCAGATG ACCCGTTCCC C.GGTCCGCT
1101  TTTGGTCTAT CTC...
```

This corresponds to the amino acid sequence (SEQ ID NO: 328; ORF88):

```
  1  MVFLNADNGI LVQDLPFEVK LKKFHIDFYN TGMPRDFASD IEVTDKATGE
 51  KLERTIRVNH PLTLHGITIY QASFADGGSD LTFKAWNLGD ASREPVVLKA
```

-continued

```
101    TSIHQFPLEI GKHKYRLEFD QFTSMNVEDM SEGAEREKSL KSTLPDVRAV

151    TQEGHKYTNX XXXXXYRIRD APGQAVEYKN YMLPVLQEQD YFWITGTRSX

201    LQQQYRWLRI PLDKQLKADT FMALREFLKD GEGRKRXVAD ATKGAPAEIR

251    EQFMLAAENT LNIFAQKGYL GLDEFITSNI PKEQQDKMQG YFYEMLYGVM

301    NAALDETXTR YGLPEWQQDE ARNRFLLHSM DAYTGLTEYP APMLLQLDGF

351    SEVRSSGLQM TRSXGPLLVY L...
```

Further work revealed the complete nucleotide sequence (SEQ ID NO: 329):

```
   1    ATGAGTAAAT CCCGTAGATC TCCCCCACTT CTTTCCCGTC CGTGGTTCGC

51    TTTTTTCAGC TCCATGCGCT TTGCAGTCGC TTTGCTCAGT CTGCTGGGTA

101    TTGCATCGGT TATCGGTACG GTGTTGCAGC AAAACCAGCC GCAGACGGAT

151    TATTTGGTCA AATTCGGATC GTTTTGGGCG CAGATTTTTG GTTTTCTGGG

201    ACTGTATGAC GTCTATGCTT CGGCATGGTT TGTCGTTATC ATGATGTTTT

251    TGGTGGTTTC TACCAGTTTG TGCCTGATTC GCAATGTGCC GCCGTTCTGG

301    CGCGAAATGA AGTCTTTTCG GGAAAAGGTT AAAGAAAAAT CTCTGGCGGC

351    GATGCGCCAT TCTTCGCTGT TGGATGTAAA AATTGCGCCC GAGGTTGCCA

401    AACGTTATCT GGAAGTACAA GGTTTTCAGG GAAAAACCAT TAACCGTGAA

451    GACGGGTCGG TTCTGATTGC CGCCAAAAAA GGCACAATGA ACAAATGGGG

501    CTATATCTTT GCCCATGTTG CTTTGATTGT CATTTGCCTG GGCGGGTTGA

551    TAGACAGTAA CCTGCTGTTG AAACTGGGTA TGCTGACCGG TCGGATTGTT

601    CCGGACAATC AGGCGGTTTA TGCCAAGGAT TTCAAGCCCG AAAGTATTTT

651    GGGTGCGTCC AATCTCTCAT TTAGGGGCAA CGTCAATATT TCCGAGGGGC

701    AGAGTGCGGA TGTGGTTTTC CTGAATGCCG ACAACGGGAT ATTGGTTCAG

751    GACTTGCCTT TGAAGTCAA ACTGAAAAAA TTCCATATCG ATTTTTACAA

801    TACGGGTATG CCGCGTGATT TCGCCAGCGA TATTGAAGTG ACGGACAAGG

851    CAACCGGTGA GAAACTCGAG CGCACCATCC GCGTGAACCA TCCTTTGACC

901    TTGCACGGCA TCACGATTTA TCAGGCGAGT TTTGCCGACG GCGGTTCGGA

951    TTTGACATTC AAGGCGTGGA ATTTGGGTGA TGCTTCGCGC GAGCCTGTCG

1001    TGTTGAAGGC AACATCCATA CACCAGTTTC CGTTGGAAAT TGGCAAACAC

1051    AAATATCGTC TTGAGTTCGA TCAGTTCACT TCTATGAATG TGGAGGACAT

1101    GAGCGAGGGC GCGGAACGGG AAAAAAGCCT GAAATCCACG CTGAACGATG

1151    TCCGCGCCGT TACTCAGGAA GGTAAAAAAT ACACCAATAT CGGCCCTTCC

1201    ATTGTTTACC GTATCCGTGA TGCGGCAGGG CAGGCGGTCG AATATAAAAA

1251    CTATATGCTG CCGGTTTTGC AGGAACAGGA TTATTTTTGG ATTACCGGCA

1301    CGCGCAGCGG CTTGCAGCAG CAATACCGCT GGCTGCGTAT CCCCTTGGAC

1351    AAGCAGTTGA AAGCGGACAC CTTTATGGCA TTGCGTGAGT TTTTGAAAGA

1401    TGGGGAAGGG CGCAAACGTC TGGTTGCCGA CGCAACCAAA GGCGCACCTG

1451    CCGAAATCCG CGAACAATTC ATGCTGGCTG CGGAAAACAC GCTGAACATC

1501    TTTGCACAAA AAGGCTATTT GGGATTGGAC GAATTTATTA CGTCCAATAT
```

-continued

```
1551  CCCGAAAGAG CAGCAGGATA AGATGCAGGG CTATTTCTAC GAAATGCTTT

1601  ACGGCGTGAT GAACGCTGCT TTGGATGAAA CCATACGCCG GTACGGCTTG

1651  CCCGAATGGC AGCAGGATGA AGCGCGGAAT CGTTTCCTGC TGCACAGTAT

1701  GGATGCGTAC ACGGGTTTGA CCGAATATCC CGCGCCTATG CTGCTGCAAC

1751  TTGATGGGTT TTCCGAGGTG CGTTCGTCGG GTTTGCAGAT GACCCGTTCC

1801  CCGGGTGCGC TTTTGGTCTA TCTCGGCTCG GTGCTGTTGG TATTGGGTAC

1851  GGTATTGATG TTTTATGTGC GCGAAAAACG GGCGTGGGTA TTGTTTTCAG

1901  ACGGCAAAAT CCGTTTTGCC ATGTCTTCGG CCCGCAGCGA ACGGGATTTG

1951  CAGAAGGAAT TCCAAAACA CGTCGAGAGT CTGCAACGGC TCGGCAAGGA

2001  CTTGAATCAT GACTGA
```

This corresponds to the amino acid sequence (SEQ ID NO: 330; ORF88-1):

```
  1  MSKSRRSPPL LSRPWFAFFS SMRFAVALLS LLGIASVIGT VLQQNQPQTD

51  YLVKFGSFWA QIFGFLGLYD VYASAWFVVI MMFLVVSTSL CLIRNVPPFW

101  REMKSFREKV KEKSLAAMRH SSLLDVKIAP EVAKRYLEVQ GFQGKTINRE

151  DGSVLIAAKK GTMNKWGYIF AHVALIVICL GGLIDSNLLL KLGMLTGRIV

201  PDNQAVYAKD FKPESILGAS NLSFRGNVNI SEGQSADVVF LNADNGILVQ

251  DLPFEVKLKK FHIDFYNTGM PRDFASDIEV TDKATGEKLE RTIRVNHPLT

301  LHGITIYQAS FADGGSDLTF KAWNLGDASR EPVVLKATSI HQFPLEIGKH

351  KYRLEFDQFT SMNVEDMSEG AEREKSLKST LNDVRAVTQE GKKYTNIGPS

401  IVYRIRDAAG QAVEYKNYML PVLQEQDYFW ITGTRSGLQQ QYRWLRIPLD

451  KQLKADTFMA LREFLKDGEG RKRLVADATK GAPAEIREQF MLAAENTLNI

501  FAQKGYLGLD EFITSNIPKE QQDKMQGYFY EMLYGVMNAA LDETIRRYGL

551  PEWQQDEARN RFLLHSMDAY TGLTEYPAPM LLQLDGFSEV RSSGLQMTRS

601  PGALLVYLGS VLLVLGTVLM FYVREKRAWV LFSDKIRFA MSSARSERDL

651  QKEFPKHVES LQRLGKDLNH D*
```

Computer analysis of this amino acid sequence gave the following results:
Homology with a Predicted ORF from *N.meningitidis* (Strain A)

ORF88 (SEQ ID NO: 328) shows 95.7% identity over a 371aa overlap with an ORF (ORF88a) (SEQ ID NO: 332) from strain A of *N. meningitidis*:

```
                          10         20         30
orf88.pep                 MVFLNADNGILVQDLPFEVKLKKFHIDFYN
                          :|||||||||||||||||||||||||||||
orf88a    AKDFKPESILGASNLSFRGNVNISEGQSADVVFLNADNGILVQDLPFEVKLKKFHIDFYN
          210        220        230        240        250        260

40         50         60         70         80         90
orf88.pep TGMPRDFASDIEVTDKATGEKLERTIRVNHPLTLHGITIYQASFADGGSDLTFKAWNLGD
          ||||||||||||||||||||||||||||||||||||||||||||||||||||||||||||
orf88a    TGMPRDFASDIEVTDKATGEKLERTIRVNHPLTLHGITIYQASFADGGSDLTFKAWNLGD
          270        280        290        300        310        320

100        110        120        130        140        150
orf88.pep ASREPVVLKATSIHQFPLEIGKHKYRLEFDQFTSMNVEDMSEGAEREKSLKSTLPDVRAV
          |||||||||||||||||||||||||||||||||||||||||||||||||||||| |||||
orf88a    ASREPVVLKATSIHQFPLEIGKHKYRLEFDQFTSMNVEDMSEGAEREKSLKSTLNDVRAV
          330        340        350        360        370        380
```

```
                     -continued
               160        170        180        190        200        210
orf88.pep  TQEGHKYTNXXXXXXYRIRDAPGQAVEYKNYMLPVLQEQDYFWITGTRSXLQQQYRWLRI
           ||||:||||      ||||||  |||||||||||||||||||||||||| |||||||||||
orf88a     TQEGKKYTNIGPSIVYRIRDAAGQAVEYKNYMLPVLQEQDYFWITGTRSGLQQQYRWLRI
               390        400        410        420        430        440

220        230        240        250        260        270
orf88.pep  PLDKQLKADTFMALREFLKDGEGRKRXVADATKGAPAEIREQFMLAAENTLNIFAQKGYL
           ||||||||||||||||||||||||||| ||||||||||||||||||||||||||||||||
orf88a     PLDKQLKADTFMALREFLKDGEGRKRLVADATKGAPAEIREQFMLAAENTLNIFAQKGYL
               450        460        470        480        490        500

280        290        300        310        320        330
orf88.pep  GLDEFITSNIPKEQQDKMQGYFYEMLYGVMNAALDETXTRYGLPEWQQDEARNRFLLHSM
           |||||||||||||||||||||||||||||||||||||| |||||||||||||||||||||
orf88a     GLDEFITSNIPKEQQDKMQGYFYEMLYGVMNAALDETIRRYGLPEWQQDEARNRFLLHSM
               510        520        530        540        550        560

340        350        360        370
orf88.pep  DAYTGLTEYPAPMLLQLDGFSEVRSSGLQMTRSXGPLLVYL
           |||||||||||||||||||||||||||||||||| | |||||
orf88a     DAYTGLTEYPAPMLLQLDGFSEVRSSGLQMTRSPGALLVYLGSVLLVLGTVLMFYVREKR
               570        580        590        600        610        620 orf88a     AWVLFSDGKIRFAMSSARSERDLQKEFPKHVESLQRLGKDLNHDX
               630        640        650        660        670
```

The complete length ORF88a nucleotide sequence (SEQ ID NO: 331) is:

```
   1  ATGAGTAAAT CCCGTAGATC TCCCCCACTT CTTTCCCGTC CGTGGTTCGC
  51  TTTTTTCAGC TCCATGCGCT TGCGGTCGC  TTTGCTCAGT CTGCTGGGTA
 101  TTGCATCGGT TATCGGTACG GTGTTGCAGC AAAACCAGCC GCAGACGGAT
 151  TATTTGGTCA AATTCGGATC GTTTTGGGCG CAGATTTTTG GTTTTCTGGG
 201  ACTGTATGAC GTCTATGCTT CGGCATGGTT TGTCGTTATC ATGATGTTTT
 251  TGGTGGTTTC TACCAGTTTG TGCCTGATTC GCAATGTGCC GCCGTTCTGG
 301  CGCGAAATGA AGTCTTTTCG GGAAAAGGTT AAAGAAAAAT CTCTGGCGGC
 351  GATGCGCCAT TCTTCGCTGT TGGATGTAAA AATTGCGCCC GAGGTTGCCA
 401  AACGTTATCT GGAAGTACAA GGTTTTCAGG GAAAAACCAT TAACCGTGAA
 451  GACGGGTCGG TTCTGATTGC CGCCAAAAAA GGCACAATGA ACAAATGGGG
 501  CTATATCTTT GCCCATGTTG CTTTGATTGT CATTTGCCTG GGCGGGTTGA
 551  TAGACAGTAA CCTGCTGTTG AAACTGGGTA TGCTGACCGG TCGGATTGTT
 601  CCGGACAATC AGGCGGTTTA TGCCAAGGAT TTCAAGCCCG AAAGTATTTT
 651  GGGTGCGTCC AATCTCTCAT TTAGGGGCAA CGTCAATATT TCCGAGGGGC
 701  AGAGTGCGGA TGTGGTTTTC CTGAATGCCG ACAACGGGAT ATTGGTTCAG
 751  GACTTGCCTT TGAAGTCAA  ACTGAAAAAA TTCCATATCG ATTTTTACAA
 801  TACGGGTATG CCGCGCGATT TGCCAGTGA  TATTGAAGTA ACGGATAAGG
 851  CAACCGGTGA GAAACTCGAG CGCACCATCC GCGTGAACCA TCCTTTGACC
 901  TTGCACGGCA TCACGATTTA TCAGGCGAGT TTTGCCGACG GCGGTTCGGA
 951  TTTGACATTC AAGGCGTGGA ATTTGGGTGA TGCTTCGCGC GAGCCTGTCG
1001  TGTTGAAGGC AACATCCATA CACCAGTTTC CGTTGGAAAT TGGCAAACAC
1051  AAATATCGTC TTGAGTTCGA TCAGTTTACT TCTATGAATG TGGAGGACAT
1101  GAGCGAGGGC GCGGAACGGG AAAAAAGCCT GAAATCCACG CTGAACGATG
```

-continued

```
1151  TCCGCGCCGT TACTCAGGAA GGTAAAAAAT ACACCAATAT CGGCCCTTCC
1201  ATTGTTTACC GTATCCGTGA TGCGGCAGGG CAGGCGGTCG AATATAAAAA
1251  CTATATGCTG CCGGTTTTGC AGGAACAGGA TTATTTTTGG ATTACCGGCA
1301  CGCGCAGCGG CTTGCAGCAG CAATACCGCT GGCTGCGTAT CCCCTTGGAC
1351  AAGGAGTTGA AAGCGGACAC CTTTATGGCA TTGCGTGAGT TTTTGAAAGA
1401  TGGGGGAGGG CGCAAACGTC TGGTTGCCGA CGCAACCAAA GGCGCACCTG
1451  CCGAAATCCG CGAACAATTC ATGCTGGCTG CGGAAAACAC GCTGAACATC
1501  TTTGCACAAA AAGGCTATTT GGGATTGGAC GAATTTATTA CGTCCAATAT
1551  CCCGAAAGAG CAGCAGGATA AGATGCAGGG CTATTTCTAC GAAATGCTTT
1601  ACGGCGTGAT GAACGCTGCT TTGGATGAAA CCATACGCCG GTACGGCTTG
1651  CCCGAATGGC AGCAGGATGA AGCGCGGAAT CGTTTCCTGC TGCACAGTAT
1701  GGATGCGTAC ACGGGTTTGA CCGAATATCC CGCGCCTATG CTGCTGCAAC
1751  TTGATGGGTT TTCCGAGGTG CGTTCGTCGG GTTTGCAGAT GACCCGTTCC
1801  CCGGGTGCGC TTTTGGTCTA TCTCGGCTCG GTGCTGTTGG TATTGGGTAC
1851  GGTATTGATG TTTTATGTGC GCGAAAAACG GGCGTGGGTA TTGTTTTCAG
1901  ACGGCAAAAT CCGTTTTGCC ATGTCTTCGG CCCGCAGCGA ACGGGATTTG
1951  CAGAAGGAAT TCCAAAACA CGTCGAGAGT CTGCAACGGC TCGGCAAGGA
2001  CTTGAATCAT GACTGA
```

This encodes a protein having amino acid sequence (SEQ ID NO: 332):

```
  1  MSKSRRSPPL LSRPWFAFFS SMRFAVALLS LLGIASVIGT VLQQNQPQTD
 51  YLVKFGSFWA QIFGFLGLYD VYASAWFVVI MMFLVVSTSL CLIRNVPPFW
101  REMKSFREKV KEKSLAAMRH SSLLDVKIAP EVAKRYLEVQ GFQGKTINRE
151  DGSVLIAAKK GTMNKWYIF AHVALIVICL GGLIDSNLLL KLGMLTGRIV
201  PDNQAVYAKD FKPESILGAS NLSFRGNVNI SEGQSADVVF LNADNGILVQ
251  DLPFEVKLKK FHIDFYNTGM PRDFASDIEV TDKATGEKLE RTIRVNHPLT
301  LHGITIYQAS FADGGSDLTF KAWNLGDASR EPVVLKATSI HQFPLEIGKH
351  KYRLEFDQFT SMNVEDMSEG AEREKSLKST LNDVRAVTQE GKKYTNIGPS
401  IVYRIRDAAG QAVEYKNYML PVLQEQDYFW ITGTRSGLQQ QYRWLRIPLD
451  KQLKADTFMA LREFLKDGEG RKRLVADATK GAPAEIREQF MLAAENTLNI
501  FAQKGYLGLD EFITSNIPKE QQDKMQGYFY EMLYGVMNAA LDETIRRYGL
551  PEWQQDEARN RFLLHSMDAY TGLTEYPAPM LLQLDGFSEV RSSGLQMTRS
601  PGALLVYLGS VLLVLGTVLM FYVREKRAWV LFSDGKIRFA MSSARSERDL
651  QKEFPKHVES LQRLGKDLNH D*
```

ORF88a (SEQ ID NO: 332) and ORF88-1 (SEQ ID NO: 330) 100.0% identity in 671 aa overlap:

```
orf88a.pep  MSKSRRSPPLLSRPWFAFFSSMRFAVALLSLLGIASVIGTVLQQNQPQTDYLVKFGSFWA  60
            ||||||||||||||||||||||||||||||||||||||||||||||||||||||||||||
orf88-1     MSKSRRSPPLLSRPWFAFFSSMRFAVALLSLLGIASVIGTVLQQNQPQTDYLVKFGSFWA  60
```

-continued
```
orf88a.pep  QIFGFLGLYDVYASAWFVVIMMFLVVSTSLCLIRNVPPFWREMKSFREKVKEKSLAAMRH   120
            ||||||||||||||||||||||||||||||||||||||| |||||||||||||||||||
orf88-1     QIFGFLGLYDVYASAWFVVIMMFLVVSTSLCLIRNVPPFWRRMKSFREKVKEKSLAAMRH   120 orf88a.pep  SSLLDVKIAPEVAKRYLEVQGFQGKTINREDGSVLIAAKKGTMNKWGYIFAHVALIVICL   180
            ||||||||||||||||||||||||||||||||||||||||||||||||||||||||||||
orf88-1     SSLLDVKIAPEVAKRYLEVQGFQGKTINREDGSVLIAAKKGTMNKWGYIFAHVALIVICL   180 orf88a.pep  GGLIDSNLLLKLGMLTGRIVPDNQAVYAKDFKPESILGASNLSFRGNVNISEGQSADVVF   240
            ||||||||||||||||||||||||||||||||||||||||||||||||||||||||||||
orf88-1     GGLIDSNLLLKLGMLTGRIVPDNQAVYAKDFKPESILGASNLSFRGNVNISEGQSADVVF   240 orf88a.pep  LNADNGILVQDLPFEVKLKKFHIDFYNTGMPRDFASDIEVTDKATGEKLERTIRVNHPLT   300
            ||||||||||||||||||||||||||||||||||||||||||||||||||||||||||||
orf88-1     LNADNGILVQDLPFEVKLKKFHIDFYNTGMPRDFASDIEVTDKATGEKLERTIRVNHPLT   300 orf88a.pep  LHGITIYQASFADGGSDLTFKAWNLGDASREPVVLKATSIHQFPLEIGKHKYRLEFDQFT   360
            ||||||||||||||||||||||||||||||||||||||||||||||||||||||||||||
orf88-1     LHGITIYQASFADGGSDLTFKAWNLGDASREPVVLKATSIHQFPLEIGKHKYRLEFDQFT   360 orf88a.pep  SMNVEDMSEGAEREKSLKSTLNDVRAVTQEGKKYTNIGPSIVYRIRDAAGQAVEYKNYML   420
            ||||||||||||||||||||||||||||||||||||||||||||||||||||||||||||
orf88-1     SMNVEDMSEGAEREKSLKSTLNDVRAVTQEGKKYTNIGPSIVYRIRDAAGQAVEYKNYML   420 orf88a.pep  PVLQEQDYFWITGTRSGLQQQYRWLRIPLDKQLKADTFMALREFLKDGEGRKRLVADATK   480
            ||||||||||||||||||||||||||||||||||||||||||||||||||||||||||||
orf88-1     PVLQEQDYFWITGTRSGLQQQYRWLRIPLDKQLKADTFMALREFLKDGEGRKRLVADATK   480 orf88a.pep  GAPAEIREQFMLAAENTLNIFAQKGYLGLDEFITSNIPKEQQDKMQGYFYEMLYGVMNAA   540
            ||||||||||||||||||||||||||||||||||||||||||||||||||||||||||||
orf88-1     GAPAEIREQFMLAAENTLNIFAQKGYLGLDEFITSNIPKEQQDKMQGYFYEMLYGVMNAA   540 orf88a.pep  LDETIRRYGLPEWQQDEARNRFLLHSMDAYTGLTEYPAPMLLQLDGFSEVRSSGLQMTRS   600
            ||||||||||||||||||||||||||||||||||||||||||||||||||||||||||||
orf88-1     LDETIRRYGLPEWQQDEARNRFLLHSMDAYTGLTEYPAPMLLQLDGFSEVRSSGLQMTRS   600 orf88a.pep  PGALLVYLGSVLLVLGTVLMFYVREKRAWVLFSDGKIRFAMSSARSERDLQKEFPKHVES   660
            ||||||||||||||||||||||||||||||||||||||||||||||||||||||||||||
orf88-1     PGALLVYLGSVLLVLGTVLMFYVREKRAWVLFSDGKIRFAMSSARSERDLQKEFPKHVES   660 orf88a.pep  LQRLGKDLNHD                                                  672
            |||||||||||
orf88-1     LQRLGKDLNHD                                                  672
```

Homology with a Predicted ORF from N.gonorrhoeae

ORF88 (SEQ ID NO: 328) shows 93.8% identity over a 371aa overlap with a predicted ORF (ORF88.ng) (SEQ ID NO: 334) from N. gonorrhoeae:

```
orf88.pep  MVFLNADNGILVQDLPFEVKLKKFHIDFYNTGMPRDFASDIEVTDKATGEKLERTIRVNH   60
           |||||||||:||||||||||||||||||||||||||||||||||||||||||||||||||
orf88ng    MVFLNADNGMLVQDLPFEVKLKKFHIDFYNTGMPRDFASDIEVTDKATGEKLERTIRVNH   60 orf88.pep  PLTLHGITIYQASFADGGSDLTFKAWNLGDASREPVVLKATSIHQFPLEIGKHKYRLEFD   120
           |||||||||||||||||||||||||||||| |||||||||||||||||||||||||||||
orf88ng    PLTLHGITIYQASFADGGSDLTFKAWNLRDASREPVVLKATSIHQFPLEIGKHKYRLEFD   120 orf88.pep  QFTSMNVEDMSEGAEREKSLKSTLPDVRAVTQEGHKYTNXXXXXXYRIRDAPGQAVEYKN   180
           ||||||||||||||||||||||||| ||||||||:|||| |||||| ||||| |||||||
orf88ng    QFTSMNVEDMSEGAEREKSLKSTLNDVRAVTQEGKKYTNIGPSIVYRIRDAAGQAVEYKN   180 orf88.pep  YMLPVLQEQDYFWITGTRSXLQQQYRWLRIPLDKQLKADTFMALREFLKDGEGRKRVAD   240
           ||||:||::||||:||||| ||||||||||||||||||||||||||||||||||||| ||
orf88ng    YMLPILQDKDYFWLTGTRSGLQQQYRWLRIPLDKQLKADTFMALREFLKDGEGRKRLVAD   240 orf88.pep  ATKGAPAEIREQFMLAAENTLNIFAQKGYLGLDEFITSNIPKEQQDKMQGYFYEMLYGVM   300
           ||| ||||||||||||||||||||||||||||||||||||||| ||||||||||||||||
orf88ng    ATKDAPAEIREQFMLAAENTLNIFAQKGYLGLDEFITSNIPKGQQDKMQGYFYEMLYGVM   300 orf88.pep  NAALDETXTRYGLPEWQQDEARNRFLLHSMDAYTGLTEYPAPMLLQLDGFSEVRSSGLQM   360
           ||||||| |||||||||||||||||||||||||||||||||||||||||||||||||||
orf88ng    NAALDETIRRYGLPEWQQDEARNRFLLHSMDAYTGLTEYPAPMLLQLDGFSEVRSSGLQM   360 orf88.pep  TRSXGPLLVYL                                                  371
           ||| | |||||
orf88ng    TRSPGALLVYLGSVLLVLGTVFMFYVPKKRAWVLFSNXKIRFAMSSARSERDLQKEFPKH 420
```

An ORF88ng nucleotide sequence (SEQ ID NO: 333) was predicted to encode a protein having amino acid sequence (SEQ ID NO: 334):

```
  1    MVFLNADNGM LVQDLPFEVK LKKFHIDFYN TGMPRDFASD IEVTDKATGE
 51    KLERTIRVNH PLTLHGITIY QASFADGGSD LTFKAWNLRD ASREPVVLKA
101    TSIHQFPLEI GKHKYRLEFD QFTSMNVEDM SEGAEREKSL KSTLNDVRAV
151    TQEGKKYTNI GPSIVYRIRD AAGQAVEYKN YMLPILQDKD YFWLTGTRSG
201    LQQQYRWLRI PLDKQLKADT FMALREFLKD GEGRKRLVAD ATKDAPAEIR
251    EQFMLAAENT LNIFAQKGYL GLDEFITSNI PKGQQDKMQG YFYEMLYGVM
301    NAALDETIRR YGLPEWQQDE ARNRFLLHSM DAYTGLTEYP APMLLQLDGF
351    SEVRSSGLQM TRSPGALLVY LGSVLLVLGT VFMFYVPKKR AWVLFSNXKI
401    RFAMSSARSE RDLQKEFPKH VESLQRLGKD LNHD*
```

Further work revealed the complete gonococcal DNA sequence (SEQ ID NO: 335):

```
   1   ATGAGTAAAT CCCGTATATC TCCCACACTT CTTTCCCGTC CGTGGTTCGC
  51   TTTTTTCAGC TCCATGCGCT TGCGGTCGC TTTGCTCAGT CTGCTGGGTA
 101   TTGCATCGGT TATCGGCACG GTGTTACAGC AAAACCAGCC GCAGACGGAT
 151   TATTTGGTCA AATTCGGACC GTTTTGGACT CGGATTTTTG ATTTTTTGGG
 201   TTTGTATGAT GTCTATGCTT CGGCATGGTT TGTCGTTATC ATGATGTTTC
 251   TGGTGGTTTC TACCAGTTTG TGTTTAATCC GTAACGTTCC GCCGTTTTGG
 301   CGCGAAATGA AGTCTTTCCG GGAAAAGGTT AAAGAAAAAT CTCTGGCGGC
 351   GATGCGCCAT TCTTCGCTGT TGGATGTAAA AATTGCCCCC GAAGTTGCCA
 401   AACGTTATCT GGAGGTGCGG GGTTTTCAGG GAAAAACCGT CAGCCGTGAG
 451   GACGGGTCGG TTCTGATTGC CGCCAAAAAA GGCAcaatga acaaATGGGG
 501   CTATATCTTT GCccaagtag ctTTGATTGT CATTTGCCTG GGCGGGTTGA
 551   TAGACAGTAA CCTGCTGCTG AAGCTGGGTA TGCTGGCCGG TCGGATTGTT
 601   CCGGACAATC AGGCGGTTTA TGCCAAGGAT TTCAAGCCCG AAAGTATTTT
 651   GGGTGCGTCC AATCTCTCAT TTAGGGGCAA CGTCAATATT TCCGAGGGGC
 701   AAAGTGCGGA TGTGGTTTTC CTGAATGCCG ACAACGGGAT GTTGGTTCAG
 751   GACTTGCCTT TTGAAGTCAA ACTGAAAAAA TTCCATATCG ATTTTTACAA
 801   TACGGGTATG CCGCGCGATT TTGCCAGCGA TATTGAAGTA ACGGACAAGG
 851   CAACCGGTGA GAAACTCGAG CGCACCATCC GCGTGAACCA TCCTTTGACC
 901   TTGCACGGCA TCACGATTTA TCAGGCGAGT TTTGCCGACG GCGGTTCGGA
 951   TTTGACATTC AAGGCGTGGA ATTTGAGGGA TGCTTCGCGC GAACCTGTCG
1001   TGTTGAAGGC AACCTCCATA CACCAGTTTC CGTTGGAAAT CGGCAAACAC
1051   AAATATCGTC TTGAGTTCGA TCAGTTCACT TCTATGAATG TGGAGGACAT
1101   GAGCGAGGGT GCGGAACGGG AAAAAAGCCT GAAATCCACT CTGAACGATG
1151   TCCGCGCCGT TACTCAGGAA GGTAAAAAAT ACACCAATAT CGGCCCTTCC
1201   ATCGTGTACC GCATCCGTGA TGcggCAGGG CAGGCGGTCG AATATAAAAA
1251   CTATATGCTG CCGATTTTGC AGGACAAAGA TTATTTTTGG CTGACCGGCA
```

-continued

```
1301  CGCGCAGCGG CTTGCAGCAG CAATACCGCT GGCTGCGTAT CCCCTTGGAC

1351  AAGCAGTTGA AAGCGGACAC CTTTATGGCA TTGCGTGAGT TTTTGAAAGA

1401  TGGGGAAGGG CGCAAACGTC TGGTTGCCGA CGCAACCAAA GACGCACCTG

1451  CCGAAATCCG CGAACAATTC ATGCTGGCTG CGGAAAACAC GCTGAATATC

1501  TTTGCGCAAA AAGGCTATTT GGGATTGGAC GAATTTATTA CGTCCAATAT

1551  CCCGAAAGGG CAGCAGGATA AGATGCAGGG CTATTTCTAC GAAATGCTTT

1601  ACGGCGTGAT GAACGCCGCT TTGGATGAAA CCATACGCCG GTACGGCTTG

1651  CCCGAATGGC AGCAGGATGA AGCGCGGAAC CGTTTCCTGC TGCACAGTAT

1701  GGATGCCTAT ACGGGGCTGA CGGAATATCC CGCGCCTATG CTGCTCCAGC

1751  TTGACGGGTT TTCCGAGGTG CGTTCCTCAG GTTTGCAGAT GACCCGTTCG

1801  CCGGGTGCGC TTTTGGTCTA TCtcggctcg gtattgttgg TTTTGGgtac 1851  ggtaTtttatg tTTTATGTGC GCGAAAAACG GGCGTGGgta tTGTTTTCag 1901  aCGGCAAAAT CCGTTTTGCT ATGtCTTcgg CCcgcagcga ACGGGATTTG 1951  cAGAaggaaT TTCCAAAACA CGtcgAGAGC CTGCAACggc tcggcaaggA 2001  CttgaaTCAT GACTga
```

This corresponds to the amino acid sequence (SEQ ID NO: 336; ORF88ng-1):

```
  1  MSKSRISPTL LSRPWFAFFS SMRFAVALLS LLGIASVIGT VLQQNQPQTD

51  YLVKFGPFWT RIFDFLGLYD VYASAWFVVI MMFLVVSTSL CLIRNVPPFW

101  REMKSFREKV KEKSLAAMRH SSLLDVKIAP EVAKRYLEVR GFQGKTVSRE

151  DGSVLIAAKK GTMNKWGYIF AQVALIVICL GGLIDSNLLL KLGMLAGRIV

201  PDNQAVYAKD FKPESILGAS NLSFRGNVNI SEGQSADVVF LNADNGMLVQ

251  DLPFEVKLKK FHIDFYNTGM PRDFASDIEV TDKATGEKLE RTIRVNHPLT

301  LHGITIYQAS FADGGSDLTF KAWNLRDASR EPVVLKATSI HQFPLEIGKH

351  KYRLEFDQFT SMNVEDMSEG AEREKSLKST LNDVRAVTQE GKKYTNIGPS

401  IVYRIRDAAG QAVEYKNYML PILQDKDYFW LTGTRSGLQQ QYRWLRIPLD

451  KQLKADTFMA LREFLKDGEG RKRLVADATK DAPAEIREQF MLAAENTLNI

501  FAQKGYLGLD EFITSNIPKG QQDKMQGYFY EMLYGVMNAA LDETIRRYGL

551  PEWQQDEARN RFLLHSMDAY TGLTEYPAPM LLQLDGFSEV RSSGLQMTRS

601  PGALLVYLGS VLLVLGTVFM FYVREKRAWV LFSDGKIRFA MSSARSERDL

651  QKEFPKHVES LQRLGKDLNH D*
```

ORF88ng-1 (SEQ ID NO: 336) and ORF88-1 (SEQ ID NO: 330) show 97.0% identity in 671 aa overlap:

```
orf88-1.pep MSKSRRSPPLLSRPWFAFFSSMRFAVALLSLLGIASVIGTVLQQNQPQTDYLVKFGSFWA   60
            ||||| ||  |||||||||||||||||||||||||||||||||||||||||||||| ||:
orf88ng-1   MSKSRISPTLLSRPWFAFFSSMRFAVALLSLLGIASVIGTVLQQNQPQTDYLVKFGPFWT   60 orf88-1.pep QIFGFLGLYDVYASAWFVVIMMFLVVSTSLCLIRNVPPFWREMKSFREKVKEKSLAAMRH  120
            :|| ||||||||||||||||||||||||||||||||||||||||||||||||||||||||
orf88ng-1   RIFDFLGLYDVYASAWFVVIMMFLVVSTSLCLIRNVPPFWREMKSFREKVKEKSLAAMRH  120
```

-continued

```
orf88-1.pep  SSLLDVKIAPEVAKRYLEVQGFQGKTINREDGSVLIAAKKGTMNKWGYIFAHVALIVICL  180
             ||||||||||||||||||||:||||||::||||||||||||||||||||:||||||||
orf88ng-1    SSLLDVKIAPEVAKRYLEVRGFQGKTVSREDGSVLIAAKKGTMNKWGYIFAQVALIVICL  180 orf88-1.pep  GGLIDSNLLLKLGMLTGRIVPDNQAVYAKDFKPESILGASNLSFRGNVNISEGQSADVVF  240
             ||||||||||||:|||||||||||||||||||||||||||||||||||||||||||||
orf88ng-1    GGLIDSNLLLKLGMLAGRIVPDNQAVYAKDFKPESILGASNLSFRGNVNISEGQSADVVF  240 orf88-1.pep  LNADNGILVQDLPFEVKLKKFHIDFYNTGMPRDFASDIEVTDKATGEKLERTIRVNHPLT  300
             ||||||:|||||||||||||||||||||||||||||||||||||||||||||||||||
orf88ng-1    LNADNGMLVQDLPFEVKLKKFHIDFYNTGMPRDFASDIEVTDKATGEKLERTIRVNHPLT  300 orf88-1.pep  LHGITIYQASFADGGSDLTFKAWNLGDASREPVVLKATSIHQFPLEIGKHKYRLEFDQFT  360
             |||||||||||||||||||||||||| |||||||||||||||||||||||||||||||
orf88ng-1    LHGITIYQASFADGGSDLTFKAWNLRDASREPVVLKATSIHQFPLEIGKHKYRLEFDQFT  360 orf88-1.pep  SMNVEDMSEGAEREKSLKSTLNDVRAVTQEGKKYTNIGPSIVYRIRDAAGQAVEYKNYML  420
             ||||||||||||||||||||||||||||||||||||||||||||||||||||||||||
orf88ng-1    SMNVEDMSEGAEREKSLKSTLNDVRAVTQEGKKYTNIGPSIVYRIRDAAGQAVEYKNYML  420 orf881.pep   PVLQEQDYFWITGTRSGLQQQYRWLRIPLDKQLKADTFMALREFLKDGEGRKRLVADATK  480
             |:||::||||:|||||||||||||||||||||||||||||||||||||||||||||||
orf68ng-1    PILQDKDYFWLTGTRSGLQQQYRWLRIPLDKQLKADTFMALREFLKDGEGRKRLVADATK  480 orf88-1.pep  GAPAEIREQFMLAAENTLNIFAQKGYLGLDEFITSNIPKEQQDKMQGYFYEMLYGVMNAA  540
             ||||||||||||||||||||||||||||||||||||||||:|||||||||||||||||
orf88ng-1    DAPAEIREQFMLAAENTLNIFAQKGYLGLDEFITSNIPKGQQDKMQGYFYEMLYGVMNAA  540 orf88-1.pep  LDETIRRYGLPEWQQDEARNRFLLHSMDAYTGLTEYPAPMLLQLDGFSEVRSSGLQMTRS  600
             ||||||||||||||||||||||||||||||||||||||||||||||||||||||||||
orf88ng-1    LDETIRRYGLPEWQQDEARNRFLLHSMDAYTGLTEYPAPMLLQLDGFSEVRSSGLQMTRS  600 orf88-1.pep  PGALLVYLGSVLLVLGTVLMFYVREKRAWVLFSDGKIRFAMSSARSERDLQKEFPKHVES  660
             ||||||||||||||||||:|||||||||||||||||||||||||||||||||||||||
orf88ng-1    PGALLVYLGSVLLVLGTVFMFYVREKRAWVLFSDGKIRFAMSSARSERDLQKEFPKHVES  660 orf88-1.pep  LQRLGKDLNHD  671
             |||||||||||
orf88ng-1    LQRLGKDLNHD  671
```

Furthermore, ORG88ng-1 (SEQ ID NO: 336) shows homology with a hypothetical protein (SEQ ID NO: 1134) from *Aquifex aeolicus*:

```
gi|2984296 (AE000771) hypothetical protein [Aquifex aeolicus] Length = 537
Score = 94.4 bits (231), Expect = 2e-18
Identities = 91/334 (27%), Positives = 159/334 (47%), Gaps = 59/334 (17%)

Query:  16 FAFFSSMRFAVALLSLLGIASVIG-TVLQQNQPQTDYLVKFGPFWTRIFDFLGLYDVYAS   74
           + F +S++ A+ ++ +LGI S++G T ++QNQ     YL +FG         L L DV+ S
Sbjct:  80 YDFLASLKIAIFIMLVLGILSMLGSTYIKQNQSFEWYLDQFGYDVGIWIWKLWLNDVFHS  139

Query:  75 AWFVVIMMFLVVSTSLCLIRNVPPFWREMKSFREKVKEKSLAAMRHSSLLDVKIAPEVAK  134
           ++++ ++ L V+   C I+ +P  W++  S  +E++ +     A +H   + VKI P+ K
Sbjct: 140 WYYILFIVLLAVNLIFCSIKRLPRVWKQAFS-KERILKLDEHAEKHLKPITVKI-PDKDK  197

Query: 135 --RYLEVRGFQGKTVSREDGSVLIAAKKGTMNKWGYIFAQVALIVICLGGLIDSNLLLKL  192
             ++L  +GF+    V  E    + + A+KG   ++ G      +AL+VI  G LID
Sbjct: 198 VLKFLLKKGFK-VFVEEEGNKLYVFAEKGRFSRLGVYITHIALLVIMAGALID-------  249

Query: 193 GMLAGRIVPDNQAVYAKDFKPESILGASNLSFRGNVNISEGQSADVVFLNADNGMLVQDL  252
                                 +I+G    RG++ ++EG + DV+ + A+          L
Sbjct: 250 ----------------------AIVGV-----RGSLIVAEGDTNDVMLVGAE--QKPYKL  280

Query: 253 PFEVKLKKFHIDFY---NTGMPRDFA-------SDIEVTDKATGEKLER--TIRVNHPLT  300
           PF V L  FI   Y   N + + FA        SDIE+ +   G K+E   T++VN  P
Sbjct: 281 PFAVHLIDFRIKTYAEENPNVDKRFAQAVSSYESDIEIIN---GGKVEAKGTVKVNEPFD  337

Query: 301 LHGITIYQASFA--DGGSDLTFKAWNLRDASREP                           332
                ++QA++   DG S +     + A +P
Sbjct: 338 FGRYRLFQATYGILDGTSGMGVIVVDRKKAHEDP                           371
```

Based on this analysis, including the putative transmembrane domain in the gonococcal protein, it is predicted that the proteins from *N.meningitidis* and *N.gonorrhoeae*, and their epitopes, could be useful antigens for vaccines or diagnostics, or for raising antibodies.

Example 40

The following DNA sequence, believed to be complete, was identified in *N.meningitidis* (SEQ ID NO: 337):

```
  1 ATGATGAGTA ATAmAATGGm ACAAAAAGGG TTTACATTGA TTGmGmTGAT
 51 GATAGTCGTC GCGATACTCG GCATTATCAG CGTCATTGCC ATACCTTCTT
101 ATCmAAGTTA TATTGAAAAA GGCTATCAGT CCCAGCTTTA TACGGAGATG
151 GyCGGTATCA ACAATATTTC CAAACAGTTT ATTTTGAAAA ATCCCCTGGA
201 CGATAATCAG ACCATCGAGA ACAAACTGGA AATATTTGTC TCAGGCTATA
251 AGATGAATCC GAAAATTGCC AAAAAaTATA GTGTTTCGGT AAAGTTTGTC
301 GATAAGGAAA AATCCAGGGC ATACAGGTTG GTCGGCGTTC CGAAGGCGGG
351 GACGGGTTAT ACTTTGTCGG TATGGATGAA CAGCGTGGGC GACGGATACA
401 AATGCCGTGA TGCCGCTTCT GCCCAAGCCC ATTTGGAGAC CTTGTCCTCA
451 GATGTCGGCT GTGAAGCCTT CTCTAATCGT AAAAAATAA
```

This corresponds to the amino acid sequence (SEQ ID NO: 338; ORF89):

```
  1 MMSNXMXQKG FTLIXXMIVV AILCIISVIA IPSYXSYIEK GYQSQLYTEM
 51 XGINNISKQF ILKNPLDDNQ TIENKLEIFV SGYKMNPKIA KKYSVSVKFV
101 DKEKSRAYRL VGVPKAGTGY TLSVWMNSVG DGYKCRDAAS AQAHLETLSS
151 DVGCEAFSNR KK*
```

Further work revealed the complete nucleotide sequence (SEQ ID NO: 339):

```
  1 ATGATGAGTA ATAAAATGGA ACAAAAAGGG TTTACATTGA TTGAGATGAT
 51 GATAGTCGTC GCGATACTCG GCATTATCAG CGTCATTGCC ATACCTTCTT
101 ATCAAAGTTA TATTGAAAAA GGCTATCAGT CCCAGCTTTA TACGGAGATG
151 GTCGGTATCA ACAATATTTC CAAACAGTTT ATTTTGAAAA ATCCCCTGGA
201 CGATAATCAG ACCATCGAGA ACAAACTGGA AATATTTGTC TCAGGCTATA
251 AGATGAATCC GAAAATTGCC AAAAAATATA GTGTTTCGGT AAAGTTTGTC
301 GATAAGGAAA AATCAAGGGC ATACAGGTTG GTCGGCGTTC CGAAGGCGGG
351 GACGGGTTAT ACTTTGTCGG TATGGATGAA CAGCGTGGGC GACGGATACA
401 AATGCCGTGA TGCCGCTTCT GCCCAAGCCC ATTTGGAGAC CTTGTCCTCA
451 GATGTCGGCT GTGAAGCCTT CTCTAATCGT AAAAAATAA
```

This corresponds to the amino acid sequence (SEQ ID NO: 340; ORF89-1):

```
  1 MMSNKMEQKG FTLIEMMIVV AILGIISVIA IPSYQSYIEK GYQSQLYTEM
 51 VGINNISKQF ILKNPLDDNQ TIENKLEIFV SGYKMNPKIA KKYSVSVKFV
101 DKEKSRAYRL VGVPKAGTGY TLSVWMNSVG DGYKCRDAAS AQAHLETLSS
151 DVGCEAFSNR KK*
```

Computer analysis of this amino acid sequence gave the following results:
Homology with PilE of *N. gonorrhoeae* (Accession Number Z69260) (SEQ ID NO: 1135).
ORF89 (SEQ ID NO: 338) and PilE protein (SEQ ID NO: 1135) show 30% aa identity in 120a overlap:

```
orf89    8 QKGFTLIXXMIVVAILGIISVIAIPSYXSYIEKGYQSQLYTEMXGINNISKQFILKNPL-   66
           QKGFTLI  MIV+AI+GI++ +A+P+Y  Y  +  S+      G  +    ++ L + +
PilE     5 QKGFTLIELMIVIAIVGILAAVALPAYQDYTARAQVSEAILLAEGQKSAVTEYYLNHGIW   64 orf89   67 -DDNQTIENKLEIFVSGYKMNPKIAKKYSVSVKFVDKEKSRAYRLVGVPKAGTGYTLSVW  125
            DN +           +G   + KI KY SV            GV K   G  LS+W
PilE    65 PKDNTS---------AGVASSDKIKGKYVQSVTVAKGVVTAEMASTGVNKEIQGKKLSLW  115
```

Homology with a Predicted ORF from *N.meningitidis* (Strain A)[15]

ORF89 (SEQ ID NO: 338) shows 83.3% identity over a 162aa overlap with an ORF (ORF89a) (SEQ ID NO: 342) from strain A of *N. meningitidis*:

```
                    10        20        30        40        50        60
orf89.pep MMSNXMXQKGFTLIXXMIVVAILGIISVIAIPSYXSYIEKGYQSQLYTEMXGINNISKQF
          ||||  |  |||||||||     ||    |||       ||||||||||||||||  ||||||||
orf89a    MMSNKMEQKGFTLIXXXXXXATXXXXSVIXXXXYXSYIEKGYQSQLYTEMVGINNISKQX
                    10        20        30        40        50        60

70        80        90       100       110       120
orf89.pep ILKNPLDDNQTTENKLEIFVSGYKMNPKTAKKYSVSVKFVDKEKSRAYRLVGVPKAGTGY
          |||||||||||::||||||||||||||||:|:|||:|::|| ||| ||||||:||||
orf89a    ILKNPLDDNQTIKSKLEIFVSGYKMNPKTAEKYNVSVHFVNEEKPRAYSLVGVPKTGTGY
                    70        80        90       100       110       120

130       140       150       160
orf89pep  TLSVWMNSVGDGYKCRDAASAQAHLETLSSDVGCEAFSNRKXX
          ||||||||||||||||||||||:|||||||||||||||||||||||
orf89a    TLSVWMNSVGDGYKCRDAASARAHLETLSSDVGCEAFSNRKKX
                   130       140       150       160
```

The complete length ORF89a nucleotide sequence (SEQ ID NO: 341) is:

```
  1 ATGATGAGTA ATAAAATGGA ACAAAAAGGG TTTACATTGA TTGNGANGNT

51 NATNGNCNTC GCGATACNCN GCNTTANCAG CGTCATTNCN ATNNNTNCNT

101 ATCNNAGTTA TATTGAAAAA GGCTATCAGT CCCAGCTTTA TACGGAGATG

151 GTCGGTATCA ACAATATTTC CAAACAGTNT ATTTTGAAAA ATCCCCTGGA

201 CGATAATCAG ACCATCAAGA GCAAACTGGA AATATTTGTC TCAGGCTATA

251 AGATGAATCC GAAAATTGCC GAAAAATATA ATGTTTCGGT GCATTTTGTC

301 AATGAGGAAA AACCNAGGGC ATACAGCTTG GTCGGCGTTC CAAAGACGGG

351 GACGGGTTAT ACTTTGTCGG TATGGATGAA CAGCGTGGGC GACGGATACA

401 AATGCCGTGA TGCCGCTTCT GCCCGAGCCC ATTTGGAGAC CTTGTCCTCA

451 GATGTCGGCT GTGAAGCCTT CTCTAATCGT AAAAAATAG
```

This encodes a protein having amino acid sequence (SEQ ID NO: 342):

```
  1 MMSNKMEQKG FTLIXXXXXX AIXXXXSVIX XXXYXSYIEK GYQSQLYTEM

51 VGINNISKQX ILKNPLDDNQ TIKSKLEIFV SGYKMNPKIA EKYNVSVHFV

101 NEEKPRAYSL VGVPKTGTGY TLSVWMNSVG DGYKCRDAAS ARAHLETLSS

151 DVGCEAFSNR KK*
```

ORF89a (SEQ ID NO: 342) and ORF89-1 (SEQ ID NO: 340) show 83.3% identity in 162 aa overlap:

```
                   10        20        30        40        50        60
orf89a.pep  MMSNKMEQKGFTLIXXXXXXAIXXXXSVIXXXXYXSYIEKGYQSQLYTEMVGINNISKQX
            ||||||||||||||    ||    |||    |  ||||||||||||||||||||||||||
orf89-1     MMSNKMEQKGFTLIEMMIVVAILGIISVIAIPSYQSYIEKGYQSQLYTEMVGINNISKQF
                   10        20        30        40        50        60

70        80        90       100       110       120
orf89a.pep  ILKNPLDDNQTIKSKLEIFVSGYKMNPKIAEKYNVSVHFVNEEKPRAYSLVGVPKTGTGY
            |||||||||||::|||||||||||||||||:|:||:||::|| ||| ||||||:||||
orf89-1     ILKNPLDDNQTIENKLEIFVSGYKMNPKIAKKYSVSVKFVDKEKSRAYRLVGVPKAGTGY
                   70        80        90       100       110       120

130       140       150       160
orf89a.pep  TLSVWMNSVGDGYKCRDAASARAHLETLSSDVGCEAFSNRKKX
            |||||||||||||||||||||:||||||||||||||||||||
orf89-1     TLSVWMNSVGDGYKCRDAASAQAHLETLSSDVGCEAFSNRKKX
                  130       140       150       160
```

Homology with a Predicted ORF from *N.gonorrhoeae*
ORF89 (SEQ ID NO: 338) shows 84.6% identity over a 162aa overlap with a predicted ORF (ORF89.ng (SEQ ID NO: 344) from *N. gonorrhoeae*:

```
orf89    MMSNXMXQKGFTLIXXMIVVAILGIISVIAIPSYXSYIEKGYQSQLYTEMXGINNISKQF    60
         |||| | |||||||| ||||:||||||||||||||| |||||||||||||||  ||||: |||
orf89ng  MMSNKMEQKGFTLIEMMIVVTILGIISVIAIPSYVSYIEKGYQSQLYTEMVGINNVLKQF    60 orf89    ILKNPLDDNQTIENKLEIFVSGYKMNPKIAKKYSVSVKFVDKEKSRAYRLVGVPKAGTGY   120
         ||||| |||:::::|:||||||||||||||||||||||:||| || |||||||||:|||||
orf89ng  ILKNPQDDNDTLKSKLKIFVSGYKMNPKIAKKYSVSVRFVDAEKPRAYRLVGVPNAGTGY   120 orf89    TLSVWMNSVGDGYKCRDAASAQAHLETLSSDVGCEAFSNRKK                     162
         |||||||||||||||||||:||||: :|||:| ||||||||||
orf89ng  TLSVWMNSVGDGYKCRDATSAQAYSDTLSADSGCEAFSNRKK                    162
```

The complete length ORF89ng nucleotide sequence (SEQ ID NO: 343) is:

```
  1  aTGATGAGCA ATAAAATGGA ACAAAAAGGG TTTACATTGA TTGAGATGAT
 51  GATAGTTGTC ACGATACTCG GCATCATCAG CGTCATTGCC ATACCTTCTT
101  ATCAGAGTTA TATTGAAAAA GGCTATCAGT CCCAGCTTTA TACGGAGATG
151  GTCGGTATCA ACAATGTTCT CAAACAGTTT ATTTTGAAAA ATCCCCAGGA
201  CGATAATGAT ACCCTCAAGA GCAAACTGAA AATATTTGTC TCAGGCTATA
251  AGATGAATCC GAAAAttgCC AAAAAATATA GTGTTTCGGt aaggtttGTC
301  gatGCGGAAA AACCAAGGGC ATACAGGTTG GTCGGCGTTC CGAACGCGGG
351  GACGGGTTAT ACTTTGTCGG TATGGATGAA CAGCGTGGGC GACGGATACA
401  AATGCCGTGA TGCCACTTCT GCCCAGGCCT ATTCGGACAC CTTGTCCGCA
451  GATAGCGGCT GTGAAGCTTT CTCTAATCGT AAAAAATAG
```

The encodes a protein having amino acid sequence (SEQ ID NO: 344):

```
  1  MMSNKMEQKG FTLIEMMIVV TILGIISVIA IPSYQSYIEK GYQSQLYTEM
 51  VGINNVLKQF ILKNPQDDND TLKSKLKIFV SGYKMNPKIA KKYSVSVRFV
101  DAEKPRAYPL VGVPNAGTGY TLSVWMNSVG DGYKCRDATS AQAYSDTLSA
151  DSGCEAFSNR KK*
```

This gonococcal protein has a putative leader peptide (underlined) and N-terminal methylation site (NMePhe or type-4 pili, double-underlined). In addition, ORF89ng (SEQ ID NO: 344) and ORF89-1 (SEQ ID NO: 340) show 88.3% identity in 162 aa overlap:

```
                    10        20        30        40        50        60
orf89-1.pep MMSNKMEQKGFTLIEMMIVVAILGIISVIAIPSYQSYIEKGYQSQLYTEMVGINNISKQF
            |||||||||||||||||||:||||||||||||||||||||||||||||||||||:|||
orf89ng     MMSNKMEQKGFTLIEMMIVVTILGIISVIAIPSYQSYIEKGYQSQLYTEMVGINNVLKQF
                    10        20        30        40        50        60

70        80        90       100       110       120
orf89-1.pep ILKNPLDDNQTIENKLEIFVSGYKMNPKIAKKYSVSVKFVDKEKSRAYRLVGVPKAGTGY
            ||||| |||:|:::||:||||||||||||||||||||:||| || ||||||||:|||||
orf89ng     ILKNPQDDNDTLKSKLKIFVSGYKMNPKIAKKYSVSVRFVDAEKPRAYRLVGVPNAGTGY
                    70        80        90       100       110       120

130       140       150       160
orf89       TLSVWMNSVGDGYKCRDAASAQAHLETLSSDVGCEAFSNRKKX
            ||||||||||||||||||:||||: :|||:| |||||||||||
orf89ng     TLSVWMNSVGDGYKCRDATSAQAYSDTLSADSGCEAFSNRKKX
                    130       140       150       160
```

Based on this analysis, including the gonococcal motifs and the homology with the known PilE protein (SEQ ID NO: 1135), it was predicted that these proteins from *N.meningitidis* and *N.gonorrhoeae*, and their epitopes, could be useful antigens for vaccines or diagnostics, or for raising antibodies.

Figure 11:

ORF89-1 (SEQ ID NO: 340) (13.6 kDa) was cloned in the pGex vector and expressed in *E.coli*, as described above. The products of protein expression and purification were analyzed by SDS-PAGE. FIG. 11A shows the results of affinity purification of the GST-fusion protein. Purified GST-fusion protein was used to immunise mice, whose sera gave a positive result in the ELISA test., confirming that ORF89-1 (SEQ ID NO: 340) is a surface-exposed protein, and that it is a useful immunogen.

Example 41

The following partial DNA sequence was identified in *N.meningitidis* (SEQ ID NO: 345):

```
  1 ATGAAAAAAT CCTCCCTCAT CAGCGCATTG GGCATCGGTA TTTTGAGCAT
 51 CGGCATGGCA TTTGCCGCCC CTGCCGACGC GGTAAGCCAA ATCCGTCAAA
101 ACGCCACTCA AGTATTGAGC ATCTTAAAAA ACGGCGATGC CAACACCGCT
151 CGCCAAAAAG CCGAAGCCTA TGCGATTCCC TATTTCGATT TCCAACGTAT
201 GACCGCATTG CCGGTCGGCA ACCCTTGGsG CACCG.GTCC GACG.GCAAA
251 AACAAGCGTT GGCCn.AGAA TTTCAACCC...
    45
```

This corresponds to the amino acid sequence (SEQ ID NO: 346; ORF91):

```
  1 MKKSSLISAL GIGILSIGMA FAAPADAVSQ IRQNATQVLS ILKNGDANTA
 51 RQKAEAYAIP YFDFQRMTAL AVGNPWXTXS DXQKQALAXE FQP...
```

Further work revealed the complete nucleotide sequence (SEQ ID NO: 347):

```
  1 ATGAAAAAAT CCTCCCTCAT CAGCGCATTG GGCATCGGTA TTTTGAGCAT
 51 CGGCATGGCA TTTGCCGCCC CTGCCGACGC GGTAAGCCAA ATCCGTCAAA
101 ACGCCACTCA AGTATTGAGC ATCTTAAAAA ACGGCGATGC CAACACCGCT
151 CGCCAAAAAG CCGAAGCCTA TGCGATTCCC TATTTCGATT TCCAACGTAT
201 GACCGCATTG GCGGTCGGCA ACCCTTGGCG CACCGCGTCC GACGCGCAAA
```

```
251  AACAAGCGTT GGCCAAAGAA TTTCAAACCC TGCTGATCCG CACCTATTCC

301  GGCACGATGC TGAAATTAAA AAACGCCAAC GTCAACGTCA AAGACAATCC

351  CATCGTCAAT AAAGGCGGCA AAGAAATCAT CGTCCGCGCC GAAGTCGGCG

401  TACCCGGGCA AAAACCCGTC AACATGGACT TCACCACCTA CCAAAGCGGC

451  GGTAAATACC GTACCTACAA CGTCGCCATC GAAGGCGCGA GCCTGGTTAC

501  CGTGTACCGC AACCAATTCG GCGAAATTAT CAAAGCGAAA GGCGTGGACG

551  GACTGATTGC CGAGTTGAAA GCCAAAAACG GCGGCAAATA A
```

This corresponds to the amino acid sequence (SEQ ID NO: 348; ORF91-1):

```
  1  MKKSSLISAL GIGILSIGMA FAAPADAVSQ IRQNATQVLS ILKNGDANTA

51  RQKAEAYAIP YFDFQRMTAL AVGNPWRTAS DAQKQALAKE FQTLLIRTYS

101  GTMLKLKNAN VNVKDNPIVN KGGKEIIVRA EVGVPGQKPV NMDFTTYQSG

151  GKYRTYNVAI EGASLVTVYR NQFGEIIKAK GVDGLIAELK AKNGGK*
```

Computer analysis of this amino acid sequence gave the following results:
Homology with a Predicted ORF from *N.meningitidis* (Strain A)

ORF91 (SEQ ID NO: 346) shows 92.4% identity over a 92aa overlap with an ORF (ORF91a) (SEQ ID NO: 350) from strain A of *N. meningitidis*:

```
                       10         20         30         40         50         60
orf91.pep  MKKSSLISALGIGILSIGMAFAAPADAVSQIRQNATQVLSILKNGDANTARQKAEAYAIP
           |||||:||||||||||||||||||||||||:|||||||||||||:|||||||||||||||
orf91a     MKKSSFISALGIGILSIGMAFAAPADAVNQIRQNATQVLSILKSGDANTARQKAEAYAIP
                       10         20         30         40         50         60

70         80         90
orf91.pep  YFDFQRMTALAVGNPWXTXSDXQKQALAXEFQP
           ||||||||||||||||| || |||||| |||
orf91a     YFDFQRMTALAVGNPWRTASDAQKQALAKEFQTLLIRTYSGTMLKLKNANVNVKDNPIVN
                       70         80         90        100        110        120 orf91a     KGGKEIIVRAEVGVPGQKPVNMDFTTYQSGGKYRTYNVAIEGASLVTVYRNQFGEIIKAK
                      130        140        150        160        170        180
```

The complete length ORF91a nucleotide sequence (SEQ ID NO: 349) is:

```
  1  ATGAAAAAAT CCTCCTTCAT CAGCGCATTG GGCATCGCTA TTTTGAGCAT

51  CGGCATGGCA TTTGCCGCCC CTGCCGACGC GGTAAACCAA ATCCGTCAAA

101  ACGCCACTCA AGTATTGAGC ATCTTAAAAA GCGGTGATGC CAACACCGCC

151  CGCCAAAAAG CCGAAGCCTA TGCGATTCCC TATTTCGATT CCAACGTAT

201  GACCGCATTG GCGGTCGGCA ACCCTTGGCG CACCGCGTCC GACGCGCAAA

251  AACAAGCGTT GGCCAAAGAA TTTCAAACCC TGCTGATCCG CACCTATTCC

301  GGCACGATGC TGAAATTAAA AAACGCCAAC GTCAACGTCA AAGACAATCC

351  CATCGTCAAT AAAGGCGGCA AAGAAATCAT CGTCCGCGCC GAAGTCGGCG

401  TACCCGGGCA AAAACCCGTC AACATGGACT TCACCACCTA CCAAAGCGGC

451  GGTAAATACC GTACCTACAA CGTCGCCATC GAAGGCGCGA GCCTGGTTAC

501  CGTGTACCGC AACCAATTCG GCGAAATTAT CAAAGCGAAA GGCGTGGACG

551  GACTGATTGC CGAGTTGAAG GCTAAAAACG GCAGCAAGTA A
```

This encodes a protein having amino acid sequence (SEQ ID NO: 350):

```
  1 MKKSSFISAL GIGILSIGMA FAAPADAVNQ IRQNATQVLS ILKSGDANTA

51 RQKAEAYAIP YFDFQRMTAL AVGNPWRTAS DAQKQALAKE FQTLLIRTYS

101 GTMLKLKNAN VNVKDNPIVN KGGKEIIVRA EVGVPGQKPV NMDFTTYQSG

151 GKYRTYNVAI EGASLVTVYR NQFGEIIKAK GVDGLIAELK AKNGSK*
```

ORF91a (SEQ ID NO: 350) and ORF91-1 (SEQ ID NO: 348) show 98.0% identity in 196 aa overlap:

```
                   10         20         30         40         50         60
orf91a.pep  MKKSSFISALGIGILSIGMAFAAPADAVNQIRQNATQVLSILKSGDANTARQKAEAYAIP
            |||||:||||||||||||||||||||||||:|||||||||:||||||||||||||||||
orf91-1     MKKSSLISALGIGILSIGMAFAAPADAVSQIRQNATQVLSILKNGDANTARQKAEAYAIP
                   10         20         30         40         50         60

70         80         90        100        110        120
orf91a.pep  YFDPQRMTALAVGNPWRTASDAQKQALAKEFQTLLIRTYSGTMLKLKNANVNVKDNPIVN
            |||||||||||||||||||||||||||||||||||||||||||||||||||||||||||
orf91-1     YFDFQRMTALAVGNPWRTASDAQKQALAKEFQTLLIRTYSGTMLKLKNANVNVKDNPIVN
                   70         80         90        100        110        120

130        140        150        160        170        180
orf91a.pep  KGGKEIIVRAEVGVPGQKPVNMDFTTYQSGGKYRTYNVAIEGASLVTVYRNQFGEIIKAK
            ||||||||||||||||||||||||||||||||||||||||||||||||||||||||||||
orf91-1     KGGKEIIVRAEVGVPGQKPVNMDFTTYQSGGKYRTYNVAIEGASLVTVYRNQFGEIIKAK
                  130        140        150        160        170        180

190
orf9a.pep   GVDGLIAELKAKNGSKX
            |||||||||||||:||
orf91-1     GVDGLIAELKAKNGGKX
                  190
```

Homology with a Predicted ORF from *N.gonorrhoeae*

ORF91 (SEQ ID NO: 346) shows 84.8% identity over a 92aa overlap with a predicted ORF (ORF91.ng) (SEQ ID NO: 352) from *N. gonorrhoeae*:

```
orf91.pep  MKKSSLISALGIGILSIGMAFAAPADAVSQIRQNATQVLSILKNGDANTARQKAEAYAIP   60
           :||||:|||||||||||||||||:|||||:|||||||||:|||:||| :|| ||||||:|
orf91ng    VKKSSFISALGIGILSIGMAFASPADAVGQIRQNATQVLTILKSGDAASARPKAEAYAVP   60 orf91.pep  YFDFQRMTALAVGNPWXTXSDXQKQALAXEFQP                              93
           ||||||||||||||||| || |||||| |||
orf91ng    YFDFQRMTALAVGNPWRTASDAQKQALAKEPQTLLIRTYSGTMLKFKNATVNVKDNPIVN  120
```

The complete length ORF91ng nucleotide sequence (SEQ ID NO: 351) is predicted to encode a protein having amino acid sequence (SEQ ID NO: 352):

```
  1   VKKSSFISAL GIGILSIGMA FASPADAVGQ IRQNATQVLT ILKSGDAASA

51   RPKAEAYAVP YFDFQRMTAL AVGNPWRTAS DAQKQALAKE FQTLLIRTYS

101   GTMLKFKNAT VNVKDNPIVN KGGKEIVVRA EVGIPGQKPV NMDFTTYQSG

151   GKYRTYNVAI EGTSLVTVYR NQFGEIIKAK GIDGLIAELK AKNGGK*
```

Further work revealed the complete nucleotide sequence (SEQ ID NO: 353):

```
  1    ATGAAAAAAT CCTCCTTCAT CAGCGCATTG GGCATCGGTA TTTTGAGCAT
 51    CGGCATGGCA TTTGCCTCCC CGGCCGACGC AGTGGGACAA ATCCGCCAAA
101    ACGCCACACA GGTTTTGACC ATCCTCAAAA GCGGCGACGC GGCTTCTGCA
151    CGCCCAAAAG CCGAAGCCTA TGCGGTTCCC TATTTCGATT TCCAACGTAT
201    GACCGCATTG GCGGTCGGCA ACCCTTGGCG TACCGCGTCC GACGCGCAAA
251    AACAAGCGTT GGCCAAAGAA TTTCAAACCC TGCTGATCCG CACCTATTCC
301    GGCACGATGC TGAAATTCAA AAACGCGACC GTCAACGTCA AAGACAATCC
351    CATCGTCAAT AAGGGCGGCA AGGAAATCGT CGTCCGTGCC GAAGTCGGCA
401    TCCCCGGTCA GAAGCCCGTC AATATGGACT TTACCACCTA CCAAAGCGGC
451    GGCAAATACC GTACCTACAA CGTCGCCATC GAAGGCACGA GCCTGGTTAC
501    CGTGTACCGC AACCAATTCG GCGAAATCAT CAAAGCCAAA GGCATCGACG
551    GGCTGATTGC CGAGTTGAAA GCCAAAAACG GCGGCAAATA A
```

This corresponds to the amino acid sequence (SEQ ID NO: 354; ORF91ng-1):

```
  1    MKKSSFISAL GIGILSIGMA FASPADAVGQ IRQNATQVLT ILKSGDAASA
 51    RPKAEAYAVP YFDFQRMTAL AVGNPWRTAS DAQKQALAKE FQTLLIRTYS
101    GTMLKFKNAT VNVKDNPIVN KGGKEIVVRA EVGIPGQKPV NMDFTTYQSG
151    GKYRTYNVAI EGTSLVTVYR NQFGEIIKAK GIDGLIAELK AKNGGK*
```

ORF91NG-1 (SEQ ID NO: 354) and ORF91-1 (SEQ ID NO: 348) show 92.3% identity in 196 aa overlap:

```
                  10         20         30         40         50         60
orf91-1.pep  MKKSSLISALGIGILSIGMAFAAPADAVSQIRQNATQVLSILKNGDANTARQKAEAYAIP
             |||||:||||||||||||||:|||||:||||||||||||:|||:||| :|| ||||||:|
orf91ng-1    MKKSSFISALGIGILSIGMAFASFADAVGQIRQNATQVLTILKSGDAASARPKAEAYAVP
                  10         20         30         40         50         60

70         80         90        100        110        120
orf91-1.pep  YFDFQRMTALAVGNPWRTASDAQKQALAKEFQTLLIRTYSGTMLKLKNATNVNVKDNPIVN
             ||||||||||||||||||||||||||||||||||||||||:|||:||||||||||||||
orf91ng-1    YFDFQRMTALAVGNPWRTASDAQKQALAKEFQTLLIRTYSGILKFKNATVNVKDNPIVN
                  70         80         90        100        110        120

130        140        150        160        170        180
orf91-1.pep  KGGKEIIVAAEVGVPGQKPVNMDFTTYQSGGKYRTYNVAIEGASLVTVYRNQFGEIIKAK
             ||||||:||||:|||||||||||||||||||||||||||||||:|||||||||||||||||
orf91ng-1    KGGKEIVVRAEVGIPGQKPVNMDFTTYOSGGKYRTYNVAIEGTSLVTVYRNQFGEIIKAK
                 130        140        150        160        170        180

190
orf91-1.pep  GVDGLIAELKAKNGGKX
             |:|||||||||||||||
orf91ng-1    GIDGLIAELKAKNGGKX
                 190
```

In addition, ORF91ng-1 (SEQ ID NO: 354) shows homology to a hypothetical *E.coli* protein (SEQ ID NO: 1136):

```
sp|P45390|YRBC_ECOLI HYPOTHETICAL 24.0 KD PROTEIN IN MURA-RPON INTERGENIC REGION
PRECURSOR (F211) )gi|606130 (U18997) ORF_f211 [Escherichia coli] )gi|1789583
(AE000399) hypothetical 24.0 kD protein in murZ-rpoN intergenic region [Escherichia
coli] Length = 211

Score = 70.6 bits (170), Expect = 6e-12
     Identities = 42/137 (30%), Positives = 76/137 (54%), Gaps = 6/137 (4%)

Query:  59   VPYFDFQRMTALAVGNPWRTASDAQKQALAKEFQTLLIRTYSGILKFKNATVVVKDNPI    118
             +PY + AL +G +++A+ AQ++A F+ L + Y + + T + P
Sbjct:  65   LPYVQVKYAGALVLGQYYKSATPAQREAYFAAFREYLKQAYGQALAIYHGQTYQIA--PE  122

Query: 119   VNKGGKEIV-VRAEVGIP-GQKPVNMDFTTYQSG--GKYRTYNVAIEGTSLVTVYRNQFG  174
              G K IV +R + P G+ PV +DF ++ G ++ Y++ EG S++T +N++G
Sbjct: 123   QPLGDKTIVPIRVTIIDPNGRPPVRLDFQWRKNSQTGIQAYDMIAEGVSIITTKQIEIG   182

Query: 175   EIIKAKGIDGLIAELKA                                            191
             +++ KGIDGL A+LK+
Sbjct: 183   TLLRTKGIDGLTAQLKS                                            199
```

Based on this analysis, including the presence of a putative leader sequence in the gonococcal protein, it is predicted that the proteins from *N.meningitidis* and *N.gonorrhoeae*, and their epitopes, could be useful antigens for vaccines or diagnostics, or for raising antibodies.

Example 42

The following DNA sequence was identified in *N.meningitidis* (SEQ ID NO: 355):

```
  1   ATGAAACACA TACTCCCCCT GATTGCCGCA TCCGCACTCT GCATTTCAAC
 51   CGCTTCGGCA CATCCTGCCA GCGAACCGTC CACTCAAAAC GAAACCGCTA
101   TGATCACGCA TACCCTCATC TCAAAATACA GTTTTGGnnn nnnnnnnnnn
151   nnnnnnnnnn nnGCCATAAA AAGCAAAGGG ATGGACATTT TTGCCGTCAT
201   CGACCATCAG GAAGCCGCAC GCCGAAACGG CTTAACGATG CAGCCGGCAA
251   AAGTCATCGT CTTCGGCACG CCCAAAGCCG GCACGCCGCT GATGGTCAAA
301   GACCCCGCCT TCGCCCTGCA ACTGCCCCTA CGCGTCCTCG TTACCGAAAC
351   GGACGGCAAA GTACGCGCCG CCTATACCGA TACGCGCGCC CTCATCGCCG
401   GCAGCCGCAT CGGTTTCGAC GAAGTGGCAA ACACTTTGGC AAACGCCGAA
451   AAACTGATAC AAAAACCGT AGGCGAATAA
 45
```

This corresponds to the amino acid sequence (SEQ ID NO: 356; ORF97):

```
  1   MKHILPLIAA SALCISTASA HPASEPSTQN ETAMITHTLI SKYSFGXXXX
 51   XXXXAIKSKG MDIFAVIDHQ EAARRNGLTM QPAKVIVFGT PKAGTPLMVK
101   DPAFALQLPL RVLVTETDGK VRAAYTDTRA LIAGSRIGFD EVANTLANAE
151   KLIQKTVGE*
```

Further work revealed the complete nucleotide sequence (SEQ ID NO: 357):

```
  1   ATGAAACACA TACTCCCCCT GATTGCCGCA TCCGCACTCT GCATTTCAAC
 51   CGCTTCGGCA CATCCTGCCA GCGAACCGTC CACCCAAAAC GAAACCGCTA
101   TGACCACGCA TACCCTCACC TCAAAATACA GTTTTGACGA AACCGTCAGC
```

-continued

```
151    CGCCTTGAAA CCGCCATAAA AAGCAAAGGG ATGGACATTT TTGCCGTCAT

201    CGACCATCAG GAAGCCGCCC GCCGAAACGG CTTAACGATG CAGCCGGCAA

251    AAGTCATCGT CTTCGGCACG CCCAAAGCCG GCACGCCGCT GATGGTCAAA

301    GACCCCGCCT TCGCCCTGCA ACTGCCCCTA CGCGTCCTCG TTACCGAAAC

351    GGACGGCAAA GTACGCGCCG CCTATACCGA TACGCGCGCC CTCATCGCCG

401    GCAGCCGCAT CGGTTTCGAC GAAGTGGCAA ACACTTTGGC AAACGCCGAA

451    AAACTGATAC AAAAAACCGT AGGCGAATAA
```

This corresponds to the amino acid sequence (SEQ ID NO: 358; ORF97-1):

```
  1    MKHILPLIAA SALCISTASA HPASEPSTQN ETAMTTHTLT SKYSFDETVS

51    RLETAIKSKG MDIFAVIDHQ EAARRNGLTM QPAKVIVFGT PKAGTPLMVK

101    DPAFALQLPL EVLVTETDGK VRAAYTDTRA LIAGSRIGFD EVANTLANAE

151    KLIQKTVGE*
```

Computer analysis of this amino acid sequence gave the following results:
Homology with a Predicted ORF from *N.meningitidis* (Strain A)

ORF97 (SEQ ID NO: 356) shows 88.7% identity over a 159aa overlap with an ORF (ORF97a) (SEQ ID NO: 360) from strain A of *N. meningitidis*:

```
                    10        20        30        40        50        60
orf97.pep  MKHILPLIAASALCISTASAHPASEPSTQNETAMITHTLISKYSFGXXXXXXXXXAIKSKG
           ||||||  ||||||||||  ||||||:||||||  ||||  ||||  :  :||||||
orf97a     MXHILPLXXASALCISTASXHPASEPQTQNETAMTTHTLTSKYSFDETVSRLETAIKSKG
                    10        20        30        40        50        60

70        80        90       100       110       120
orf97.pep  MDIFAVIDHQEAARRNGLTMQPAKVIVFGTPKAGTPLMVKDPAFALQLPLRVLVTETDGK
           ||||||||||||||||||||||||||||||||||||||||||||||||||||  ||||||
orf97a     MDIFAVIDHQEAARRNGLTMQPAKVIVFGTPKAGTPLMVKDPAFALQLPLRVXVTETDGK
                    70        80        90       100       110       120

130       140       150       160
orf97.pep  VRAAYTDTRALIAGSRIGFDEVANTLANAEKLIQKTVGEX
           ||||||||||||||||||||||||||||||||||⊕:|||
orf97a     VRAAYTDTRALIAGSRIGFDEVANTLANAEKLIQKTIGEX
                   130       140       150       160
```

The complete length ORF97a nucleotide sequence (SEQ ID NO: 359) is:

```
  1    ATGANACACA TACTCCCCCT GANTGNCGCA TCCGCACTCT GCATTTCAAC

51    CGCTTCGGNN CATCCTGCCA GCGAACCGCA AACCCAAAAC GAAACCGCTA

101    TGACCACGCA TACCCTCACC TCAAAATACA GTTTTGACGA AACCGTCAGC

151    CGCCTTGAAA CCGCCATAAA AAGCAAAGGG ATGGACATTT TTGCCGTCAT

201    CGACCATCAG GAAGCCGCCC GCCGAAACGG CTTAACGATG CAGCCGGCAA

251    AAGTCATCGT CTTCGGCACG CCCAAAGCCG GTACGCCGCT GATGGTCAAA

301    GACCCCGCCT TCGCCCTGCA ACTGCCCCTG CGCGTCNTCG TTACCGAAAC

351    GGACGGCAAA GTACGCGCCG CCTATACCGA TACGCGCGCC CTCATCGCCG

401    GCAGCCGCAT CGGTTTCGAC GAAGTGGCAA ACACTTTGGC AAACGCCGAA

451    AAACTGATAC AAAAACCAT AGGCGAATAA
```

This encodes a protein having amino acid sequence (SEQ ID NO: 360):

```
  1   MXHILPLXXA SALCISTASX HPASEPQTQN ETAMTTHTLT SKYSFDETVS
 51   RLETAIKSKG MDIFAVIDHQ EAARRNGLTM QPAKVIVFGT PKAGTPLMVK
101   DPAFALQLPL RVXVTETDGK VRAAYTKTRA LIAGSRIGFD EVANTLANAE
151   KLIQKTIGE*
```

ORF97a (SEQ ID NO: 360) and ORF97-1 (SEQ ID NO: 358) show 95.6% identity in 159 aa overlap:

```
                  10        20        30        40        50        60
orf97a.pep  MXHILPLXXASALCISTASXHPASEPQTQNETAMTTHTLTSKYSFDETVSRLETAIKSKG
            | |||||  |||||||||| ||||||:|||||||||||||||||||||||||||||||||
orf97-1     MKHILPLIAASALCISTASAHPASEPSTQNETAMTTHTLTSKYSFDETVSKLETAIKSKG
                  10        20        30        40        50        60

70        80        90       100       110       120
orf97a.pep  MDIFAVIDHQEAARRNGLTMQPAKVIVFGTPKAGTPLMVKDPAFALQLPLRVXVTETDGK
            ||||||||||||||||||||||||||||||||||||||||||||||||||||| ||||||
orf97-1     MDIFAVIDHQEAARRNGLTMQPAKVIVFGTPKAGTPLMVKDPAFALQLPLRVLVTETDGK
                  70        80        90       100       110       120

130       140       150       160
orf97a.pep  VRAAYTDTRALIAGSRIGFDEVANTLANAEKLIQKTIGEX
            |||||||||||||||||||||||||||||||||||:|||
orf97-1     VRAAYTDTRALIAGSRIGFDEVANTLANAEKLIQKTVGEX
                 130       140       150       160
```

Homology with a Predicted ORF from *N.gonorrhoeae*

ORF97 (SEQ ID NO: 356) shows 88.1% identity over a 159aa overlap with a predicted ORF (ORF97.ng) SEQ ID NO: 362) from *N. gonorrhoeae*:

```
orf97.pep  MKHILPLIAASALCISTASAHPASEPSTQNETAMITHTLISKYSFGXXXXXXXXXAIKSKG   60
           ||||||  |||||:|||||||||||::| ||||||| |||||||||| :      :||||||
orf97ng    MKHILPPIAASAFCISTASAHPAGKPPTQNETAMTTHTLTSKYSFDETVSRLETAIKSKG   60 orf97.pep  MDIFAVIDHQEAARRNGLTMQPAKVIVFGTPKAGTPLMVKDPAFALQLPLRVLVTETDGK  120
           ||||||||||||||||||||||||||||||||||||||||||||||||||||||||||||
orf97ng    MDIFAVIDHQEAARRNGLTMQPAKVIVFGTPKAGTPLMVKDPAFALQLPLRVLVTETDGK  120 orf97.pep  VRAAYTDTRALIAGSRIGFDEVANTLANAEKLIQKTVGE                       159
           ||:|||||||||:||||:|||||||||||||||||||||
orf97ng    VRTAYTDTRALIVGSRISFDEVANTLANAEKLIQKTVGE                       159
```

The complete length ORF97ng nucleotide sequence (SEQ ID NO: 361) is predicted to encode a protein having amino acid sequence (SEQ ID NO: 362):

```
  1   MKHILPPIAA SAFCISTASA HPAGKPPTQN ETAMTTHTLT SKYSFDETVS
 51   RLETAIKSKG MDIFAVIDHQ EAARRNGLTM QPAKVIVFGT PKAGTPLMVK
101   DPAFALQLPL RVLVTETDGK VRTAYTDTRA LIVGSRISFD EVANTLANAE
151   KLIQKTVGE*
```

Further work reveal the complete nucleotide sequence (SEQ ID NO: 363):

```
  1   ATGAAACACA TACTCCCcct gatcgccgca TccgcactCT GCATTTCAAC
 51   CGCTTCGGCA CACCCTGCCG GCAAACCGCC CACCCAAAAC GAAACCGCTA
101   TGACCACGCA CACCCTCACC TCGAAATACA GTTTTGACGA AACCGTCAGC
```

```
-continued
151  CGCCTTGAAA CCGCCATAAA AAGCAAAGGG ATGGACATTT TTGCCGTCAT

201  CGACCATCAG GAAGCGGCAC GCCGAAACGG CCTGACCATG CAGCCGGCAA

251  AAGTCATCGT CTTCGGCACG CCCAAGGCCG GTACGCCgct GATGGTCAAA

301  GACCCCGCCT TCGCCCTGCA ACTGCCCCTG CGCGTCCTCG TTACCGAAAC

351  GGACGGCAAA GTACGCACCG CCTATACCGA TACGCGCGCC CTCATCGTCG

401  GCAGCCGCAT CAGTTTCGAC GAAGTGGCAA ACACTTTGGC AAACGCCGAA

451  AAACTGATAC AAAAAACCGT AGGCGAATAA
```

This corresponds to the amino acid sequence (SEQ ID NO: 364; ORF97ng-1):

```
  1  MKHILPLIAA SALCISTASA HPAGKPPTQN ETAMTTHTLT SKYSFDETVS

51  RLETAIKSKG MDIFAVIDHQ EAARRNGLTM QPAKVIVFGT PKAGTPLMVK

101  DPAFALQLPL RVLVTETDGK VRTAYTDTRA LIVGSRISFD EVANTLANAE

151  KLIQKTVGE*
```

ORF97ng-1 (SEQ ID NO: 364) and ORF97-1 (SEQ ID NO: 358) show 96.2% identity in 159 aa overlap:

```
                 10         20         30         40         50         60
orf97-1.pep  MKHILPLIAASALCISTASAHPASEPSTQNETAMTTHTLTSKYSFDETVSRLETAIKSKG
             ||||||||||||||||||||||||::|||||||||||||||||||||||||||||||||
orf97ng-1    MKHILPLIAASALCISTASAHPAGKPPTQNETAMTTHTLTSKYSFDETVSRLETAIKSKG
                 10         20         30         40         50         60

70         80         90        100        110        120
orf97-1.pep  MDIFAVIDHQEAARRNGLTMQPAKVIVFGTPKAGTPLMVKDPAFALQLPLRVLVTETDGK
             ||||||||||||||||||||||||||||||||||||||||||||||||||||||||||||
orf97ng-1    MDIFAVIDHQEAARRNGLTMQPAKVIVFGTPKAGTPLMVKDPAFALQLPLRVLVTETDGK
                 70         80         90        100        110        120

130        140        150        160
orf97-1.pep  VRAAYTDTRALIAGSRIGFDEVANTLANAEKLIQKTVGEX
             ||:|||||||||:||||:||||||||||||||||||||||
orf97ng-1    VRTAYTDTRALIVGSRISFDEVANTLANAEKLIQKTVGEX
                130        140        150        160
```

Based on this analysis, including the presence of a putative leader sequence in the gonococcal protein, it was predicted that the proteins from N.meningitidis and N.gonorrhoeae, and their epitopes, could be useful antigens for vaccines or diagnostics, or for raising antibodies.

ORF97-1 (SEQ ID NO: 358) (15.3 kDa) was cloned in pET and pGex vectors and expressed in E.coli, as described above. The products of protein expression and purification were analyzed by SDS-PAGE. FIGS. 12A & 12B show, respectively, the results of affinity purification of the GST-fusion and His-fusion proteins. Purified GST-fusion protein was used to immunise mice, whose sera were used for Western Blot (FIG. 12C), ELISA (positive result), and FACS analysis (FIG. 12D). These experiments confirm that ORF97-1 (SEQ ID NO: 358) is a surface-exposed protein, and that it is a useful immunogen.

Figure 12E:
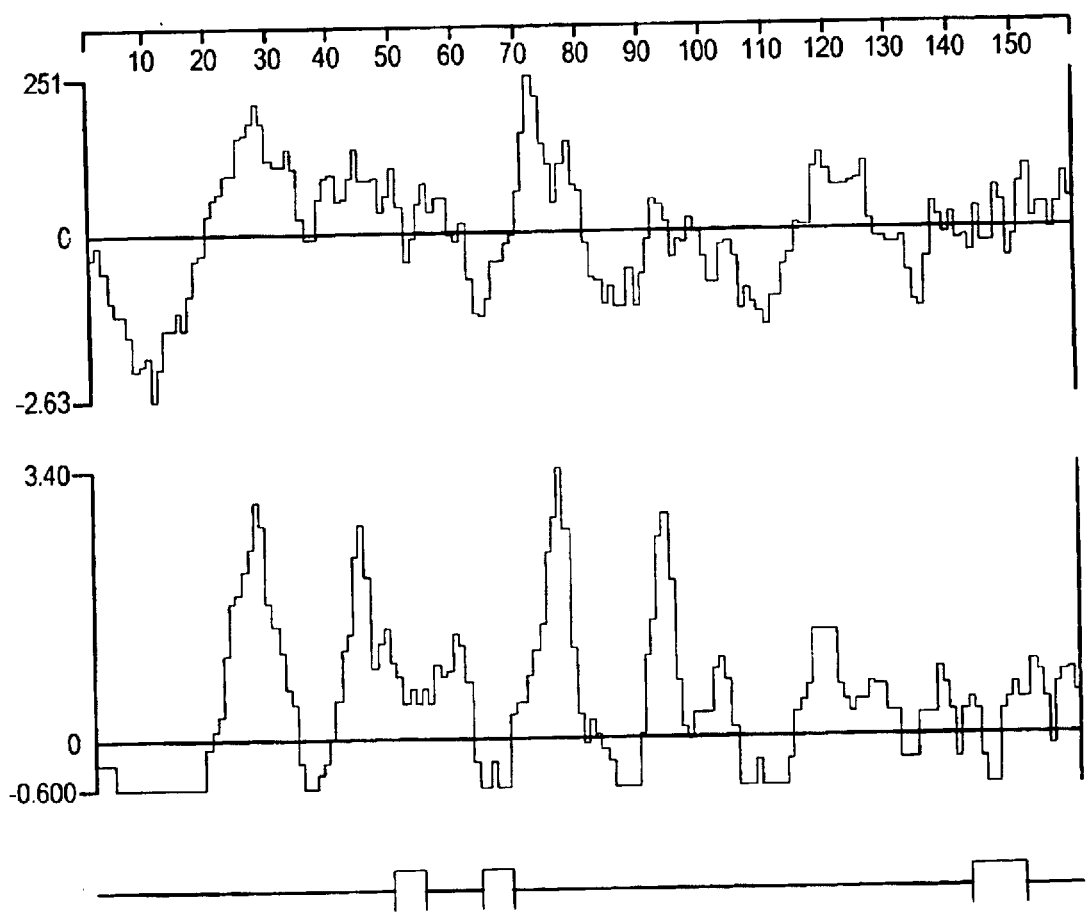

FIG. 12E shows plots of hydrophilicity, antigenic index, and AMPHI regions for ORF97-1 (SEQ ID NO: 358).

Example 43

The following DNA, believed to be complete, sequence was identified in N.meningitidis (SEQ ID NO: 365):

```
  1  ATGGCTTTTA TTACGCGCTT ATTCAAAAGC AGTAAATGGC TGATTGTGCC

51  GCTGATGCTC CCCGCCTTTC AGAATGTGGC GGCGGAGGGG ATAGATGTGA

101  GCCGTGCCGA AGCGAGGATA ACCGACGGCG GGCAGCTTTC CATCAGCAGC

151  CGCTTCCAAA CCGAGCTGCC CGACCAGCTC CAACAGGCGT TGCGCCGGGg
```

```
-continued
201  CGTGCCGCTC AACTTTACCT TAAGCTGGCA GCTTTCCGCC CCGATAATCG

251  CTTCTTATCG GTTTAAATTG GGGCAACTGA TTGGCGATGA CGACaATATT

301  GACTACAAAC TGAGTTTCCA TCCGCTGACc AaACGCTACC GCGTTACCgT

351  CGgCGCGTTT TCGACAGACT ACGACACCTT GGATGCGGCA TTGCGCGCGA

401  CCGGCGCGGT TGCCAACTGG AAAGTCCTGA ACAAAGGCGC GCTGTCCGGT

451  GCGGAAGCAG GGGAAACCAA GGCGGAAATC CGCCTGACGC TGTCCACTTC

501  AAAACTGCCC AAGCCTTTTC AAATCAATGC ATTGACTTCT CAAAACTGGC

551  ATTTGGATTC GGGTTGGAAA CCTCTAAACA TCATCGGGAA CAAATAA
                                                        15
```

This corresponds to the amino acid sequence (SEQ ID NO: 366; ORF106):

```
  1  MAFITRLFKS SKWLIVPLML PAFQNVAAEG IDVSRAEARI TDGGQLSISS

51  RFQTELPDQL QQALRRGVPL NFTLSWQLSA PIIASYRFKL GQLIGDDDNI

101  DYKLSFHPLT KRYRVTVGAF STDYDTLDAA LRATGAVANW KVLNKGALSG

151  AEAGETKAEI RLTLSTSKLP KPFQINALTS QNWHLDSGWK PLNIIGNK*
```

Further work revealed the following DNA sequence (SEQ ID NO: 367):

```
  1  ATGGCTTTTA TTACGCGCTT ATTCAAAAGC AGTAAATGGC TGATTGTGCC

51  GCTGATGCTC CCCGCCTTTC AGAATGTGGC GGCGGAGGGG ATAGATGTGA

101  GCCGTGCCGA AGCGAGGATA ACCGACGGCG GGCAGCTTTC CATCAGCAGC

151  CGCTTCCAAA CCGAGCTGCC CGACCAGCTC CAACAGGCGT TGCGCCGGGG

201  CGTGCCGCTC AACTTTACCT TAAGCTGGCA GCTTTCCGCC CCGATAATCG

251  CTTCTTATCG GTTTAAATTG GGGCAACTGA TTGGCGATGA CGACAATATT

301  GACTACAAAC TGAGTTTCCA TCCGCTGACC AACCGCTACC GCGTTACCGT

351  CGGCGCGTTT TCGACAGACT ACGACACCTT GGATGCGGCA TTGCGCGCGA

401  CCGGCGCGGT TGCCAACTGG AAAGTCCTGA ACAAAGGCGC GCTGTCCGGT

451  GCGGAAGCAG GGGAAACCAA GGCGGAAATC CGCCTGACGC TGTCCACTTC

501  AAAACTGCCC AAGCCTTTTC AAATCAATGC ATTGACTTCT CAAAACTGGC

551  ATTTGGATTC GGGTTGGAAA CCTCTAAACA TCATCGGGAA CAAATAA
```

This corresponds to the amino acid sequence (SEQ ID NO: 368; ORF106-1):

```
  1  MAFITRLFKS SKWLIVPLML PAFQNVAAEG IDVSRAEARI TDGGQLSISS

51  RFQTELPDQL QQALRRGVPL NFTLSWQLSA PIIASYRFKL GQLIGDDDNI

101  DYKLSFHPLT NRYRVTVGAF STDYDTLDAA LRATGAVANW KVLNKGALSG

151  AEAGETKAEI RLTLSTSKLP KPFQINALTS QNWHLDSGWK PLNIIGNK*
```

Computer analysis of this amino acid sequence gave the following results:
Homology with a Predicted ORF from *N.meningitidis* (Strain A)

ORF106 (SEQ ID NO: 366) shows 87.4% identity over a 199aa overlap with an ORF (ORF106a) (SEQ ID NO: 370) from strain A of *N. meningitidis*:

```
                  10         20         30         40         50        59
orf106.pep   MAFITRLFKSSK-WLIVPLMLPAFQNVAAEGIDVSRAEARITDGGQLSISSRFQTELPDQ
             ||||||||||| | ||:: || ::: :::|||||||||||||||:||||| ||||||||||
orf106a      MAFITRLFKSIKQWLVLLPMLSVLPDAAAEGIDVSRAEARIXDGGQLSXXSRFQTELPDQ
                  10         20         30         40         50        60

60         70         80         90        100        110       119
orf106.pep   LQQALRRGVPLNFTLSWQLSAPIIASYRFKLGQLIGDDDNIDYKLSFHPLTKRYRVTVGA
             || |  ||| || || |||||||||||||| |||||||||| ||||||||||||:||||||||
orf106a      LQXAXXRGVXLNXTLXWQLSAPIIASYRFXLGQLIGDDDXIDYKLSFHPLTNRYRVTVGA
                  70         80         90        100        110        120

120        130        140        150        160        170       179
orf106.pep   FSTDYDTLDAALRATGAVANWKVLNKGALSGAEAGETKAEIRLTLSTSKLPKPFQINALT
             ||| ||||||||||||||||||||||||||||||||||||||||||||||||||||||||
orf106a      FSTXYDTLDAALRATGAVANWKVLNKGALSGAEAGETKAEIRLTLSTSKLPKPFQINALT
                      130        140        150        160        170        180

180        190        199
orf106.pep   SQNWHLDSGWKPLNIIGNKX
             ||||||||||||||||||||
orf106a      SQNWHLDSGWKPLNIIGNKX
                      190        200
```

Due to the K→N substitution at residue 111, the homology between ORF106a (SEQ ID NO: 370) and ORF106-1 (SEQ ID NO: 368) is 87.9% over the same 199 aa overlap.

The complete length ORF106a nucleotide sequence (SEQ ID NO: 369) is:

```
  1   ATGGCTTTTA TTACGCGCTT ATTCAAAAGC ATTAAACAAT GGCTTGTGCT

51   GCTGCCGATG CTTTCCGTTT TGCCGGACGC GGCGGCGGAG GGGATAGATG

101   TGAGCCGCGC CGAAGCGAGG ATAANCGACG GCGGGCAGCT TTCCATNAGN

151   AGCCGCTTCC AAACCGAGCT GCCCGACCAG CTCCAANNNG CGNNGNGCCG

201   GGGCGTGNCG CTCAACTNTA CCTTAAGNTG GCAGCTTTCC GCCCCGATAA

251   TCGCTTCTTA TCGGTTTNAA TTGGGGCAAC TGATTGGCGA TGACGACNAT

301   ATTGACTACA AACTGAGTTT CCATCCGCTG ACCAACCGCT ACCGCGTTAC

351   CGTCGGCGCG TTTTCGACAG ANTACGACAC CTTGGATGCG GCATTGCGCG

401   CGACCGGCGC GGTTGCCAAC TGGAAAGTCC TGAACAAAGG CGCGCTGTCC

451   GGTGCGGAAG CAGGGGAAAC CAAGGCGGAA ATCCGCCTGA CGCTGTCCAC

501   TTCAAAACTG CCCAAGCCTT TCAAATCAA TGCATTGACT TCTCAAAACT

551   GGCATTTGGA TTCGGGTTGG AAACCTCTAA ACATCATCGG GAACAAATAA
```

This encodes a protein having amino acid sequence (SEQ ID NO: 370):

```
  1   MAFITRLFKS IKQWLVLLPM LSVLPDAAAE GIDVSRAEAR IXDGGQLSXX

51   SRFQTELPDQ LQXAXXRGVX LNXTLXWQLS APIIASYRFX LGQLIGDDDX

101   IDYKLSFHPL TNRYRVTVGA FSTXYDTLDA ALRATGAVAN WKVLNKGALS

151   GAEAGETKAE IRLTLSTSKL PKPFQINALT SQNWMLDSGW KPLNIIGNK*
```

Homology with a Predicted ORF from N.gonorrhoeae

ORF106 (SEQ ID NO: 366) shows 90.5% identity over a 199aa overlap with a predicted ORF (ORF106.ng) (SEQ ID NO: 372) from N. gonorrhoeae:

```
orf106.pep  MAFITRLFKSSK-WLIVPLMLPAFQNVAAEGIDVSRAEARITDGGQLSISSRFQTELPDQ   59
            |||||||||||  |||::  :|  ::  ::|||||  ::||||||||||:||||||||||
orf106ng    MAFITRLFKSIKQWLVLLPILSVLPDAAAEGIAATRAEARITDGGRLSISSRFQTELPDQ   60 orf106.pep  LQQALRRGVPLNFTLSWQLSAPIIASYRFKLGQLIGDDDNIDYKLSFHPLTKRYRVTVGA  119
            ||||||||||||||||||||||||| ||||||||||||||||||||||||||:|||||||
orf106ng    LQQALRRGVPLNFTLSWQLSAPTIASYRFKLGQLIGDDDNIDYKLSFHPLTNRYRVTVGA  120 orf106.pep  FSTDYDTLDAALRATGAVANWKVLNKGALSGAEAGETKAEIRLTLSTSKLPKPFQINALT  179
            ||||||||||||||||||||||||||||||||||||||||||||||||||||||||||||
orf106ng    FSTDYDTLDAALRATGAVANWKVLNKGALSGAEAGETKAEIRLTLSTSKLPKPFQINALT  180 orf106.pep  SQNWHLDSGWKPLNIIGNK                                          198
            |||||||||||||||||||
orf106ng    SQNWHLDSGWKPLNIIGNK                                          199
```

Due to the K→N substitution at residue 111, the homology between ORF106ng (SEQ ID NO: 372) and ORF106-1 (SEQ ID NO: 368) is 91.0% over the same 199 aa overlap.

The complete length ORF106ng nucleotide sequence (SEQ ID NO: 371) is:

```
  1  ATGGCTTTTA TTACGCGCTT ATTCAAAAGC ATTAAACAAT GGCTTGTGCT
 51  GTTGCCGATA CTCTCCGTTT TGCCGGACGC GGCGGCGGAG GGCATTGCCG
101  CGACCCGCGC CGAAGCGAGG ATAACCGACG GCGGGCGGCT TTCCATCAGC
151  AGCCGCTTCC AAACCGAGCT GCCCGACCAG CTCCAACAGG CGTTGCGCCG
201  GGGCGTACCG CTCAACTTTA CCTTAAGCTG GCAGCTTTCC GCCCCGACAA
251  TCGCTTCTTA TCGGTTTAAA TTGGGGCAAC TGATTGGCGA TGACGACAAT
301  ATTGACTACA AACTAAGTTT CCATCCGCTG ACCAACCGCT ACCGCGTTAC
351  CGTCGGCGCA TTTTCCACCG ATTACGACAC TTTGGATGCG GCATTGCGCG
401  CGACCGGCGC GGTTGCCAAC TGGAAAGTCC TGAACAAAGG CGCGTTGTCC
451  GGTGCGGAAG CAGGGGAAAC CAAGGCGGAA ATCCGCCTGA CGCTGTCCAC
501  TTCAAAACTG CCCAAGCCTT TCCAAATCAA CGCATTGACT TCTCAAAACT
551  GGCATTTGGA TTCGGGTTGG AAACCTCTAA ACATCATCGG GAACAAATAA
```

This encodes a protein having amino acid sequence (SEQ ID NO: 372):

```
  1  MAFITRLFKS IKQWLVLLPI LSVLPDAAAE GIAATRAEAR ITDGGRLSIS
 51  SRFQTELPDQ LQQALRRGVP LNFTLSWQLS APTIASYRFK LGQLIGDDDN
101  IDYKLSFHPL TNRYRVTVGA FSTDYDTLDA ALRATGAVAN WKVLNKGALS
151  GAEAGETKAE IRLTLSTSKL PKPFQINALT SQNWHLDSGW KPLNIIGNK*
```

Based on this analysis, including the presence of a putative leader sequence in the gonococcal protein, it was predicted that the proteins from N.meningitidis and N.gonorrhoeae, and their epitopes, could be useful antigens for vaccines or diagnostics, or for raising antibodies.

ORF106-1 (SEQ ID NO: 368) (18 kDa) was cloned in pET and pGex vectors and expressed in E.coli, as described above. The products of protein expression and purification were analyzed by SDS-PAGE. FIG. 13A shows the results of affinity purification of the His-fusion protein, and FIG. 13B shows the results of expression of the GST-fusion in E.coli. Purified His-fusion protein was used to immunise mice, whose sera were used for FACS analysis (FIG. 13C) These experiments confirm that ORF106-1 (SEQ ID NO: 368) is a surface-exposed protein, and that it is a useful immunogen.

Example 44

The following DNA sequence, believed to be complete, was identified in *N.meningitidis* (SEQ ID NO: 373):

```
   1  ATGGACACAA AAGAAATCCT CGG.TACGCG GcAGGcTCGA TCGGCAGCGC
  51  GGTTTTAGCC GTCATCATCc TGCCGCTGCT GTCGTGGTAT TTCCCCGCCG
 101  ACGACATCGG GCGCATCGTG CTGATGCAGA CGGCGGCGGG GCTgACGGTG
 151  TCGGTGTTGT GCCTCGGGCT GGATCAGGCA TACGTCCGCG AATACTATGC
 201  CACCGCCGAC AAAGACAcCT TGTTCAAAAC CCTGTTCCTG CCGCCGCTGC
 251  TGTCTGCCGC CGCGATAGCC GCCCTGCTGC TTTCCCGCCC GTCCCTGCCG
 301  TCTGAAATCC TGTTTTCACT CGACGATGCC gCCGCCGGCa TCGGGCTGGT
 351  GCTGTTTGAA CtGAGCTTCC TGCCCATCCG cTTTCTCTTA CTGGTTTTGC
 401  GTATGGAAGG ACGCGCCcTT GCCTTTTCGT CCGCGCAACT CGTGCcCAAG
 451  CTCGCCATCC TGCTGCTG.T GCCGCTGACG GTCGGGCTGC TGCACTTTCC
 501  AGCGAACACC GCCGTCCTGA CCGCCGTTTA CGCGCTGGCA AACCTTGCCG
 551  CCGCCGCCTT TTTGCTGTTT CAAAACCGAT GCCGTCTAAA GGCCGTCCGG
 601  CACGCACCGT TTTCGCCCGC CGTCCTGCAC CGGGGG.TGC GCTACGGCAT
 651  ACCGATCGCA CTGAGCAGCA TCGCCTATTG GGGGCTGGCA TCCGCCGACC
 701  GTTTGTTCCT GAAAAAATAT GCCGGCCTGG AACAGCTCGG CGTTTATTCG
 751  ATGGGTATTT CGTTCGGCGG GGCGGCATTA TTGTTCCAAA GCATCTTTTC
 801  AACGGTCTGG ACACCGTATA TTTTCCGCGC AATCGAAGAA AACGCCCCGC
 851  CCGCTCGCCT CTCGGCAACG GCAGAATCCG CCGCCGCCCT GCTTGCCTCC
 901  GCCCTCTGC. TGACCGGCAT TTTCTCGCCC CTTGCCTCCC TCCTGCTGCC
 951  GGAAAACTAC GCCGCCGTCC GGTTTATCGT CGTATCGTGT ATG.TGCCGC
1001  CGCTGTTTTG CACGCTGGCG GAAATCAGCG GCATCGGTTT GAACGTCGTT
1051  CGCAAAACGC GCCCGATCGC GCTCGCCACC TTGGGCGCGC TGGCGGCAAA
1101  CCTGCTGCTG CTGGGGCTTG ACCGTGCCGT ACCGGCGAGG CCGCC.GGCG
1151  CGGCGGTTGC CTGTGCCGCC TCATTCTGGC TGTTTTTTCG CTTCAAGACC
1201  GAAAGCTCyT GCCGCCTGTG GCAGCCGCTC AAACGCCTGC CGCTTTATCT
1251  GCACACATTG TTCTGCCTGA CCTCCTCGGC GGCCTACACC TGCTTCGGCA
1301  CGCCGGCAAA CTATCCCCTG TTTGCCGGCG TATGGGCGGC ATATCTGGCA
1351  GGCTGCATCC TGCGCCACCG GAAAGATTTG CACAAACTGT TTCATTATTT
1401  GAAAAAACAA GGTTTCCCAT TATGA
```

This corresponds to the amino acid sequence (SEQ ID NO: 374; ORF10):

```
   1  MDTKEILXYA AGSIGSAVLA VIILPLLSWY FPADDIGRIV LMQTAAGLTV
  51  SVLCLGLDQA YVREYYATAD KDTLFKTLFL PPLLSAAAIA ALLLSRPSLP
 101  SEILFSLDDA AAGIGLVLFE LSFLPIRFLL LVLRMEGRAL AFSSAQLVPK
 151  LAILLLXPLT VGLLHFPANT AVLTAVYALA NLAAAAFLLF QNRCRLKAVR
 201  HAPFSPAVLH RGXRYGIPIA LSSIAYWGLA SADRLFLKKY AGLEQLGVYS
```

-continued
```
251  MGISFGGAAL LFQSIFSTVW TPYIFRAIEE NAPPARLSAT AESAAALLAS

301  ALCXTGIFSP LASLLLPENY AAVRFIVVSC MXPPLFCTLA EISGIGLNVV

351  RKTRPIALAT LGALAANLLL LGLDRAVFAR PXGAAVACAA SFWLFFAFKT

401  ESSCRLWQPL KRLPLYLHTL FCLTSSAAYT CFGTPANYPL FAGVWAAYLA

451  GCILRHRKDL HKLFHYLKKQ GFPL*
```

Further sequence analysis revealed the complete DNA sequence(SEQ ID NO: 375) to be:

```
   1  ATGGACACAA AAGAAATCCT CGGCTACGCG GCAGGCTCGA TCGGCAGCGC

51  GGTTTTAGCC GTCATCATCC TGCCGCTGCT GTCGTGGTAT TTCCCCGCCG

101  ACGACATCGG GCGCATCGTG CTGATGCAGA CGGCGGCGGG GCTGACGGTG

151  TCGGTGTTGT GCCTCGGGCT GGATCAGGCA TACGTCCGCG AATACTATGC

201  CACCGCCGAC AAAGACACCT TGTTCAAAAC CCTGTTCCTG CCGCCGCTGC

251  TGTCTGCCGC CGCGATAGCC GCCCTGCTGC TTTCCCGCCC GTCCCTGCCG

301  TCTGAAATCC TGTTTTCACT CGACGATGCC GCCGCCGGCA TCGGGCTGGT

351  GCTGTTTGAA CTGAGCTTCC TGCCCATCCG CTTTCTCTTA CTGGTTTTGC

401  GTATGGAAGG ACGCGCCCTT GCCTTTTCGT CCGCGCAACT CGTGCCCAAG

451  CTCGCCATCC TGCTGCTGCT GCCGCTGACG GTCGGGCTGC TGCACTTTCC

501  AGCGAACACC GCCGTCCTGA CCGCCGTTTA CGCGCTGGCA AACCTTGCCG

551  CCGCCGCCTT TTTGCTGTTT CAAAACCGAT GCCGTCTGAA GGCCGTCCGG

601  CACGCACCGT TTTCGCCCGC CGTCCTGCAC CGGGGGCTGC GCTACGGCAT

651  ACCGATCGCA CTGAGCAGCA TCGCCTATTG GGGGCTGGCA TCCGCCGACC

701  GTTTGTTCCT GAAAAAATAT GCCGGCCTGG AACAGCTCGG CGTTTATTCG

751  ATGGGTATTT CGTTCGGCGG GGCGGCATTA TTGTTCCAAA GCATCTTTTC

801  AACGGTCTGG ACACCGTATA TTTTCCGCGC AATCGAAGAA AACGCCCCGC

851  CCGCCCGCCT CTCGGCAACG GCAGAATCCG CCGCCGCCCT GCTTGCCTCC

901  GCCCTCTGCC TGACCGGCAT TTTCTCGCCC CTTGCCTCCC TCCTGCTGCC

951  GGAAAACTAC GCCGCCGTCC GGTTTATCGT CGTATCGTGT ATGCTGCCGC

1001  CGCTGTTTTG CACGCTGGCG GAAATCAGCG GCATCGGTTT GAACGTCGTC

1051  CGCAAAACGC GCCCGATCGC GCTCGCCACC TTGGGCGCGC TGGCGGCAAA

1101  CCTGCTGCTG CTGGGGCTTG CCGTGCCGTC CGGCGGCGCG CGCGGCGCGG

1151  CGGTTGCCTG TGCCGCCTCA TTCTGGCTGT TTTTTGCCTT CAAGACCGAA

1201  AGCTCCTGCC GCCTGTGGCA GCCGCTCAAA CGCCTGCCGC TTTATCTGCA

1251  CACATTGTTC TGCCTGACCT CCTCGGCGGC CTACACCTGC TTCGGCACGC

1301  CGGCAAACTA TCCCCTGTTT GCCGGCGTAT GGGCGGCATA TCTGGCAGGC

1351  TGCATCCTGC GCCACCGGAA AGATTTGCAC AAACTGTTTC ATTATTTGAA

1401  AAAACAAGGT TTCCCATTAT GA
```

This corresponds to the amino acid sequence (SEQ ID NO: 376; ORF10-1):

```
  1 MDTKEILGYA AGSIGSAVLA VIILPLLSWY FPADDIGPIV LMQTAAGLTV

51 SVLCLGLDQA YVREYYATAD KDTLFKTLFL PPLLSAAAIA ALLLSRPSLP

101 SEILFSLDDA AAGIGLVLFE LSFLPIRFLL LVLRMEGRAL AFSSAQLVPK

151 LAILLLLPLT VGLLHFPANT AVLTAVYALA NLAAAAFLLF QNRCRLKAVR

201 HAPFSPAVLH RGLRYGIPIA LSSIAYWGLA SADRLFLKKY AGLEQLGVYS

251 MGISFGGAAL LFQSIFSTVW TPYIFRAIEE NAPPAPLSAT AESAAALLAS

301 ALCLTGIFSP LASLLLPENY AAVRFIVVSC MLPPLFCTLA EISGIGLNVV

351 RKTRPIALAT LGALAANLLL LGLAVPSGGA RGAAVACAAS FWLFFAFKTE

401 SSCRLWQPLK RLPLYLHTLF CLTSSAAYTC FGTPANYPLF AGVWAAYLAG

451 CILRHRKDLH KLFHYLKKQG FPL*
```

Computer analysis of this amino acid sequence gave the following results:
Prediction
ORF10-1 (SEQ ID NO: 376) is predicted to be the precursor of an integral membrane protein, since it comprises several (12–13) potential transmembrane segments, and a probable cleavable signal peptide Homology with EpsM (SEQ ID NO: 1137) from *Streptococcus thermophilus* (Accession Number U40830).

ORF10 (SEQ ID NO: 374) shows homology with the epsM gene of *S. thermophilus*, which encoded a protein (SEQ ID NO: 1137) of a size similar to ORF10 and is involved in exopolysaccharide synthesis. Other homologies are with prokaryotic membrane proteins:

```
Identities = (25%)
Query:  213 LRYGIPLALSSLAYWGLASADRLFLKKYAGLEQLGVYSMGISFGGAALLLQSIFSTVW   270
            L Y +PL   SS+ +W L ++ R F+   + G     G+ ++           +  +IF+  W
Sbjct:  210 LYYALPLIPSSILWWLLNASSRYFVLFFLGAGANGLLAVATKIPSIISIFNTIFTQAW   267

Identities = 15/57 (26%), Positives = 31/57 (54%)
Query:    7 LGYAAGSIGSAVLAVIILPLLSWYFPADDIGRIVLMQTAAGLTVSVLCLGLDQAYVR     63
            L +  G++GS +L   +++PL ++          + G    L QT A L + ++ +  + A +R
Sbjct:   12 LVFTIGNLGSKLLVFLLVPLYTYAMTPQEYGMADLYQTTANLLLPLITMNVFDATLR     68

Identities = 16/96 (16%), Positives = 36/96 (37%)
Query:  307 IFSPLASLLLPENYAAVRFTVVSCMLPPLFYTLTEISGIGLNVVRKTRPIXXXXXXXXXX   366
                + P+ ++ +YA+   V   ML LF + ++  G        ++T+ +
Sbjct:  305 VLKPIVEKVVSSDYASSWQYVPFFMLSMLFSSFSDFFGTNYIAAKQTKGVFMTSIYGTIV   364
```

Homology with a Predicted ORF from *N.meningitidis* (Strain A)
ORF10 (SEQ ID NO: 374) shows 95.4% identity over a 475aa overlap with an ORF (ORF10a) (SEQ ID NO: 378) from strain A of *N. meningitidis*:

```
                     10         20         30         40         50         60
orf10.pep  MDTKEILXYAAGSIGSAVLAVIILPLLSWYFPADDIGRIVLMQTAAGLTVSVLCLGLDQA
           |||||||  |||||||||||||||||||||||||||||||||||||||||||||||||||
orf10a     MDTKEILGYAAGSIGSAVLAVIILPLLSWYFPADDIGRIVLMQTAAGLTVSVLCLGLDQA
                     10         20         30         40         50         60

70         80         90        100        110        120
orf10.pep  YVREYYATADKDTLFKTLFLPPLLSAAAIAALLLSRPSLPSEILFSLDDAAAGIGLVLFE
           |||||||:||||||||||||||||||||||||||||||||||||||||||||||||||||
orf10a     YVREYYAAADKDTLFKTLFLPPLLSAAAIAALLLSRPSLPSEILFSLDDAAAGIGLVLFE
                     70         80         90        100        110        120

130        140        150        160        170        180
orf10.pep  LSFLPIRFLLLVLRMEGRALAFSSAQLVPKLAILLLXPLTVGLLHFPANTAVLTAVYALA
           ||||||||||||||||||||||||||||| ||||||| ||||||||||||||||||||||
orf10a     LSFLPIRFLLLVLRMEGRALAFSSAQLVSKLAILLLLPLTVGLLHFPANTAVLTAVYALA
                    130        140        150        160        170        180
```

```
                190       200       210       220       230       240
orf10.pep NLAAAAFLLFQNRCRLKAVRHAPFSPAVLHRGXRYGIPIALSSIAYWGLASADRLFLKKY
          ||||||||||||||||||||||:||||  ||||||  |||||||||||||||||||||||
orf10a    NLAAAAFLLFQNRCRLKAVRRAPFSSAVLHRGLRYGIPIALSSIAYWGLASADRLFLKKY
                190       200       210       220       230       240

250       260       270       280       290       300
orf10.pep AGLEQLGVYSMGISFGGAALLFQSIFSTVWTPYIFRAIEENAPPARLSATAESAAALLAS
          ||||||||||||||||||||||||||||||||||||||||:|||||||||||||||||||
orf10a    AGLEQLGVYSMGISFGGAALLFQSIFSTVWTPYIFRAIEANAPPARLSATAESAAALLAS
                250       260       270       280       290       300

310       320       330       340       350       360
orf10.pep ALCXTGIFSPLASLLLPENYAAVRFIVVSCMXPPLFCTLAEISGIGLNVVRKTRPIALAT
          ||| ||||||||||||||||||||||||||||  ||||||:|||||||||||||||||||
orf10a    ALCLTGIFSPLASLLLPENYAAVRFIVVSCMLPPLFCTLVEISGIGLNVVRKTRPIALAT
                310       320       330       340       350       360

370       380       390       400       410       419
orf10.pep LGALAANLLLLGLDRAVPAR-PXGAAVACAASFWLFFAFKTESSCRLWQPLKRLPLYLHT
          |||||||||||||   |||: ||||||||||||||||:||||||||||||||||||:||
orf10a    LGALAANLLLLGL--AVPSGGARGAAVACAASFWLFFVFKTESSCRLWQPLKRLPLYMHT
                370       380       390       400       410

420       430       440       450       460       470
orf10.pep LFCLTSSAAYTCFGTPANYPLFAGVWAAYLAGCILRHRKDLHKLFHYLKKQGFPLX
          ||||:|||||||||||||||||||||||:|||||||||||||||||||||||||||
orf10a    LFCLASSAAYTCFGTPANYPLFAGVWAVYLAGCILRHRKDLHKLFHYLKKQGFPLX
                420       430       440       450       460       470
```

The complete length ORF10a nucleotide sequence (SEQ ID NO: 377) is:

```
   1 ATGGACACAA AAGAAATCCT CGGCTACGCG GCAGGCTCGA TCGGCAGCGC
  51 GGTTTTAGCC GTCATCATCC TGCCGCTGCT GTCGTGGTAT TTCCCTGCCG
 101 ACGACATCGG ACGCATCGTG CTGATGCAGA CGGCGGCGGG GCTGACGGTG
 151 TCGGTGTTGT GCCTCGGGCT GGATCAGGCA TACGTCCGCG AATACTATGC
 201 CGCCGCCGAC AAAGACACTT TGTTCAAAAC CCTGTTCCTG CCGCCGCTGC
 251 TGTCTGCCGC CGCGATAGCC GCCCTGCTGC TTTCCCGCCC ATCCCTGCCG
 301 TCTGAAATCC TGTTTTCGCT CGACGATGCC GCCGCCGGCA TCGGGCTGGT
 351 GCTGTTTGAA CTGAGCTTCC TGCCCATCCG CTTTCTCTTA CTGGTTTTGC
 401 GTATGGAAGG ACGCGCCCTT GCCTTTTCGT CCGCGCAACT CGTGTCCAAG
 451 CTCGCCATCC TGCTGCTGCT GCCGCTGACG GTCGGGCTGC TGCACTTTCC
 501 GGCGAACACC GCCGTCCTGA CCGCCGTTTA CGCGCTGGCA AACCTTGCCG
 551 CCGCCGCCTT TTTGCTGTTT CAAAACCGAT GCCGTCTGAA GGCCGTCCGG
 601 CGCGCACCGT TTTCATCCGC CGTCCTGCAT CGCGGCCTGC GCTACGGCAT
 651 ACCGATCGCA CTAAGCAGCA TCGCCTATTG GGGGCTGGCA TCCGCCGACC
 701 GTTTGTTCCT GAAAAAATAT GCCGGCCTAG AACAGCTCGG CGTTTATTCG
 751 ATGGGTATTT CGTTCGGCGG AGCGGCATTA TTGTTCCAAA GCATCTTTTC
 801 AACGGTCTGG ACACCGTATA TTTTCCGCGC AATCGAAGCA AACGCCCCGC
 851 CCGCCCGCCT CTCGGCAACG GCAGAATCCG CCGCCGCCCT GCTTGCCTCC
 901 GCCCTCTGCC TGACCGGCAT TTTCTCGCCC CTCGCCTCCC TCCTGCTGCC
 951 GGAAAACTAC GCCGCCGTCC GGTTTATCGT CGTATCGTGT ATGCTGCCTC
1001 CGCTGTTTTG CACGCTGGTA GAAATCAGCG GCATCGGTTT GAACGTCGTC
1051 CGAAAAACAC GCCCGATCGC GCTCGCCACC TTGGGCGCGC TGGCGGCAAA
```

```
1101    CCTGCTGCTG CTGGGGCTTG CCGTACCGTC CGGCGGCGCG CGCGGCGCGG

1151    CGGTTGCCTG TGCCGCCTCA TTTTGGCTGT TTTTTGTTTT CAAGACCGAA

1201    AGCTCCTGCC GCCTGTGGCA GCCGCTCAAA CGCCTGCCGC TTTATATGCA

1251    CACATTGTTC TGCCTGGCCT CCTCGGCGGC CTACACCTGC TTCGGCACTC

1301    CGGCAAACTA CCCCCTGTTT GCCGGCGTAT GGGCGGTATA TCTGGCAGGC

1351    TGCATCCTGC GCCACCGGAA AGATTTGCAC AAACTGTTTC ATTATTTGAA

1401    AAAACAAGGT TTCCCATTAT GA
```

This encodes a protein having amino acid sequence (SEQ ID NO: 378):

```
  1    MDTKEILGYA AGSIGSAVLA VIILPLLSWY FPADDIGRIV LMQTAAGLTV

51    SVLCLGLDQA YVREYYAAAD KDTLFKTLFL PPLLSAAAIA ALLLSRPSLP

101    SEILFSLDDA AAGIGLVLFE LSFLPIRFLL LVLRMEGRAL AFSSAQLVSK

151    LAILLLLPLT VGLLHFPANT AVLTAVYALA NLAAAAFLLF QNRCRLKAVR

201    RAPFSSAVLH RGLRYGIPIA LSSIAYWGLA SADRLFLKKY AGLEQLGVYS

251    MGISFGGAAL LFQSIFSTVW TPYIFRAIEA NAPPARLSAT AESAAALLAS

301    ALCLTGIFSP LASLLLPENY AAVRFIVVSC MLPPLFCTLV EISGIGLNVV

351    RKTRPIALAT LGALAANLLL LGLAVPSGGA RGAAVACAAS FWLFFVFKTE

401    SSCRLWQPLK RLPLYMHTLF CLASSAAYTC FGTPANYPLF AGVWAVYLAG

451    CILRHRKDLH KLFHYLKKQG FPL*
```

ORF10a (SEQ ID NO: 378) and ORF10-1 (SEQ ID NO: 376) show 95.4% identity in 475 aa overlap:

```
                  10         20         30         40         50         60
orf10-1.pep MDTKEILXYAAGSIGSAVLAVIILPLLSWYFPADDIGRIVLMQTAAGLTVSVLCLGLDQA
            |||||||  ||||||||||||||||||||||||||||||||||||||||||||||||||
orf10a      MDTKEILGYAAGSIGSAVLAVIILPLLSWYFPADDIGRIVLMQTAAGLTVSVLCLGLDQA
                  10         20         30         40         50         60

70         80         90        100        110        120
orf10-1.pep YVREYYATADKDTLFKTLFLPPLLSAAAIAALLLSRPSLPSEILFSLDDAAAGIGLVLFE
            |||||||:|||||||||||||||||||||||||||||||||||||||||||||||||||
orf10a      YVREYYAAADKDTLFKTLFLPPLLSAAAIAALLLSRPSLPSEILFSLDDAAAGIGLVLFE
                  70         80         90        100        110        120

130        140        150        160        170        180
orf10-1.pep LSFLPIRFLLLVLRMEGRALAFSSAQLVPKLAILLLXPLTVGLLHFPANTAVLTAVYALA
            |||||||||||||||||||||||||||||   ||||||  ||||||||||||||||||||
orf10a      LSFLPIRFLLLVLRMEGRALAFSSAQLVSKLAILLLLPLTVGLLHFPANTAVLTAVYALA
                 130        140        150        160        170        180

190        200        210        220        230        240
orf10-1.pep NLAAAAFLLFQNRCRLKAVRHAPFSPAVLHRGXRYGIPIALSSIAYWGLASADRLFLKKY
            ||||||||||||||||||||:||| ||||||||||||||||||||||||||||||||||
orf10a      NLAAAAFLLFQNRCRLKAVRRAPFSSAVLHRGLRYGIPIALSSIAYWGLASADRLFLKKY
                 190        200        210        220        230        240

250        260        270        280        290        300
orf10-1.pep AGLEQLGVYSMGISFGGAALLFQSIFSTVWTPYIFRAIEENAPPARLSATAESAAALLAS
            ||||||||||||||||||||||||||||||||||||||||  ||||||||||||||||||
orf10a      AGLEQLGVYSMGISFGGAALLFQSIFSTVWTPYIFRAIEANAPPARLSATAESAAALLAS
                 250        260        270        280        290        300
```

```
                      -continued
                310       320       330       340       350       360
orf10-1.pep  ALCXTGIFSPLASLLLPENYAAVRFIVVSCMXPPLFCTLAEISGIGLNVVRKTRPIALAT
             ||| |||||||||||||||||||||||| ||||||||:|||||||||||||||||||||
orf10a       ALCLTGIFSPLASLLLPENYAAVRFIVVSCMLPPLFCTLVEISGIGLNVVRKTRPIALAT
                310       320       330       340       350       360

370       380       390       400       410       419
orf10-1.pep  LGALAANLLLLGLDRAVPAR-PXGAAVACAASFWLFFAFKTESSCRLWQPLKRLPLYLHT
             ||||||||||||| |||:   ||||||||||||||||:||||||||||||||||||:||
orf10a       LGALAANLLLLGL--AVPSGGARGAAVACAASFWLFFVFKTESSCRLWQPLKRLPLYMHT
                370       380         390       400       410

420       430       440       450       460       470
orf10-1.pep     LFCLTSSAAYTCFGTPANYPLFAGVWAAYLAGCILRHRKDLHKLFHYLKKQGFPLX
                ||||:|||||||||||||||||||||||:||||||||||||||||||||||||||
orf10a          LFCLASSAAYTCFGTPANYPLFAGVWAVYLAGCILRHRKDLHKLFHYLKKQGFPLX
                420       430       440       450       460       470
```

Homology with a predicted ORF from *N.gonorrhoeae* ORF10 (SEQ ID NO: 374) shows 94.1% identity over a 475aa overlap with a predicted ORF (ORF10.ng) (SEQ ID NO: 380) from *N. gonorrhoeae*:

```
orf10ng.pep  MDTKEILGYAAGSIGSAVLAVIILPLLSWYFPADDIGRIVLMQTAAGLTVSVLCLGLDQA  60
             ||||||| ||||||||||||||||||||||||||||||||||||||||||||||||||||
orf10nm      MDTKEILXYAAGSIGSAVLAVIILPLLSWYFPADDIGRIVLMQTAAGLTVSVLCLGLDQA  60 orf10ng.pep  YVREYYAAADKDTLFKTLFLPPLLFSAAIAALLLSRPSLPSEILFSLDDAAAGIGLVLFE  120
             ||||||:|||||||||||||||| :|||||||||||||||||||||||||||||||||||
orf10nm      YVREYYATADKDTLFKTLFLPPLLSAAAIAALLLSRPSLPSEILFSLDDAAAGIGLVLFE  120 orf10ng.pep  LSFLPIRFLLLVLRMEGRALAFSSAQLVPKLAILLLLPLTVGLLHFPANTSVLTAVYALA  180
             ||||||||||||||||||||||:|||||||||||| ||||||||||||||:||||||||
orf10nm      LSFLPIRFLLLVLRMEGRALAFSSAQLVPKLAILLLXPLTVGLLHFPANTAVLTAVYALA  180 orf10ng.pep  NLAAAAFLLFQNRCRLKAVRRAPFSPAVLHRGLRYGIPLALSSLAYWGLASADRLFLKKY  240
             ||||||||||||||||||||:|||||||||| |||| :||||:|||||||||||||||||
orf10nm      NLAAAAFLLFQNRCRLKAVRHAPFSPAVLHRGXRYGIPIALSSIAYWGLASADRLFLKKY  240 orf10ng.pep  AGLEQLGVYSMGISFGGAALLLQSIFSTVWTPYIFRAIEENATPARLSATAESAAALLAS  300
             |||||||||||||||||||||:|||||||||||||||||||| ||||||||||||||||
orf10nm      AGLEQLGVYSMGISFGGAALLFQSIFSTVWTPYIFRAIEENAPPARLSATAESAAALLAS  300 orf10ng.pep  ALCLTGIFSPLASLLLPENYAAVRFTVVSCMLPPLFYTLTEISGIGLNVVRKTRPIALAT  360
             ||| ||||||||||||||||||||||| |||| |||| ||:|||||||||||||||||
orf10nm      ALCXTGIFSPLASLLLPENYAAVRFIVVSCMXPPLFCTLAEISGIGLNVVRKTRPIALAT  360

370       380       390       400       410
orf10ng.pep  LGALAANLLLLGL--AVPSGGTRGAAVACAASFWLFFVFKTESSCRLWQPLKRLPLYMHT
             ||||||||||||| |||:   ||||||||||||||||:||||||||||||||||||:||
orf10nm      LGALAANLLLLGLDRAVPAR-PXGAAVACAASFWLFFAFKTESSCRLWQPLKRLPLYLHT
                370       380       390       400       410

420       430       440       450       460       470
orf10ng.pep  LFCLASSAAYTCFGTPANYPLFAGVWAAYLAGCILRHRKNLHKLFHYLKKQGFPLX
             ||||:||||||||||||||||||||||||||||||||||:|||||||||||||||
orf10nm      LFCLTSSAAYTCFGTPANYPLFAGVWAAYLAGCILRHRKDLHKLFHYLKKQGFPLX
             420       430       440       450       460       470
```

The complete length ORF10ng nucleotide sequence (SEQ ID NO: 379) is:

```
  1  ATGGACACAA AAGAAATCCT CGGCTACGCG GCAGGCTCGA TCGGCAGCGC

51  GGTTTTAGCC GTCATCATCC TGCCGCTGCT GTCGTGGTAT TTCcccgCCG

101  ACGACATCGG GCGCATCGTG CTGATGCAGA CGGCGGCGGG ACTGACGGTG

151  TCGGTATTGT GCCTCGGGCT GGATCAGGCA TACGTCCGCG AATACTATGC

201  CGCCGCCGAC AAAGACACTT TGTTCAAAAC CCTGTTCCTG CCGCCGCTGC
```

```
                    -continued
 251   TGTTTTCCGC CGCGATAGCC GCCCTGCTGC TTTCCCGCCC GTCCCTGCCG

301   TCTGAAATCC TGTTTTCGCT CGACGATGCC GCCGCCGGCA TCGGGCTGGT

351   GCTGTTTGAA CTGAGCTTCC TGCCCATCCG CTTTCTCTTA CTGGTTTTGC

401   GTATGGAAGG GCGCGCCCTT GCCTTTTCGT CCGCGCAACT CGTGCCCAAA

451   CTCGCCATTC TGCTGCTGTT GCCGCTGACG GTCGGGCTGC TGCACTTTCC

501   GGCGAACACC TCCGTCCTGA CCGCCGTTTA CGCGCTGGCA AACCTTGCCG

551   CCGCCGCCTT TTTGCTGTTT CAAAACCGAT GCCGTCTGAA GGCCGTCCGG

601   CGCGCGCCGT TTTCGCCCGC CGTCCTGCAC CGGGGGCTGC GCTACGGCAT

651   ACCGCTCGCA CTGAGCAGCC TTGCCTATTG GGGGCTGGCA TCCGCCGACC

701   GTTTGTTCCT GAAAAAATAT GCGGGCCTGG AACAGCTCGG CGTTTATTCG

751   ATGGGTATTT CGTTCGGCGG GGCGGCATTA TTGCTCCAAA GCATCTTTTC

801   AACGGTCTGG ACACCGTATA TTTTCCGTGC AATCGAAGAA AACGCCACGC

851   CCGCCCGCCT CTCGGCAACG GCAGAATCCG CCGCCGCCCT GCTTGCCTCC

901   GCCCTCTGCC TGACCGGAAT TTTCTCGCCC CTCGCCTCCC TCCTGCTGCC

951   GGAAAACTAC GCCGCCGTCC GGTTTACCGT CGTATCGTGT ATGCTGccgc 1001   cgctGTTTTA CACGCTGACC GAAATCAGCG GCATCGGTTT GAACGTCGTC

1051   CGCAAAACGC GTCCGATCGC GCTTGCCACC TTGGGCGCGC TGGCGGCAAA

1101   CCTGCTGCTG CTGGGGCTTG CCGTACCGTC CGGCGGCACG CGCGGCGCGG

1151   CGGTTGCCTG TGCCGCCTCA TTCTGGTTGT TTTTTGTTTT CAAGACAGAA

1201   AGCTCCTGCC GCCTGTGGCA GCCGCTCAAA CGCCTGCCGC TTTATATGCA

1251   CACATTGTTC TGCCTgGCCT CCTCGGCGGC CTACACCTGC TTCGGCACAC

1301   CGGCAAACTA CCCcctgttt gccggcgtAT GGGCGGCATA TCTGGCAGGC

1351   TGCATCCTGC GCCACCGGAA AAATTTGCAC AAACTGTTTC ATTATTTGAA

1401   AAAACAAGGT TTCCCATTAT GA
```

This encodes a protein having amino acid sequence (SEQ ID NO: 380):

```
  1   MDTKEILGYA AGSIGSAVLA VIILPLLSWY FPADDIGRIV LMQTAAGLTV

51   SVLCLGLDQA YVREYYAAAD KDTLFKTLFL PPLLFSAAIA ALLLSRPSLP

101   SEILFSLDDA AAGIGLVLFE LSFLPIRFLL LVLRMEGRAL AFSSAQLVPK

151   LAILLLLPLT VGLLHFPANT SVLTAVYALA NLAAAAFLLF QNRCRLKAVR

201   RAPFSPAVLH RGLRYGIPLA LSSLAYWGLA SADRLFLKKY AGLEQLGVYS

251   MGISFGGAAL LLQSIFSTVW TPYIFRAIEE NATPARLSAT AESAAALLAS

301   ALCLTGIFSP LASLLLPENY AAVRFTVVSC MLPPLFYTLT EISGIGLNVV

351   RKTRPIALAT LGALAANLLL LGLAVPSGGT RGAAVACAAS FWLFFVFKTE

401   SSCRLWQPLK RLPLYMHTLF CLASSAAYTC FGTPANYPLF AGVWAAYLAG

451   CILRHRKNLH KLFHYLKKQG FPL*
```

ORF10ng (SEQ ID NO: 380) and ORF10-1 (SEQ ID NO: 376) show 96.4% identity in 473 aa overlap:

```
                    10        20        30        40        50        60
orf10-1.pep MDTKEILGYAAGSIGSAVLAVIILPLLSWYFPADDIGRIVLMQTAAGLTVSVLCLGLDQA
            ||||||||||||||||||||||||||||||||||||||||||||||||||||||||||||
orf10ng-1   MDTKEILGYAAGSIGSAVLAVIILPLLSWYFPADDIGRIVLMQTAAGLTVSVLCLGLDQA
                    10        20        30        40        50        60

70        80        90       100       110       120
orf10-1.pep YVREYYATADKDTLFKTLFLPPLLSAAAIAALLLSRPSLPSEILFSLDDAAAGIGLVLFE
            |||||||:|||||||||||||||| :||||||||||||||||||||||||||||||||||
orf10ng-1   YVREYYAAADKDTLFKTLFLPPLLFSAAIAALLLSRPSLPSEILFSLDDAAAGIGLVLFE
                    70        80        90       100       110       120

130       140       150       160       170       180
orf10-1.pep LSFLPIRFLLLVLRMEGRALAFSSAQLVPKLAILLLLPLTVGLLHFPANTAVLTAVYALA
            ||||||||||||||||||||||||||||||||||||||||||||||||||:|||||||||
orf10ng-1   LSFLPIRFLLLVLRMEGRALAFSSAQLVPKLAILLLLPLTVGLLHFPANTSVLTAVYALA
                   130       140       150       160       170       180

190       200       210       220       230       240
orf10-1.pep NLAAAAFLLFQNRCRLKAVRHAPFSPAVLHRGLRYGIPIALSSIAYWGLASADRLFLKKY
            ||||||||||||||||||||:|||||||||||||||||:||||:||||||||||||||||
orf10ng-1   NLAAAAFLLFQNRCRLKAVRRAPFSPAVLHRGLRYGIPLALSSLAYWGLASADRLFLKKY
                   190       200       210       220       230       240

250       260       270       280       290       300
orf10-1.pep AGLEQLGVYSMGISFGGAALLFQSIFSTVWTPYIFRAIEENAPPARLSATAESAAALLAS
            |||||||||||||||||||||:|||||||||||||||||||| |||||||||||||||||
orf10ng-1   AGLEQLGVYSMGISFGGAALLLQSIFSTVWTPYIFRAIEENATPARLSATAESAAALLAS
                   250       260       270       280       290       300

310       320       330       340       350       360
orf10-1.pep ALCLTGIFSPLASLLLPENYAAVRFIVVSCMLPPLFCTLAEISGIGLNVVRKTRPIALAT
            ||||||||||||||||||||||||| |||||||||| ||:||||||||||||||||||||
orf10ng-1   ALCLTGIFSPLASLLLPENYAAVRFTVVSCMLPPLFYTLTEISGIGLNVVRKTRPIALAT
                   310       320       330       340       350       360

370       380       390       400       410       420
orf10-1.pep LGALAANLLLLGLAVPSGGARGAAVACAASFWLFFAFKTESSCRLWQPLKRLPLYLHTLF
            |||||||||||||||||||:|||||||||||||||:|||||||||||||||||||:||||
orf10ng-1   LGALAANLLLLGLAVPSGGTRGAAVACAASFWLFFVFKTESSCRLWQPLKRLPLYMHTLF
                   370       380       390       400       410       420

430       440       450       460       470
orf10-1.pep CLTSSAAYTCFGTPANYPLFAGVWAAYLAGCILRHRKDLHKLFHYLKKQGFPLX
            ||:||||||||||||||||||||||||||||||||||:|||||||||||||||
orf10ng-1   CLASSAAYTCFGTPANYPLFAGVWAAYLAGCILRHRKNLHKLFHYLKKQGFPLX
                   430       440       450       460       470
```

Based on this analysis, including the presence of a putative leader peptide and several transmembrane segments and the presence of a leucine-zipper motif (4 Leu residues spaced by 6 aa, shown in bold), it is predicted that these proteins from *N.meningitidis* and *N.gonorrhoeae*, and their epitopes, could be useful antigens for vaccines or diagnostics, or for raising antibodies.

Example 45

The following partial DNA sequence was identified in *N.meningitidis* (SEQ ID NO: 381):

```
  1 ..ATCCTGAAAC CGCATAACCA GCTTAAGGAA GACATCCAAC CTGATCCGGC
 51   CGATCAAAAC GCCTTGTCCG AACCGGATGC TGCGACAGAG GCAGAGCAGT
101   CGGATGCGGA AAATGCTGCC GACAAGCAGC CCGTTGCCGA TAAAGCCGAC
151   GAGGTTGAAG AAAAGGCGGG CGAGCCGGAA CGGGAAGAGC CGGACGGACA
201   GGCAGTGCGT AAGAAAGCGC TGACGGAAGA GCGTGAACAA ACCGTCAGGG
251   AAAAAGCGCA GAAGAAAGAT GCCGAAACGG TTAAAATACA AGCGGTAAAA
301   CCGTCTAAAG AAACAGAGAA AAAAGCTTCA AAAGAAGAGA AAAAGGCGGC
351   GAAGGAAAAA GTTGCACCCA AACCAACCCC GGAACAAATC CTCAACAGCG
```

```
401  GCAgCATCGA AAAmGCGCGC AgTGCCGCCG CCAAAGAAGT GCAGAAAATG

451  AA.AACGTCC GACAAGGCGG AAGC.AACGC ATTATCTGCA AATGGGCGCG

501  TATGCCGACC GTCAGAGCGC GGAAGGGCAG CGTGCCAAAC TGGCAATCTT

551  GGGCATATCT TCCAAGGTGG TCGGTTATCA GGCGGGACAT AAAACGCTTT

601  ACCGGGTGCA AAGCGGCAAT ATGTCTGCCG ATGCGGTGA
```

This corresponds to the amino acid sequence (SEQ ID NO: 382; OR65):

```
  1  ..ILKPHNQLKE DIQPDPADQN ALSEPDAATE AEQSDAENAA DKQPVADKAD

51  EVEEKAGEPE REEPDGQAVR KKALTEEREQ TVREKAQKKD AETVKIQAVK

101  PSKETEKKAS KEEKKAAKEK VAPKPTPEQI LNSGSIEXAR SAAAKEVQKM

151  XNVRQGGSXR IICKWARMPT VRARKGSVPN WQSWAYLPRW SVIRRDIKRF

201  TGCKAAICLP MR*
```

Further work revealed the complete nucleotide sequence (SEQ ID NO: 383):

```
  1  ATGTTTATGA ACAAATTTTC CCAATCCGGA AAAGGTCTGT CCGGTTTTTT

51  CTTCGGTTTG ATACTGGCGA CGGTCATTAT TGCCGGTATT TTGTTTTATC

101  TGAACCAGAG CGGTCAAAAT GCGTTCAAAA TCCCGGCTTC GTCGAAGCAG

151  CCTGCAGAAA CGGAAATCCT GAAACCGAAA AACCAGCCTA AGGAAGACAT

201  CCAACCTGAA CCGGCCGATC AAAACGCCTT GTCCGAACCG GATGCTGCGA

251  CAGAGGCAGA GCAGTCGGAT GCGGAAAAAG CTGCCGACAA GCAGCCCGTT

301  GCCGATAAAG CCGACGAGGT TGAAGAAAAG GCGGGCGAGC CGGAACGGGA

351  AGAGCCGGAC GGACAGGCAG TGCGTAAGAA AGCGCTGACG GAAGAGCGTG

401  AACAAACCGT CAGGGAAAAA GCGCAGAAGA AGATGCCGA AACGGTTAAA

451  AAACAAGCGG TAAAACCGTC TAAAGAAACA GAGAAAAAAG CTTCAAAAGA

501  AGAGAAAAAG GCGGCGAAGG AAAAAGTTGC ACCCAAACCA ACCCCGGAAC

551  AAATCCTCAA CAGCGGCAGC ATCGAAAAAG CGCGCAGTGC CGCCGCCAAA

601  GAAGTGCAGA AAATGAAAAC GTCCGACAAG GCGGAAGCAA CGCATTATCT

651  GCAAATGGGC GCGTATGCCG ACCGTCAGAG CGCGGAAGGG CAGCGTGCCA

701  AACTGGCAAT CTTGGGCATA TCTTCCAAGG TGGTCGGTTA TCAGGCGGGA

751  CATAAAACGC TTTACCGGGT GCAAAGCGGC AATATGTCTG CCGATGCGGT

801  GAAAAAAATG CAGGACGAGT TGAAAAAACA TGAAGTCGCC AGCCTGATCC

851  GTTCTATCGA AAGCAAATAA
```

This corresponds to the amino acid sequence (SEQ ID NO: 384; ORF65-1):

```
  1  MFMNKFSQSG KGLSGFFFGL ILATVIIAGI LFYLNQSGQN AFKIPASSKQ

51  PAETEILKPK NQPKEDIQPE PADQNALSEP DAATEAEQSD AEKAADKQPV
```

```
101  ADKADEVEEK AGEPEREEPD GQAVRKKALT EEREQTVREK AQKKDAETVK

151  KQAVKPSKET EKKASKEEKK AAKEKVAPKP TPEQILNSGS IEKARSAAAK

201  EVQKMKTSDK AEATHYLQMG AYADRQSAEG QRAKLAILGI SSKVVGYQAG

251  HKTLYRVQSG NMSADAVKKM QDELKKHEVA SLIRSIESK*
```

Computer analysis of this amino acid sequence gave the following results:
Homology with a Predicted ORF from *N.meningitidis* (Strain A)

ORF65 (SEQ ID NO: 382) shows 92.0% identity over a 150aa overlap with an ORF (ORF65a) (SEQ ID NO: 386) from strain A of *N. meningitidis*:

```
                                                    10         20         30
orf65.pep                                    ILKPHNQLKEDIQPDPADQNALSEPDAATE
                                             ||||:|| |||||:|||||||||||| |
orf65a      IIAGILFYLNQSGQNAFKIPVPSKQPAETEILKPKNQPKEDIQPEPADQNALSEPDAAKE
              30        40        50        60        70        80

40        50        60        70        80        90
orf65.pep   AEQSDAENAADKQPVADKADEVEEKAGEPEREEPDGQAVRKKALTEEREQTVREKAQKKD
            ||||||:||||||||||||||||||||||||| ||||||||||||||||||| ||||||
orf65a      AEQSDAEKAADKQPVADKADEVEEKADEPEREKSDGQAVRKKALTEEREQTVGEKAQKKD
              90       100       110       120       130       140

100       110       120       130       140       150
orf65.pep   AETVKIQAVKPSKETEKKASKEEKKAAKEKVAPKPTPEQILNSGSIEKARSAAAKEVQKM
            ||||| |||||||||||||||||||| |||||||||||||||||||||||||||||||||
orf65a      AETVKKQAVKPSKETEKKASKEEKKAEKEKVAPKPTPEQILNSGSIEKARSAAAKEVQKM
             150       160       170       180       190       200

160       170       180       190       200       210
orf65.pep   XNVRQGGSXRIICKWARMPTVRARKGSVPNWQSWAYLPRWSVIRRDIKRFTGCKAAICLP
orf65a      KTPDKAEATHYLQMGAYADRRSAEGQRAKLAILGISSKVVGYQAGHKTLYRVQSGNMSAD
             210       220       230       240       250       260
```

The complete length ORF65a nucleotide sequence (SEQ ID NO: 385) is:

```
  1  ATGTTTATGA ACAAATTTTC CCAATCCGGA AAAGGTCTGT CCGGTTTTTT

51  CTTCGGTTTG ATACTGGCGA CGGTCATTAT TGCCGGTATT TTGTTTTATC

101  TGAACCAGAG CGGTCAAAAT GCGTTCAAAA TCCCGGTTCC GTCGAAGCAG

151  CCTGCAGAAA CGGAAATCCT GAAACCGAAA AACCAGCCTA AGGAAGACAT

201  CCAACCTGAA CCGGCCGATC AAAACGCCTT GTCCGAACCG GATGCTGCGA

251  AAGAGGCAGA GCAGTCGGAT GCGGAAAAAG CTGCCGACAA GCAGCCCGTT

301  GCCGACAAAG CCGACGAGGT TGAGGAAAAG GCGGACGAGC CGGAGCGGGA

351  AAAGTCGGAC GGACAGGCAG TGCGCAAGAA AGCACTGACG GAAGAGCGTG

401  AACAAACCGT CGGGGAAAAA GCGCAGAAGA AAGATGCCGA AACGGTTAAA

451  AAACAAGCGG TAAAACCATC TAAAGAAACA GAGAAAAAAG CTTCAAAAGA

501  AGAGAAAAAG GCGGAGAAGG AAAAAGTTGC ACCCAAACCG ACCCCGGAAC

551  AAATCCTCAA CAGCGGCAGC ATCGAAAAAG CGCGCAGTGC CGCTGCCAAA

601  GAAGTGCAGA AAATGAAAAC GCCCGACAAG GCGGAAGCAA CGCATTATCT

651  GCAAATGGGC GCGTATGCCG ACCGCCGGAG CGCGGAAGGG CAGCGTGCCA

701  AACTGGCAAT CTTGGGCATA TCTTCCAAGG TGGTCGGTTA TCAGGCGGGA

751  CATAAACGC TTTACCGGGT GCAAAGCGGC AATATGTCTG CCGATGCGGT

801  GAAAAAATG CAGGACGAGT TGAAAAAACA TGAAGTCGCC AGCCTGATCC

851  GTTCTATCGA AAGCAAATAA
```

This encodes a protein having amino acid sequence (SEQ ID NO: 386):

```
  1 MFMNKFSQSG KGLSGFFFGL ILATVIIAGI LFYLNQSGQN AFKIPVPSKQ

51 PAETEILKPK NQPKEDIQPE PADQNALSEP DAAKEAEQSD AEKAADKQPV

101 ADKADEVEEK ADEPEREKSD GQAVRKKALT EEREQTVGEK AQKKDAETVK

151 KQAVKPSKET EKKASKEEKK AEKEKVAPKP TPEQILNSGS IEKARSAAAK

201 EVQKMKTPDK AEATHYLQMG AYADRRSAEG QRAKLAILGI SSKVVGYQAG

251 HKTLYRVQSG NMSADAVKKM QDELKKHEVA SLIRSIESK*
```

ORF65a (SEQ ID NO: 386) and ORF65-1 (SEQ ID NO: 384) show 96.5% identity in 289 aa

```
                    10         20         30         40         50         60
orf65a.pep  MFMNKFSQSGKGLSGFFFGLILATVIIAGILFYLNQSGQNAFKIPVPSKQPAETEILKPK
            |||||||||||||||||||||||||||||||||||||||||||:||||||||||||||||
orf65-1     MFMNKFSQSGKGLSGFFFGLILATVIIAGILFYLNQSGQNAFKIPASSKQPAETEILKPK
                    10         20         30         40         50         60

70         80         90        100        110        120
orf65a.pep  NQPKEDIQPEPADQNALSEPDAAKEAEQSDAEKAADKQPVADKADEVEEKADEPEREKSD
            ||||||||||||||||||||||| ||||||||||||||||||||||||||||||:|
orf65-1     NQPKEDIQPEPADQNALSEPDAATEAEQSDAEKAADKQPVADKADEVEEKAGEPEREEPD
                    70         80         90        100        110        120

130        140        150        160        170        180
orf65a.pep  GQAVRKKALTEEREQTVGEKAQKKDAETVKKQAVKPSKETEKKASKEEKKAEKEKVAPKP
            ||||||||||||||||||:|||||||||||||||||||||||||||||||:|||||||||
orf65-1     GQAVRKKALTEEREQTVREKAQKKDAETVKKQAVKPSKETEKKASKEEKKAAKEKVAPKP
                   130        140        150        160        170        180

190        200        210        220        230        240
orf65a.pep  TPEQILNSGSIEKARSAAAKEVQKMKTPDKAEATHYLQMGAYADRRSAEGQRAKLAILGI
            |||||||||||||||||||||||||||||:|||||||||||||||:||||||||||||||
orf65-1     TPEQILNSGSIEKARSAAAKEVQKMKTSDKAEATHYLQMGAYADRQSAEGQRAKLAILGI
                   190        200        210        220        230        240

250        260        270        280        290
orf65a.pep  SSKVVGYQAGHKTLYRVQSGNMSADAVKKMQDELKKHEVASLIRSIESKX
            ||||||||||||||||||||||||||||||||||||||||||||||||||
orf65-1     SSKVVGYQAGHKTLYRVQSGNMSADAVKKMQDELKKHEVASLIRSIESKX
                   250        260        270        280        290
```

Homology with a Predicted ORF from *N. gonorrhoeae*

ORF65 (SEQ ID NO: 382) shows 89.6% identity over a 212aa overlap with a predicted ORF (ORF65.ng) (SEQ ID NO: 388) from *N. gonorrhoeae*:

```
                    30         40         50         60         70         80
ORF65ng     IIAGILLYLNQGGQNAFKIPAPSKQPAETEILKLKNQPKEDIQPEPADQNALSEPDVAKE
                                      |||:|| ||||||:||||||||||||||:| |
ORF65                               ILKPHNQLKEDIQPDPADQNALSEPDAATE
                                              10         20         30

90        100        110        120        130        140
ORF65ng     AEQSDAEKAADKQPVADKADEVEEKAGEPEREEPDGQAVRKKALTEEREQTVREKAQKKD
            |||||:||||||||||||||||||||||||||||||||||||||||||||||||||||||
ORF65       AEQSDAENAADKQPVADKADEVEEKAGEPEREEPDGQAVRKKALTEEREQTVREKAQKKD
                    40         50         60         70         80         90

150        160        170        180        190        200
ORF65ng     AETVKKKAVKPSKETEKKASKEEKKAAKEKVAPKPTPEQILNSRSIEKARSAAAKEVQKM
            ||||| :||||||||||||||||||||||||||||||||||||||  ||||||||||||||
ORF65       AETVKIQAVKPSKETEKKASKEEKKAAKEKVAPKPTPEQILNSGSIEXARSAAAKEVQKM
                   100        110        120        130        140        150
```

```
                    210       220       230       240       250       260
ORF65ng  KNFGQGGSQRIICKWARMPNPGARKGSVPNWQSWAYLPKWSAIRRDIKRFTACKAAICPP
         |  ||||  |||||||||||: |||||||||||||||||:|:|||||||||:|||||| |
ORF65        XNVRQGGSXRIICKWARMPTVRARKGSVPNWQSWAYLPRWSVIRRDIKRFTGCKAAICLP
                  160       170       180       190       200       210

ORF65ng  MR
         ||
ORF65    MR
```

An ORF65ng nucleotide sequence (SEQ ID NO: 387) was predicted to encode a protein having amino acid sequence (SEQ ID NO: 388):

```
  1  MFMNKFSQSG KGLSGFFFGL ILATVIIAGI LLYLNQGGQN AFKIPAPSKQ

51  PAETEILKLK NQPKEDIQPE PADQNALSEP DVAKEAEQSD AEKAADKQPV

101  ADKADEVEEK AGEPEREEPD GQAVRKKALT EEREQTVREK AQKKDAETVK

151  KKAVKPSKET EKKASKEEKK AAKEKVAPKP TPEQILNSRS IEKARSAAAK

201  EVQKMKNFGQ GGSQRIICKW ARMPNPGARK GSVPNWQSWA YLPKWSAIRR

251  DIKRFTACKA AICPPMR*
```

After further analysis, the complete gonococcal DNA sequence (SEQ ID NO: 389) was found to be:

```
  1  ATGTTTATGA ACAAATTTTC CAATCCGGA  AAAGGTCTGT CCGGTTTCTT

51  CTTCGGTTTG ATACTGGCAA CGGTCATTAT TGCCGGTATT TTGCTTTATC

101  TGAACCAGGG CGGTCAAAAT GCGTTCAAAA TCCCGGCTCC GTCGAAGCAG

151  CCTGCAGAAA CGGAAATCCT GAAACTGAAA AACCAGCCTA AGGAAGACAT

201  CCAACCTGAA CCGGCCGATC AAAACGCCTT GTCCGAACCG GATGTTGCGA

251  AAGAGGCAGA GCAGTCGGAT GCGGAAAAAG CTGCCGACAA GCAGCCCGTT

301  GCCGACAAag ccgacgAGGT TGAAGAAAag GcGGgcgAgc cggaACGGga 351  aGAGCCGGAC ggACAGGCAG TGCGCAAGAA AGCACTGACg gAAGAgCGTG 401  AACAAACcgt cagggAAAAA GCGCagaaga AAGATGCCGA AACGgTTAAA 451  AAacaaGCgg tAaaaccgtc tAAAGAAACa gagaaaaaag cTtcaaaaga 501  agagaaaaag gcggcgaaag aaaAAGttgc acccaaaccg accccggaaC 551  aaatcctcaa cagccgCagc atcgaaaaag cgcgtagtgc cgctgccaaa 601  gaAgtgcaGA AAatgaaaaa ctTtgggcaa ggcgGaagcc aacgcattaT 651  CTGcaaatgg gcgcgtatgc cgaccgtccg gagcgcggaA gggcagcgtg 701  ccaaACtggc aAtcttgGgc atatctTccg aagtggtcgG CTATCAGGCG 751  GGACATAAAA CGCTTTACCG CGTGCAAagc GGCAatatgt ccgccgatgc 801  gGTGAAAAAA ATGCAGGACG AGTTGAAAAA GCATGGGGtt gcCAGCCTGA 851  TCCGTGCgAT TGAAGGCAAA TAA
```

This encodes the following amino acid sequence (SEQ ID NO: 390):

```
  1  MFMNKFSQSG KGLSGFFFGL ILATVIIAGI LLYLNQGGQN AFKIPAPSKQ

51  PAETEILKLK NQPKEDIQPE PADQNALSEP DVAKEAEQSD AEKAADKQPV
```

-continued

```
101  ADKADEVEEK AGEPEREEPD GQAVRKKALT EEREQTVREK AQKKDAETVK

151  KQAVKPSKET EKKASKEEKK AAKEKVAPKP TPEQILNSRS IEKARSAAAK

201  EVQKMKNFGQ GGSQRIICKW ARMPTVRSAE GQRAKLAILG ISSEVVGYQA

251  GHKTLYRVQS GNMSADAVKK MQDELKKHGV ASLIRAIEGK *
```

ORF65ng-1 (SEQ ID NO: 390) and ORF65-1 (SEQ ID NO: 384) show 89.0% identity in 290 aa overlap:

```
                   10         20         30         40         50         60
orf65-1.pep    MFMNKFSQSGKGLSGFFFGLILATVIIAGILFYLNQSGQNAFKIPASSKQPAETEILKPK
               |||||||||||||||||||||||||||||||:||||:||||||||| ||||||||||| |
orf65ng-1      MFMNKFSQSGKGLSGFFFGLILATVIIAGILLYLNQGGQNAFKIPAPSKQPAETEILKLK
                   10         20         30         40         50         60

70         80         90        100        110        120
orf65-1.pep    NQPKEDIQPEPADQNALSEPDAATEAEQSDAEKAADKQPVADKADEVEEKAGEPEREEPD
               ||||||||||||||||||||||||||:| ||||||||||||||||||||||||||||||
orf65ng-1      NQPKEDIQPEPADQNALSEPDVAKEAEQSDAEKAADKQPVADKADEVEEKAGEPEREEPD
                   70         80         90        100        110        120

130        140        150        160        170        180
orf65-1.pep    GQAVRKKALTEEREQTVREKAQKKDAETVKKQAVKPSKETEKKASKEEKKAAKEKVAPKP
               ||||||||||||||||||||||||||||||||||||||||||||||||||||||||||||
orf65ng-1      GQAVRKKALTEEREQTVREKAQKKDAETVKKQAVKPSKETEKKASKEEKKAAKEKVAPKP
                  130        140        150        160        170        180

190        200        210        220        230        239
orf65-1.pep    TPEQILNSGSIEKARSAAAKEVQKMKTSDKAEATHYL-QMGAYADRQSAEGQRAKLAILG
               ||||||||  |||||||||||||||||||:  ::  :  :  :  :    :|||||||||||||
orf65ng-1      TPEQILNSRSIEKARSAAAKEVQKMKNFGQGGSQRIICKWARMPTVRSAEGQRAKLAILG
                  190        200        210        220        230        240

240        250        260        270        280        290
orf65-1.pep    ISSKVVGYQAGHKTLYRVQSGNMSADAVKKMQDELKKHEVASLIRSIESKX
               |||:||||||||||||||||||||||||||||||||||||:||:||
orf65ng-1      ISSEVVGYQAGHKTLYRVQSGNMSADAVKKMQDELKKHGVASLIRAIEGKX
                250        260        270        280        290
```

On this basis, including the presence of a putative transmembrane domain in the gonococcal protein, it is predicted that the proteins from *N.meningitidis* and *N.gonorrhoeae*, and their epitopes, could be useful antigens for vaccines or diagnostics, or for raising antibodies.

Example 46

The following DNA sequence, believed to be complete, was identified in *N.meningitidis* (SEQ ID NO: 391):

```
  1  ATGAACCACG ACATCACTTT CCTCACCCTG TTCCTACTCG GTkTCTTCGG

51  CGGAAcGCAC TGCATCGGTA TGTGCGGCGG ATTAAGCAGC GcGTTTGs.s

101  TCCAACTCCC CCCGCATATC AACCGCTTTT GGCTGATCCT GCTGCTTAAC

151  ACAGGACGGG TAAGCAGCTA TACGGCAAtC GGCCTGATAC TCGGATTAAT

201  CGGACAGGTC GGCGTTTCAC TCGAcCAaAC CCGCGTCCTG CAGAATATTT

251  TATACACGGC CGCCAACCTC CTGCTGCTCT TTTTAGGCTT ATACTTGAGC

301  GGTATTTCTT CCTTGGCGGC AAAAATCGAG AAaATCGGCA AACCGATATG

351  GCGGAACCTG AACCCGATAC TCAACCGGCT GTTACCCATA AAATCCATAC

401  CCGCCTGCCT tGCGgTCGGA ATATTATGGG GCTGGCTGCC GTGCGGACTG

451  GTTTACAGCG CGTCGCTTTA CGCGCTGGGA AgCGGTAGTG CGGCAACGGG

501  CGGGTTATAT ATGCTTGCCT TTGCACTGGG TACGCTGCCC AATCTTtTAG

551  CAATCGGCAT TTTtTCCCTG CAACTGAAwA AAATCATGCA AAACCGATAT

601  ATCCGCCTGT GTACGGGATT ATCCGTATCA TTATGGGCAT TATGGAAACT

651  TGCCGTCCTG TGGCTGTAA
```

This corresponds to the amino acid sequence (SEQ ID NO: 392; ORF103):

```
  1  MNHDITFLTL FLLGXFGGTH CIGMCGGLSS AFXXQLPPHI NRFWLILLLN
 51  TGRVSSYTAI GLILGLIGQV GVSLDQTRVL QNILYTAANL LLLFLGLYLS
101  GISSLAAKIE KIGKPIWRNL NPILNRLLPI KSIPACLAVG ILWGWLPCGL
151  VYSASLYALG SGSAATGGLY MLAFALGTLP NLLAIGIFSL QLXKIMQNRY
201  IRLCTGLSVS LWALWKLAVL WL*
```

Further work elaborated the DNA sequence (SEQ ID NO: 393) as:

```
  1  ATGAACCACG ACATCACTTT CCTCACCCTG TTCCTACTCG GTTTCTTCGG
 51  CGGAACGCAC TGCATCGGTA TGTGCGGCGG ATTAAGCAGC GCGTTTGCGC
101  TCCAACTCCC CCCGCATATC AACCGCTTTT GGCTGATCCT GCTGCTTAAC
151  ACAGGACGGG TAAGCAGCTA TACGGCAATC GGCCTGATAC TCGGATTAAT
201  CGGACAGGTC GGCGTTTCAC TCGACCAAAC CCGCGTCCTG CAGAATATTT
251  TATACACGGC CGCCAACCTC CTGCTGCTCT TTTTAGGCTT ATACTTGAGC
301  GGTATTTCTT CCTTGGCGGC AAAAATCGAG AAAATCGGCA AACCGATATG
351  GCGGAACCTG AACCCGATAC TCAACCGGCT GTTACCCATA AAATCCATAC
401  CCGCCTGCCT TGCGGTCGGA ATATTATGGG GCTGGCTGCC GTGCGGACTG
451  GTTTACAGCG CGTCGCTTTA CGCGCTGGGA AGCGGTAGTG CGGCAACGGG
501  CGGGTTATAT ATGCTTGCCT TTGCACTGGG TACGCTGCCC AATCTTTTAG
551  CAATCGGCAT TTTTTCCCTG CAACTGAAAA AAATCATGCA AAACCGATAT
601  ATCCGCCTGT GTACGGGATT ATCCGTATCA TTATGGGCAT TATGGAAACT
651  TGCCGTCCTC TGGCTGTAA
```

This corresponds to the amino acid sequence (SEQ ID NO: 394; ORF103-1):

```
  1  MNHDITFLTL FLLGFFGGTH CIGMCGGLSS AFALQLPPHI NRFWLILLLN
 51  TGRVSSYTAI GLILGLIGQV GVSLDQTRVL QNILYTAANL LLLFLGLYLS
101  GISSLAAKIE KIGKPIWRNL NPILNRLLPI KSIPACLAVG ILWGWLPCGL
151  VYSASLYALG SGSAATGGLY MLAFALGTLP NLLAIGIFSL QLKKIMQNRY
201  IRLCTGLSVS LWALWKLAVL WL*
```

Computer analysis of this amino acid sequence gave the following results:
Homology with a Predicted ORF from N.meningitidis (Strain A)

ORF103 (SEQ ID NO: 392) shows 93.8% identity over a 222aa overlap with an ORF (ORF103a) (SEQ ID NO: 396) from strain A of N. meningitidis:

```
                        10         20         30         40         50         60
orf103.pep  MNHDITFLTLFLLGXFGGTHCIGMCGGLSSAFXXQLPPHINRFWLILLLNTGRVSSYTAI
            ||  |||||||||| ||||||||||||||||||  |||||||| ||||||||||||||||
orf103a     MNXDITFLTLFLLGFFGGTHCIGMCGGLSSAFALQLPPHINRXWLILLLNTGRVSSYTAI
                        10         20         30         40         50         60
```

```
                     70        80        90       100       110       120
orf103.pep  GLILGLIGQVGVSLDQTRVLQNILYTAANLLLLFLGLYLSGISSLAAKIEKIGKPIWRNL
            ||||||||||||||||||||| ||||||||||||||||||||||||||||||||||||
orf103a     GLILGLIGQVGVSLDQTRVXQNILYTAANLLLLFLGLYLSGISSLAAKIEKIGKPIWRNL
                     70        80        90       100       110       120

130       140       150       160       170       180
orf103.pep  NPILNRLLPIKSIPACLAVGILWGWLPCGLVYSASLYALGSGSAATGGLYMLAFALGTLP
            ||||||||||||||||||||||||||||||||||||||||||||||||||||||||||||
orf103a     NPILNRLLPIKSIPACLAVGILWGWLPCGLVYSASLYALGSGSAATGGLYMLAFALGTLP
                    130       140       150       160       170       180

190       200       210       220
orf103.pep  NLLAIGIFSLQLXKIMQNRYIRLCTGLSVSLWALWKLAVLWLX
            ||  ||||||||||||||||||||||||||||||||||||||
orf103a     NLXAIGIFSLQLXKIMQNRYIRLCTGLSVSLWALWKLAVLWLX
                    190       200       210       220
```

The complete length ORF103a nucleotide sequence (SEQ ID NO: 395) is:

```
  1  ATGAACCANG ACATCACTTT CCTCACCCTG TTCCTACTCG GTTTCTTCGG

51  CGGAACGCAC TGCATCGGTA TGTGCGGCGG ATTAAGCAGC GCGTTTGCGC

101  TCCAACTCCC CCCGCATATC AACCGCTTNT GGCTGATCCT GCTGCTTAAC

151  ACAGGACGGG TAAGCAGCTA TACGGCAATC GGCCTGATAC TCGGATTAAT

201  CGGACAGGTC GGCGTTTCAC TCGACCAAAC CCGCGTCNTG CAGAATATTT

251  TATACACGGC CGCCAACCTC CTGCTGCTCT TTTTAGGCTT ATACTTGAGC

301  GGTATTTCTT CCTTGGCGGC AAAAATCGAG AAAATCGGCA AACCGATATG

351  GCGGAACCTG AACCCGATAC TCAACCGGCT GTTACCCATA AAATCCATAC

401  CCGCCTGCCT TGCGGTCGGA ATATTATGGG GCTGGCTGCC GTGCGGACTA

451  GTTTACAGCG CGTCGCTTTA CGCGCTGGGA AGCGGTAGTG CGGCAACGGG

501  CGGGTTATAT ATGCTTGCCT TTGCACTGGG TACGCTGCCC AATCTTTNGG

551  CAATCGGCAT TTTTTCCCTG CAACTGNAAA AAATCATGCA AAACCGATAT

601  ATCCGCCTGT GTACGGGATT ATCCGTATCA TTATGGGCAT TATGGAAACT

651  TGCCGTCCTG TGGCTGTAA
```

This encodes a protein having amino acid sequence (SEQ ID NO: 396):

```
  1  MNXDITFLTL FLLGFFGGTH CIGMCGGLSS AFALQLPPHI NRXWLILLLN

51  TGRVSSYTAI GLILGLIGQV GVSLDQTRVX QNILYTAANL LLLFLGLYLS

101  GISSLAAKIE KIGKPIWRNL NPILNRLLPI KSIPACLAVG ILWGWLPCGL

151  VYSASLYALG SGSAATGGLY MLAFALGTLP NLXAIGIFSL QLXKIMQNRY

201  IRLCTGLSVS LWALWKLAVL WL*
```

ORF103a (SEQ ID NO: 396) and ORF103-1 (SEQ ID NO: 394) show 97.7% identity in 222 aa overlap:

```
                     10        20        30        40        50        60
orf103a.pep  MNXDITFLTLFLLGFFGGTHCIGMCGGLSSAFALQLPPHINRXWLILLLNTGRVSSYTAI
             || ||||||||||||||||||||||||||||||||||||||| ||||||||||||||||
orf103-1     MNHDITFLTLFLLGFFGGTHCIGMCGGLSSAFALQLPPHINRFWLILLLNTGRVSSYTAI
                     10        20        30        40        50        60
```

```
                    70        80        90       100       110       120
orf103a.pep GLILGLIGQVGVSLDQTRVXQNILYTAANLLLLFLGLYLSGISSLAAKIEKIGKPIWRNL
            |||||||||||||||||| |||||||||||||||||||||||||||||||||||||||||
orf103-1    GLILGLIGQVGVSLDQTRVLQNILYTAANLLLLFLGLYLSGISSLAAKIEKIGKPIWRNL
                    70        80        90       100       110       120

130       140       150       160       170       180
orf103a.pep NPILNRLLPIKSIPACLAVGILWGWLPCGLVYSASLYALGSGSAATGGLYMLAFALGTLP
            ||||||||||||||||||||||||||||||||||||||||||||||||||||||||||||
orf103-1    NPILNRLLPIKSIPACLAVGILWGWLPCGLVYSASLYALGSGSAATGGLYMLAFALGTLP
                   130       140       150       160       170       180

190       200       210       220
orf103a.pep NLXAIGIFSLQLXKIMQNRYIRLCTGLSVSLWALWKLAVLWLX
            ||  ||||||||| |||||||||||||||||||||||||||||
orf103-1    NLLAIGIFSLQLKKIMQNRYIRLCTGLSVSLWALWKLAVLWLX
                   190       200       210       220
```

Homology with a Predicted ORF from *N.gonorrhoeae*
ORF103 (SEQ ID NO: 392) shows 95.5% identity over a 222aa overlap with a predicted ORF (ORF103ng (SEQ ID NO: 398) from *N. gonorrhoeae*:

```
orf103.pep  MNHDITFLTLFLLGXFGGTHCIGMCGGLSSAFXXQLPPHINRFWLILLLNTGRVSSYTAI   60
            ||||||||||||||| |||||||||||||||||| ||||||||||||||||||:||||||
orf103ng    MNHDITFLTLFLLGFFGGTHCIGMCGGLSSAFALQLPPHINRFWLILLLNTGRISSYTAI   60 orf103.pep  GLILGLIGQVGVSLDQTRVLQNILYTAANLLLLFLGLYLSGISSLAAKIEKIGKPIWRNL  120
            ||:||||||:|:|||||||||||||||:||||||||||||||||||||||||||||||||
orf103ng    GLMLGLIGQLGISLDQTRVLQNILYTASNLLLLFLGLYLSGISSLAAKIEKIGKPIWRNL  120 orf103.pep  NPILNRLLPIKSIPACLAVGILWGWLPCGLVYSASLYALGSGSAATGGLYMLAFALGTLP  180
            |||||||||||||||||||||||||||||||||||||||||||||:||||||||||||||
orf103ng    NPILNRLLPIKSIPACLAVGILWGWLPCGLVYSASLYALGSGSATTGGLYMLAFALGTLP  180 orf103.pep  NLLAIGIFSLQLXKIMQNRYIRLCTGLSVSLWALWKLAVLWL                   222
            ||||||||||| ||||||||||||||||||||||||||||||
orf103ng    NLLAIGIFSLQLKKIMQNRYIRLCTGLSVSLWALWKLAVLWL                   222
```

The complete length ORF103ng nucleotide sequence (SEQ ID NO: 397) is:

```
  1 ATGAACCACG ACATCACTTT CCTCACCCTG TTCCTGCTCG GTTTCTTCGG

51 CGGAACTCAC TGCATCGGTA TGTGCGGCGG ATTAAGCAGC GCGTTTGCGC

101 TCCAACTCCC CCCGCATATC AACCGCTTTT GGCTGATTCT GCTGCTTAAC

151 ACAGGACGGA TAAGCAGCTA TACGGCAATC GGCCTGATGC TCGGATTAAT

201 CGGACAACTC GGCATTTCAC TCGACCAAAc ccgcgTCCTG CAAAATATTT 251 tatacacagc ctccaaCCTC CTGCTGCTCT TTTTAGGCTT ATACTTGAGC

301 GGTATTTCTT CCTTGGCGGC AAAAATCGAG AAAATCGGCA AACCGATATG

351 GCGCAACCTG AACCCGATAC TCAACCGGCT GCTGCCCATA AAATCCATAC

401 CCGCCTGCCT TGCTGTCGGA ATATTATGGG GCTGGCTGCC GTGCGGACTG

451 GTTTACAGCG CATCACTTTA CGCGCTGGGA AGCGGTAGTG CGACAACCGG

501 CGGACTGTAT ATGCTTGCCT TTGCACTGGG TACGCTGCCC AATCTTTTGG

551 CAATCGGCAT TTTTTCCCTG CAACTGAAAA AAATCATGCA AACCGATAT

601 ATCCGCCTGT GTACAGGATT ATCCGTATCA TTATGGGCAT TATGGAAGCT

651 TGCCGTCCTG TGGCTGTAA
```

This encodes a protein having amino acid sequence (SEQ ID NO: 398):

```
  1  MNHDITFLTL FLLGFFGGTH CIGMCGGLSS AFALQLPPHI NRFWLILLLN

51  TGRISSYTAI GLMLGLIGQL GISLDQTRVL QNILYTASNL LLLFLGLYLS

101  GISSLAAKIE KIGKPIWRNL NPILNRLLPI KSIPACLAVG ILWGWLPCGL

151  VYSASLYALG SGSATTGGLY MLAFALGTLP NLLAIGIFSL QLKKIMQNRY

201  IRLCTGLSVS LWALWKLAVL WL*
```

In addition, ORF103ng (SEQ ID NO: 398) and ORF103-1 (SEQ ID NO: 394) show 97.3% identity in 222 aa overlap:

```
                      10         20         30         40         50         60
orf103-1.pep  MNHDITFLTLFLLGFFGGTHCIGMCGGLSSAFALQLPPHINRFWLILLLNTGRVSSYTAI
              ||||||||||||||||||||||||||||||||||||||||||||||||||||:||||||
orf103ng      MNHDITFLTLFLLGFFGGTHCIGMCGGLSSAFALQLPPHINRFWLILLLNTGRISSYTAI
                      10         20         30         40         50         60

70         80         90        100        110        120
orf103-1.pep  GLILGLIGQVGVSLDQTRVLQNILYTAANLLLLFLGLYLSGISSLAAKIEKIGKPIWRNL
              ||:||||||:|:||||||||||||||||||:|||||||||||||||||||||||||||||
orf103ng      GLMLGLIGQLGISLDQTRVLQNILYTASNLLLLFLGLYLSGISSLAAKIEKIGKPIWRNL
                      70         80         90        100        110        120

130        140        150        160        170        180
orf103-1.pep  NPILNRLLPIKSIPACLAVGILWGWLPCGLVYSASLYALGSGSAATGGLYMLAFALGTLP
              |||||||||||||||||||||||||||||||||||||||||||:||||||||||||||||
orf103ng      NPILNRLLPIKSIPACLAVGILWGWLPCGLVYSASLYALGSGSATTGGLYMLAFALGTLP
                     130        140        150        160        170        180

190        200        210        220
orf103-1.pep  NLLAIGIFSLQLKKIMQNRYIRLCTGLSVSLWALWKLAVLWLX
              |||||||||||||||||||||||||||||||||||||||||||
orf103ng      NLLAIGIFSLQLKKIMQNRYIRLCTGLSVSLWALWKLAVLWLX
                     190        200        210        220
```

Based on this analysis, including the presence of a putative leader sequence (double-underlined) and several putative transmembrane domains (single-underlined) in the gonococcal protein, it is predicted that the proteins from N.meningitidis and N.gonorrhoeae, and their epitopes, could be useful antigens for vaccines or diagnostics, or for raising antibodies.

Example 47

The following partial DNA sequence was identified in N.meningitidis (SEQ ID NO: 399):

```
  1  ATGGAAAACC AAAGGCCGCT CCTAGGCTTT CGCTTGGCAC TTTTGGCGGC

51  GATGACGTGG GGAACGCTGC CGAT.TCCGT GCGGCAGGTA TTGAAGTTTG

101  TCGATGCGCC GACGCTGGTG TGGGTGCGTT TTACCGTGGC GGCGGCGGTA

151  TTGTTTGTTT TGCTGGCACT GGGCGGGCGG CTGCcGAAGC GGCGaGGATT

201  TTTCTTGGTG CTCATTCAGG CTGCTGCTGC TCGGCGTGGC GGGCATTTCG

251  GCAAACTTTG TGCTGATTGC CCAAGGGCTG CATTATATTT CGCCGACCAC

301  GACGCAGGTT TTGTGGCAGA TTTCGCCGTT TACGATGATT GTwGTCGGTG

351  TGTTGGTGTT TAAAGACCGG ATGACTGCCG CTCAGAAAAT CGGCTTGGTT

401  TTGCTGCTTG CCGGTTTGCT TATGTATTTT AACGATAAAT TCGGCGAGTT

451  GTCGGGTTTG GGCGCGTATG C.AAGGGCGT GTTGCTGTGT GCGGCAGGCA

501  GTATGGCATG GGTGTGTAAT GCCGTGGCGC AAAAGCTGCT GTCGGCGCAA

551  TTCGGGCCGC AACAGATTCT GCTGTTGATT TATGCGGCAA GTGCCGCCGT
```

```
-continued
601 GTTCCTGCCG TTTGCCGAAC CGGCACACAT CGGAAGTATG GACGGTACGT

651 TGGCGTGGGT ATGTATTGCG TATTGCTGCT TGAATACGTT AATCGGTTAC

701 GGCTCGTTCG GCGAGGCGTT GAAACATTGG GAGGCTTCCA AAGTCAGCGC

751 GGTAACAACC TTGCTCCCCG TGTTTACCGT AATAAATACT TTGCTCGGGC

801 ATTATGTGAT GCCTGAAACT TTTGCCGCGC CGGA..
```

This corresponds to the amino acid sequence (SEQ ID NO: 400; ORF104):

```
  1 MENQRPLLGF RLALLAAMTW GTLPXSVRQV LKFVDAPTLV WVRFTVAAAV

51 LFVLLALGGR LPKRRDFSWC SFRLLLLGVA GISANFVLIA QGLHYISPTT

101 TQVLWQISPF TMIVVGVLVF KDRMTAAQKI GLVLLLAGLL MYFNDKFGEL

151 SGLGAYXKGV LLCAAGSMAW VCNAVAQKLL SAQFGPQQIL LLIYAASAAV

201 FLPFAEPAHI GSMDGTLAWV CIAYCCLNTL IGYGSFGEAL KHWEASKVSA

251 VTTLLPVFTV INTLLGHYVM PETFAAP...
                                              25
```

Further work revealed further partial DNA sequence (SEQ ID NO: 401):

```
  1 ATGGAAAACC AAAGGCCGCT CCTAGGCTTC GCGTTGGCAC TTTTGGCGGC

51 GATGACGTGG GGAACGCTGC CGATTGCCGT GCGGCAGGTA TTGAAGTTTG

101 TCGATGCGCC GACGCTGGTG TGGGTGCGTT TTACCGTGGC GGCGGCGGTA

151 TTGTTTGTTT TGCTGGCACT GGGCGGCGG CTGCCGAAGC GGCGGGATTT

201 TTCTTGGTGC TCATTCAGGC TGCTGCTGCT CGGCGTGGCG GGCATTTCGG

251 CAAACTTTGT GCTGATTGCC CAAGGGCTGC ATTATATTTC GCCGACCACG

301 ACGCAGGTTT TGTGGCAGAT TTCGCCGTTT ACGATGATTG TTGTCGGTGT

351 GTTGGTGTTT AAAGACCGGA TGACTGCCGC TCAGAAAATC GGCTTGGTTT

401 TGCTGCTTGC CGGTTTGCTT ATGTTTTTTA ACGATAAATT CGGCGAGTTG

451 TCGGGTTTGG GCGCGTATGC GAAGGGCGTG TTGCTGTGTG CGGCAGGCAG

501 TATGGCATGG GTGTGTTATG CCGTGGCGCA AAAGCTGCTG TCGGCGCAAT

551 TCGGGCCGCA ACAGATTCTG CTGTTGATTT ATGCGGCAAG TGCCGCCGTG

601 TTCCTGCCGT TTGCCGAACC GGCACACATC GGAAGTTTGG ACGGTACGTT

651 GGCGTGGGTT TGTTTTGCGT ATTGCTGCTT GAATACGTTA ATCGGTTACG

701 GCTCGTTCGG CGAGGCGTTG AAACATTGGG AGGCTTCCAA AGTCAGCGCG

751 GTAACAACCT TGCTCCCCGT GTTTACCGTA ATAwTwwCTT TGCTCGGGCA

801 TTATGTCATG CCTGAAACTT TTGCCGCGCC GGA...
```

This corresponds to the amino acid sequence (SEQ ID NO: 402; ORF104-1):

```
  1 MENQRPLLGF ALALLAAMTW GTLPIAVRQV LKFVDAPTLV WVRFTVAAAV

51 LFVLLALGGR LPKRRDFSWC SFRLLLLGVA GISANFVLIA QGLHYISPTT
```

-continued

```
101 TQVLWQISPF TMIVVGVLVF KDRMTAAQKI GLVLLLAGLL MFFNDKFGEL

151 SGLGAYAKGV LLCAAGSMAW VCYAVAQKLL SAQFGPQQIL LLIYAASAAV

201 FLPFAEPAHI GSLDGTLAWV CFAYCCLNTL IGYGSFGEAL KHWEASKVSA

251 VTTLLPVFTV IXXLLGHYVM PETFAAP...
```

Computer analysis of this amino acid sequence gave the following results:
Homology with Hypothetical HI0878 Protein (SEQ ID NO: 1138) of *H. influenzae* (Accession Number U32769)

ORF104 (SEQ ID NO: 400) and HI0878 (SEQ ID NO: 1138) show 40% aa identity in 277aa overlap:

```
orf104    4 QRPLLGFRLALLAAMTWGTLPXSVRQVLKFVDAPTLVWXXXXXXXXXXXXXXXXXXXXP-   62
            Q+PLLGF  AL+ AM WG+LP +++QVL  ++A T+VW                    P
HI0878    3 QQPLLGFTFALITAMAWGSLPIALKQVLSVMNAQTIVWYRFIIAAVSLLALLAYKKQLPE   62 orf104   63 --KRRDFSWCSFRLLLLGVAGISANFVLIAQGLHYISPTTTQVLWQISPFTMIVVGVLVF  120
              K R ++W    ++L+GV G+++NF+L +  L+YI P+  Q+   +S P M++ GVL+F
HI0878   63 LMKVRQYAW----IMLIGVIGLTSNFLLFSSSLNYIEPSVAQIFIHLSSFGMLICGVLIF  118 orf104  121 KDRMTAAQKIXXXXXXXXXXXMYFNDKFGELSGLGAYXKGVLLCAAGSMAWVCNAVAQKLL  180
              K+++   QKI           ++FND+F  +GL Y  GV+L  G++ WV   +AQKL+
HI0878  119 KEKLGLHQKIGLFLLLIGLGLFFNDRFDAFAGLNQYSTGVILGVGGALIWVAYGMAQKLM  178 orf104  181 SAQFGPQQILLLIYAASAAVFLPFAEPAHIGSMDGTLAWVCIAYCCLNTLIGYGSFGEAL  240
              +F  QQILL++Y  A  F+P A+ + +   +    LA +C  YCCLNTLIGYGS+ EAL
HI0878  179 LRKFNSQQILLMMYLGCAIAFMPMADFSQVQELT-PLALICFIYCCLNTLIGYGSYAEAL  237 orf104  241 KHWEASKVSAVTTLLPVFTVINTLLGHYVMPETFAAP                         277
              W+ SKVS V TL+P+FT++ + + HY  P  FAAP
HI0878  238 NRWDVSKVSVVITLVPLFTILFSHIAHYFSPADFAAP                         274
```

Homology with a Predicted ORF from *N.meningitidis* (Strain A)

ORF104 (SEQ ID NO: 400) shows 95.3% identity over a 277aa overlap with an ORF (ORF104a) (SEQ ID NO: 404) from strain A of *N. meningitidis*:

```
                    10        20        30        40        50        60
orf104.pep  MENQRPLLGFRLALLAAMTWGTLPXSVRQVLKFVDAPTLVWVRFTVAAAVLFVLLALGGR
            |||||||||| |||||||||||||| :|||||||||||||||||||||||||||||||||
orf104a     MENQRPLLGFALALLAAMTWGTLPIAVRQVLKFVDAPTLVWVRFTVAAAVLFVLLALGGR
                    10        20        30        40        50        60

70        80        90       100       110       120
orf104.pep  LPKRRDFSWCSFRLLLLGVAGISANFVLIAQGLHYISPTTTQVLWQISPFTMIVVGVLVF
            ||| ||||||||||||||||||||||||||||||||||||||||||||||||||||||||
orf104a     LPKWRDFSWCSFRLLLLGVAGISANFVLIAQGLHYISPTTTQVLWQISPFTMIVVGVLVF
                    70        80        90       100       110       120

130       140       150       160       170       180
orf104.pep  KDRMTAAQKIGLVLLLAGLLMYFNDKFGELSGLGAYXKGVLLCAAGSMAWVCNAVAQKLL
            |||||||||||||||||||||:|||||||||||||| |||||||||||||||  |||||||
orf104a     KDRMTAAQKIGLVLLLAGLLMFFNDKFGELSGLGAYAKGVLLCAAGSMAWVCYAVAQKLL
                   130       140       150       160       170       180

190       200       210       220       230       240
orf104.pep  SAQFGPQQILLLIYAASAAVFLPFAEPAHIGSMDGTLAWVCIAYCCLNTLIGYGSFGEAL
            ||||||||||||||||||||||||| |||:||||||:|||||||||||||||||||||||
orf104a     SAQFGPQQILLLIYAASAAVFLPFAELAHIGSLDGTLAWVCFAYCCLNTLIGYGSFGEAL
                   190       200       210       220       230       240

250       260       270
orf104.pep  KHWEASKVSAVTTLLPVFTVINTLLGHYVMPETFAAP
            |||||||||||||||||||||:||||||||:|||||
orf104a     KHWEASKVSAVTTLLPVFTVIFSLLGHYVMPDTFAAPDMNGLGYAGALVVVGGAVTAAVG
                   250       260       270       280       290       300
```

The complete length ORF104a nucleotide sequence (SEQ ID NO: 403) is:

```
  1 ATGGAAAACC AAAGGCCGCT CCTAGGCTTC GCGTTGGCAC TTTTGGCGGC
 51 GATGACGTGG GGAACGCTGC CGATTGCCGT GCGGCAGGTA TTGAAGTTTG
101 TCGATGCGCC GACGCTGGTG TGGGTGCGTT TTACCGTGGC GGCGGCGGTA
151 TTGTTTGTTT TGCTGGCATT GGGCGGGCGG CTGCCGAAGT GGCGGGATTT
201 TTCTTGGTGC TCATTCAGGC TGCTGCTGCT CGGCGTGGCG GGCATTTCGG
251 CAAACTTTGT GCTGATTGCC CAAGGGCTGC ATTATATTTC GCCGACCACG
301 ACGCAGGTTT TGTGGCAGAT TCGCCGTTT ACGATGATTG TTGTCGGTGT
351 GTTGGTGTTT AAAGACCGGA TGACTGCCGC TCAGAAAATC GGCTTGGTTT
401 TGCTGCTTGC CGGTTTGCTT ATGTTTTTTA ACGATAAATT CGGCGAGTTG
451 TCGGGTTTGG GCGCGTATGC GAAGGGCGTG TTGCTGTGTG CGGCAGGCAG
501 TATGGCATGG GTGTGTTATG CCGTGGCGCA AAAGCTGCTG TCGGCGCAAT
551 TCGGGCCGCA ACAGATTCTG CTGTTGATTT ATGCGGCAAG TGCCGCCGTG
601 TTCCTGCCGT TTGCCGAACT GGCACACATC GGAAGTTTGG ACGGTACGTT
651 GGCGTGGGTT TGTTTTGCGT ATTGCTGCTT GAATACGTTA ATCGGTTACG
701 GCTCGTTCGG CGAGGCGTTG AAACATTGGG AGGCTTCCAA AGTCAGCGCG
751 GTAACAACCT TGCTCCCCGT GTTTACCGTA ATATTTTCTT TGCTCGGGCA
801 TTATGTGATG CCTGATACTT TTGCCGCGCC GGATATGAAC GGTTTGGGTT
851 ATGCCGGCGC ACTGGTCGTG GTCGGGGGTG CGGTTACGGC GGCGGTGGGG
901 GACAGGCTGT TCAAACGCCG CTAG
```

This encodes a protein having amino acid sequence (SEQ ID NO: 404):

```
  1 MENQRPLLGF ALALLAAMTW GTLPIAVRQV LKFVDAPTLV WVRFTVAAAV
 51 LFVLLALGGR LPKWRDFSWC SFRLLLLGVA GISANFVLIA QGLHYISPTT
101 TQVLWQISPF TMIVVGVLVF KDRMTAAQKI GLVLLLAGLL MFFNDKFGEL
151 SGLGAYAKGV LLCAAGSMAW VCYAVAQKLL SAQFGPQQIL LLIYAASAAV
201 FLPFAELAHI GSLDGTLAWV CFAYCCLNTL IGYGSFGEAL KHWEASKVSA
251 VTTLLPVFTV IFSLLGHYVM PDTFAAPDMN GLGYAGALVV VGGAVTAAVG
301 DRLFKRR*
```

ORF104a (SEQ ID NO: 404) and ORF104-1 (SEQ ID NO: 402) show 98.2% identity in 277 aa overlap:

```
                    10        20        30        40        50        60
orf104a.pep MENQRPLLGFALALLAAMTWGTLPIAVRQVLKFVDAPTLVWVRFTVAAAVLFVLLALGGR
            ||||||||||||||||||||||||||||||||||||||||||||||||||||||||||||
orf104-1    MENQRPLLGFALALLAAMTWGTLPIAVRQVLKFVDAPTLVWVRFTVAAAVLFVLLALGGR
                    10        20        30        40        50        60

70        80        90       100       110       120
orf104a.pep LPKWRDFSWCSFRLLLLGVAGISANFVLIAQGLHYISPTTTQVLWQISPFTMIVVGVLVF
            |||  |||||||||||||||||||||||||||||||||||||||||||||||||||||||
orf104-1    LPKRRDFSWCSFRLLLLGVAGISANFVLIAQGLHYISPTTTQVLWQISPFTMIVVGVLVF
                    70        80        90       100       110       120
```

```
                  130       140       150       160       170       180
orf104a.pep KDRMTAAQKIGLVLLLAGLLMFFNDKFGELSGLGAYAKGVLLCAAGSMAWVCYAVAQKLL
            ||||||||||||||||||||||||||||||||||||||||||||||||||||||||||||
orf104-1    KDRMTAAQKIGLVLLLAGLLMFFNDKFGELSGLGAYAKGVLLCAAGSMAWVCYAVAQKLL
                  130       140       150       160       170       180

190       200       210       220       230       240
orf104a.pep SAQFGPQQILLLIYAASAAVFLPFAELAHIGSLDGTLAWVCFAYCCLNTLIGYGSFGEAL
            |||||||||||||||||||||||||||| |||||||||||||||||||||||||||||||
orf104-1    SAQFGFQQILLLIYAASAAVFLPFAEPAHIGSLDGTLAWVCFAYCCLNTLIGYGSFGEAL
                  190       200       210       220       230       240

250       260       270       280       290       300
orf104a.pep KHWEASKVSAVTTLLPVFTVIFSLLGHYVMPDTFAAPDMNGLGYAGALVVVGGAVTAAVG
            |||||||||||||||||||||| ||||||||:|||||
orf104-1    KHWEASKVSAVTTLLPVFTVIXXLLGHYVMPETFAAP
                  250       260       270
```

Homology with a Predicted ORF from *N.gonorrhoeae*

ORF104 (SEQ ID NO: 400) shows 93.9% identity over a 277aa overlap with a predicted ORF (ORF104.ng) (SEQ ID NO: 406) from *N. gonorrhoeae*:

```
orf104.pep  MENQRPLLGFRLALLAAMTWGTLPXSVRQVLKFVDAPTLVWVRFTVAAAVLFVLLALGGR   60
            ||||||||| ||||||||||||||| :|||||||||||||||||||||||||||||||||
orf104ng    MENQRPLLGFALALLAAMTWGTLPIAVRQVLKFVDAPTLVWVRFTVAAAVLFVLLALGGR   60 orf104.pep  LPKRRDFSWCSFRLLLLGVAGISANFVLIAQGLHYISPTTTQVLWQISPFTMIVVGVLVF  120
            ||||||||| ||||||||| :|||||||||||||||||||||||||||||||||||||||
orf104ng    LPKRRDFSWHSFRLLLLGVTGISANFVLIAQGLHYISPTTTQVLWQISPFTMIVVGVLVF  120 orf104.pep  KDRMTAAQKIGLVLLLAGLLMYFNDKFGELSGLGAYXKGVLLCAAGSMAWVCNAVAQKLL  180
            ||||||||||||||| :||||:|||||||||||||| |||||||||||||||| ||||||
orf104ng    KDRMTAAQKIGLVLLLVGLLMFFNDKFGELSGLGAYAKGVLLCAAGSMAWVCYAVAQKLL  180 orf104.pep  SAQFGPQQILLLIYAASAAVFLPFAEPAHIGSMDGTLAWVCIAYCCLNTLIGYGSFGEAL  240
            |||||||||||||||||||||||| ||||||||:||||||||::||||||||||||||||
orf104ng    SAQFGPQQILLLIYAASAAVFLLXAEPAHIGSLDGTLAWVCFVYCCLNTLIGYGSFGEAL  240 orf104.pep  KHWEASKVSAVTTLLPVFTVINTLLGHYVMPETFAAP                        277
            |||||||||||||||||||| :||||||||:||||||
orf104ng    KHWEASKVSAVTTLLPVFTVIFSLLGHYVMPDTFAAPDMNGLGYVGALVVVGGAVTAAVG  300
```

The complete length ORF104ng nucleotide sequence (SEQ ID NO: 405) is predicted to encode a protein having amino acid sequence (SEQ ID NO: 406):

```
  1  MENQRPLLGF ALALLAAMTW GTLPIAVRQV LKFVDAPTLV WVRFTVAAAV

51  LFVLLALGGR LPKRRDFSWH SFRLLLLGVT GISANFVLIA QGLHYISPTT

101  TQVLWQISPF TMIVVGVLVF KDRMTAAQKI GLVLLLVGLL MFFNDKFGEL

151  SGLGAYAKGV LLCAAGSMAW VCYAVAQKLL SAQFGPQQIL LLIYAASAAV

201  FLLXAEPAHI GSLDGTLAWV CFVYCCLNTL IGYGSFGEAL KHWEASKVSA

251  VTTLLPVFTV IFSLLGHYVM PDTFAAPDMN GLGYVGALVV VGGAVTAAVG

301  DRPFKRR*
```

Further work revealed the complete gonococcal nucleotide sequence (SEQ ID NO: 407):

```
  1  ATGGAAAACC AAAGGCCGCT CCTAGGCTTC GCGTTGGCAC TTTTGGCGGC

51  GATGACGTGG GGGACGCTGC CGATTGCCGT GCGGCAGGTA TTGAAGTTTG
```

-continued

```
101   TCGATGCGCC GACGCTGGTG TGGGTGCGTT TTACCGTGGC GGCGGCGGTA

151   TTGTTTGTTT TGCTGGCATT GGGCGGGCGG CTGCCGAAGC GGCGGGATTT

201   TTCTTGGCAT TCATTCAGGC TGCTGCTGCT CGGCGTGACG GGCATTTCGG

251   CAAACTTTGT GCTGATTGCC CAAGGGCTGC ATTATATTTC GCCGACCACG

301   ACGCAGGTTT TGTGGCAGAT TTCGCCGTTT ACGATGATTG TTGTCGGCGT

351   GTTGGTGTTT AAAGACCGGA tgaCTGCCGC GCAGAAAATC GGTTTGGTTT

401   TGCTGCttgT CGGTttgCTT ATGTTTTtta ACGACAAATT CGGCGAGTTG

451   TCGGGTTTGG GCGCGTATGC GAAGGGCGTG TTGCTGTGTG CGGCAGGCAG

501   TATGGCCTGG GTGTGTTATG CCGTGGCGCA AAAGCTGCTG TCGGCGCAAT

551   TCGGGCCGCA ACAGATTCTG CTGTTGATTT ATGCGGcaag tgccgccGTG

601   TTCCtgccgT TTGccgaaCC GGCACACATC GGAAGTTTgg aCGGTACGtt

651   GGCGTGGGTT TGTTTTGTGT ATTGCTGCTT GAATACGTTA ATCGGTTACG

701   GCTCGTTCGG CGAGGCGTTG AAACATTGGG AGGCTTCCAA AGTCAGCGCG

751   GTAACAACCT TGCTCCCCGT GTTTACCGTA ATATTTTCTT TGCTCGGGCA

801   TTATGTGATG CCTGATACTT TTGCCGCGCC GGATATGAAC GGTTTGGGTT

851   ATGTCGGCGC ACTGGTCGTG GTCGGGGGTG CGGTTACGGC GGCGGTGGGG

901   GACAGGCCGT TCAAACGCCG CTAG
```

This corresponds to the amino acid sequence (SEQ ID NO: 408; ORF104ng-1):

```
  1   MENQRPLLGF ALALLAAMTW GTLPIAVRQV LKFVDAPTLV WVRFTVAAAV

51   LFVLLALGGR LPKRRDFSWH SFRLLLLGVT GISANFVLIA QGLHYISPTT

101   TQVLWQISPF TMIVVGVLVF KDRMTAAQKI GLVLLLVGLL MFFNDKFGEL

151   SGLGAYAKGV LLCAAGSMAW VCYAVAQKLL SAQFGPQQIL LLIYAASAAV

201   FLPFAEPAHI GSLDGTLAWV CFVYCCLNTL IGYGSFGEAL KHWEASKVSA

251   VTTLLPVFTV IFSLLGHYVM PDTFAAPDMN GLGYVGALVV VGGAVTAAVG

301   DRPFKRR*
```

ORF104ng-1 (SEQ ID NO: 408) and ORF104-1 (SEQ ID NO: 402) show 97.5% identity in 277 aa overlap:

```
                    10         20         30         40         50         60
orf104-1.pep  MENQRPLLGFALALLAAMTWGTLPIAVRQVLKFVDAPTLVWVRFTVAAAVLFVLLALGGR
              ||||||||||||||||||||||||||||||||||||||||||||||||||||||||||||
orf104ng-1    MENQRPLLGFALALLAAMTWGTLPIAVRQVLKFVDAPTLVWVRFTVAAAVLFVLLALGGR
                    10         20         30         40         50         60

70         80         90        100        110        120
orf104-1.pep  LPKRRDFSWCSFRLLLLGVAGISANFVLIAQGLHYISPTTTQVLWQISPFTMIVVGVLVF
              |||||||||  |||||||||:|||||||||||||||||||||||||||||||||||||||
orf104ng-1    LPKRRDFSWHSFRLLLLGVTGISANFVLIAQGLHYISPTTTQVLWQISPFTMIVVGVLVF
                    70         80         90        100        110        120

130        140        150        160        170        180
orf104-1.pep  KDRMTAAQKIGLVLLLAGLLMFFNDKFGELSGLGAYAKGVLLCAAGSMAWVCYAVAQKLL
              ||||||||||||||||:|||||||||||||||||||||||||||||||||||||||||||
orf104ng-1    KDRMTAAQKIGLVLLLVGLLMFFNDKFGELSGLGAYAKGVLLCAAGSMAWVCYAVAQKLL
                   130        140        150        160        170        180
```

```
                        -continued
                190       200       210       220       230       240
orf104-1.pep   SAQFGPQQILLLIYAASAAVFLPFAEPAHIGSLDGTLAWVCFAYCCLNTLIGYGSFGEAL
               ||||||||||||||||||||||||||||||||||||||||||:|||||||||||||||||
orf104ng-1     SAQFGPQQILLLIYAASAAVFLPFAEPAHIGSLDGTLAWVCFVYCCLNTLIGYGSFGEAL
                190       200       210       220       230       240

250       260       270
orf104-1.pep   KHWEASKVSAVTTLLPVFTVIXXLLGHYVMPETFAAP
               ||||||||||||||||||| |||||||:|||||
orf104ng-1     KHWEASKVSAVTTLLPVFTVIFSLLGHYVMPDTFAAPDMNGLGYVGALVVVGGAVTAAVG
                250       260       270       280       290       300
```

In addition, ORF104ng-1 (SEQ ID NO: 408) shows significant homology with a hypothetical *H.influenzae* protein (SEQ ID NO: 1138):

```
gi|1573895 (U32769) hypothetical [Haemophilus influenzae] Length = 306
  Score = 237 bits (598), Expect = 8e-62
  Identities = 114/280 (40%), Positives = 168/280 (59%), Gaps = 8/280 (2%)

Query:   30 QRPXXXXXXXXXXXXMTWGTLPIAVRQVLKFVDAPTLVWXXXXXXXXXXXXXXXXXXXXP-   88
            Q+P             M WG+LPIA++QVL  ++A T+VW                    P
Sbjct:    3 QQPLLGFTFALITAMAWGSLPIALKQVLSVMNAQTIVWYRFIIAAVSLLALLAYKKQLPE   62

Query:   89 --KRRDFSWHSFRLLLLGVTGISANFVLIAQGLHYISPTTTQVLWQISPFTMIVVGVLVF   146
              K R ++W    ++L+GV G+++NF+L +  L+YI P+   Q+   +S F M++ GVL+F
Sbjct:   63 LMKVRQYAW----IMLIGVIGLTSNFLLFSSSLNYIEPSVAQIFIHLSSFGMLICGVLIF   118

Query:  147 KDRMTAAQKIXXXXXXXXXXXMFFNDKFGELSGLGAYAKGVLLCAAGSMAWVCYAVAQKLL   206
            K+++   QKI           +FFND+F   +GL  Y+ GV+L   G++ WV Y +AQKL+
Sbjct:  119 KEKLGLHQKIGLFLLLIGLGLFFNDRFDAFAGLNQYSTGVILGVGGALIWVAYGMAQKLM   178

Query:  207 SAQFGPQQILLLIYAASAAVFLPFAEPAHIGSLDGTLAWVCFVYCCLNTLIGYGSFGEAL   266
              +F  QQILL++Y  A  F+P A+ + +   L   LA +CF+YCCLNTLIGYGS+ EAL
Sbjct:  179 LRKFNSQQILLMMYLGCAIAFMPMADFSQVQELT-PLALICFIYCCLNTLIGYGSYAEAL   237

Query:  267 KHWEASKVSAVTTLLPVFTVIFSLLGHYVMPDTFAAPDMN                      306
            W+ SKVS V TL+P+FT++FS + HY  P  FAAP++N
Sbjct:  238 NRWDVSKVSVVITLVPLFTILFSHIAHYFSPADFAAPELN                      277
```

Based on this analysis, including the presence of a putative leader sequence and several putative transmembrane domains in the gonococcal protein, it is predicted that the proteins from *N.meningitidis* and *N.gonorrhoeae*, and their epitopes, could be useful antigens for vaccines or diagnostics, or raising antibodies.

Example 48

The following partial DNA sequence was identified in *N.meningitidis* (SEQ ID NO: 409):

```
  1 ATGGTAGCTC GTCGGGCTCA TAACCCGAAG GTCGTAGGTT CGAATCCTGT
 51 .CCCGCAACC TAATTTCAAA CCCCTCGGTT CAATGCCGAG GG.GTTTTGT
101 T.TTGCCTGT TTCCTGTTTC CTGTTTCCTG CCGCCTCCGT TTTTTGCCGG
151 ATTTTCCTTC CGGCCGCAAT ATCGGAACGG CAGACCGCCG TCTGTTTGCG
201 GTTGCAAATT CAGGCAGTTT GGCTACAATC TTCCGCATTG TCTTCAAGAA
251 AGCCAACCAT GCCGACCGTC CGTTTTACCG AATCCGTCAG CAAACAAGAC
301 CTTGATGCTC TGTTCGAGTG GGCAAAAGCA AGTTACGGTG CAGAAAGTTG
351 CTGGAAAACG CTGTATCTGA ACGGTCysCC TTTGGGCAAC CTGTCGCCGG
401 AATGGGTGGA ACGCGTsmmA AAAGACTGGG AGGCAGGCTG CyCGGAGTCT
451 TCAGACGGCA TTTTTCTGAA TgCGGACGGc TGgCctGATA TGGgCGGAcg
501 cTTACAGCAC CTCGCCCTCG GTTGGCACTG TGCGGGGCTG TTGGACGgsT
551 GGCGCAACGA GTGTTTCGAC CTGACCGACG GCGGCGGCAA CCCCTTGTTC
```

```
-continued
601  ACGCTCGaAc GCGCCGyTTT mCGTCCTkTC GGACTGCTCA GCCGCGCCGT

651  CCATCTCAAC GGTCTGACCG AATCGGACGG CCGATGGCAT TTCTGGATAG

701  GCAGGCGCAG TCCGCACAAA GCAGTCGATC CCAACAAACT CGACAATACT 751  rCCGCCGGCG GTGTTTCCGG CGGCGAAATG CCGTCTGAAG CCGTGTGTCG

801  CGAAAGCAGC GAAGAAGCCG GTTTGGATAA AACGCTGcTT CCGCTCATCC

851  GCCCGGTATC GCAGCTGCAC AGCCTGCGCT CCGTCAGCCG GGGTGTACAC

901  AATGAAATCC TGTATGTATT CGATGCCGTC CTGCCG...
```

This corresponds to the amino acid sequence (SEQ ID NO: 410; ORF105):

```
  1  MVARRAHNPK VVGSNPXPAT XFQTPRFNAE XVLXLPVSCF LFPAASVFCR

51  IFLPAAISER QTAVCLRLQI QAVWLQSSAL SSRKPTMPTV RFTESVSKQD

101  LDALFEWAKA SYGAESCWKT LYLNGXPLGN LSPEWVERVX KDWEAGCXES

151  SDGIFLNADG WPDMGGRLQH LALGWHCAGL LDGWRNECFD LTDGGGNPLF

201  TLERAXXRPX GLLSRAVHLN GLTESDGRWH FWIGRRSPHK AVDPNKLDNT

251  XAGGVSGGEM PSEAVCRESS EEAGLDKTLL PLIRPVSQLH SLRSVSRGVH

301  NEILYVFDAV LP...
```

Further work revealed the complete nucleotide sequence (SEQ ID NO: 411):

```
  1  ATGCCGACCG TCCGTTTTAC CGAATCCGTC AGCAAACAAG ACCTTGATGC

51  TCTGTTCGAG TGGGCAAAAG CAAGTTACGG TGCAGAAAGT TGCTGGAAAA

101  CGCTGTATCT GAACGGTCTG CCTTTGGGCA ACCTGTCGCC GGAATGGGTG

151  GAACGCGTCA AAAAAGACTG GGAGGCAGGC TGCTCGGAGT CTTCAGACGG

201  CATTTTTCTG AATGCGGACG GCTGGCCTGA TATGGGCGGA CGCTTACAGC

251  ACCTCGCCCT CGGTTGGCAC TGTGCGGGGC TGTTGGACGG CTGGCGCAAC

301  GAGTGTTTCG ACCTGACCGA CGGCGGCGGC AACCCCTTGT TCACGCTCGA

351  ACGCGCCGCT TTCCGTCCTT TCGGACTGCT CAGCCGCGCC GTCCATCTCA

401  ACGGTCTGAC CGAATCGGAC GGCCGATGGC ATTTCTGGAT AGGCAGGCGC

451  AGTCCGCACA AAGCAGTCGA TCCCAACAAA CTCGACAATA CTGCCGCCGG

501  CGGTGTTTCC GGCGGCGAAA TGCCGTCTGA AGCCGTGTGT CGCGAAAGCA

551  GCGAAGAAGC CGGTTTGGAT AAAACGCTGC TTCCGCTCAT CCGCCCGGTA

601  TCGCAGCTGC ACAGCCTGCG CTCCGTCAGC CGGGGTGTAC ACAATGAAAT

651  CCTGTATGTA TTCGATGCCG TCCTGCCCGA AACCTTCCTG CCTGAAAATC

701  AGGATGGCGA AGTGGCGGGT TTTGAGAAAA TGGACATCGG CGGTCTGTTG

751  GATGCCATGT TGTCGGGAAA CATGATGCAC GACGCGCAAC TGGTTACGCT

801  GGACGCGTTT TGCCGTTACG GTCTGATTGA TGCCGCCCAT CCGCTGTCCG

851  AGTGGCTGGA CGGCATACGT TTATAG
```

This corresponds to the amino acid sequence (SEQ ID NO: 412; ORF105-1):

```
  1 MPTVRFTESV SKQDLDALFE WAKASYGAES CWKTLYLNGL PLGNLSPEWV
 51 ERVKKDWEAG CSESSDGIFL NADGWPDMGG RLQHLALGWH CAGLLDGWRN
101 ECFDLTDGGG NPLFTLERAA FRPFGLLSRA VHLNGLTESD GRWHFWIGRR
151 SPHKAVDPNK LDNTAAGGVS GGEMPSEAVC RESSEEAGLD KTLLPLIRPV
201 SQLHSLRSVS RGVHNEILYV FDAVLPETFL PENQDGEVAG FEKMDIGGLL
251 DAMLSGNMMH DAQLVTLDAF CRYGLIDAAH PLSEWLDGIR L*
```

Computer analysis of this amino acid sequence gave the following results:
Homology with a Predicted ORF from *N.meningitidis* (Strain A)

ORF105 (SEQ ID NO: 410) shows 89.4% identity over a 226aa overlap with an ORF (ORF105a) (SEQ ID NO: 414) from strain A of *N. meningitidis*:

```
                        60         70         80         90        100        110
orf105.pep   ISERQTAVCLRLQIQAVWLQSSALSSRKPTMPTVRFTESVSKQDLDALFEWAKASYGAES
                                     |||||||||||:||||||||||||||||
orf105a                              MPTVRFTESVSKHDLDALFEWAKASYGAES
                                              10         20         30

120        130        140        150        160        170
orf105.pep   CWKTLYLNGXPLGNLSPEWVERVXKDWEAGCXESSDGIFLNADGWPDMGGRLQHLALGWH
             ||||||||| |||||||||:||| ||||||| |||||||||||||||||||| |||||| |:
orf105a      CWKTLYLNGLPLGNLSPEWAERVKKDWEAGCSESSDGIFLNADGWPDMGRRLQHLARIWK
                       40         50         60         70         80         90

180        190        200        210        220        230
orf105.pep   CAGLLDGWRNECFDLTDGGGNPLFTLERAXXRPXGLLSRAVHLNGLTESDGRWHFWIGRR
             |||| |||:||||||||||:||||:|||   || |||||||||||:||||||||||||
orf105a      EAGLLHGWRDECFDLTDGGSNPLFALERAAFRPFGLLSRAVHLNGLVESDGRWHFWIGRR
                      100        110        120        130        140        150

240        250        260        270        280        290
orf105.pep   SPHKAVDPNKLDNTXAGGVSGGEMPSEAVCRESSEEAGLDKTLLPLIRPVSQLHSLRSVS
             ||||||||:||||| |||||:||:||:|||||||||||||||||||||||||||| ||
orf105a      SPHKAVDPDKLDNTAAGGVSSGELPSETVCRESSEEAGLDKTLLPLIRPVSQLHSLRPVS
                      160        170        180        190        200        210

300        310
orf105.pep   RGVHNEILYVFDAVLP
             ||||||||||||||||
orf105a      RGVHNEILYVFDAVLPETFLPENQDGEVAGFEKMDIGGLLAAMLSGNMMHDAQLVTLDAF
                      220        230        240        250        260        270
```

The complete length ORF105a nucleotide sequence (SEQ ID NO: 413) is:

```
  1 ATGCCGACCG TCCGTTTTAC CGAATCCGTC AGCAAACACG ACCTTGATGC
 51 CCTATTCGAG TGGGCAAAGG CAAGTTACGG TGCGGAAAGT TGCTGGAAAA
101 CGCTGTATCT GAACGGTCTG CCTTTGGGCA ATCTGTCGCC GGAATGGGCG
151 GAGCGCGTCA AAAAGACTG GGAGGCAGGC TGCTCGAGT CTTCAGACGG
201 CATTTTCCTG AATGCGGACG GCTGGCCAGA TATGGGCAGA CGCTTGCAGC
251 ACCTCGCCCG AATATGGAAA GAAGCGGGAC TGCTTCACGG CTGGCGCGAC
301 GAGTGTTTCG ACCTGACCGA CGGCGGCAGC AATCCCTTGT TCGCGCTCGA
351 ACGCGCCGCT TTCCGTCCGT TCGGACTGCT CAGCCGCGCC GTCCATCTCA
401 ACGGTTTGGT CGAATCGGAC GGCCGATGGC ATTTCTGGAT AGGCAGGCGC
451 AGTCCGCACA AAGCAGTCGA TCCCGACAAA CTCGACAATA CTGCCGCCGG
```

```
-continued
501  CGGTGTTTCC AGCGGTGAAT TGCCGTCTGA AACCGTGTGT CGCGAAAGCA

551  GCGAAGAAGC CGGTTTGGAT AAAACGCTGC TTCCGCTCAT CCGCCCGGTA

601  TCGCAGCTGC ACAGCCTGCG CCCCGTCAGC CGGGGTGTGC ACAATGAAAT

651  CCTGTATGTA TTCGATGCCG TCCTGCCCGA AACCTTCCTG CCTGAAAATC

701  AGGATGGCGA AGTGGCGGGT TTTGAGAAAA TGGACATCGG CGGTCTGTTG

751  GCTGCCATGT TGTCGGGAAA CATGATGCAC GACGCGCAAC TGGTTACGCT

801  GGACGCGTTT TGCCGTTACG GTCTGATTGA TGCCGCCCAT CCGCTGTCCG

851  AGTGGCTGGA CGGCATACGT TTATAG
```

This encodes a protein having amino acid sequence (SEQ ID NO: 414):

```
  1  MPTVRFTESV SKHDLDALFE WAKASYGAES CWKTLYLNGL PLGNLSPEWA

51  ERVKKDWEAG CSESSDGIFL NADGWPDMGR RLQHLARIWK EAGLLHGWRD

101  ECFDLTDGGS NPLFALERAA FRPFGLLSRA VHLNGLVESD GRWHFWIGRR

151  SPHKAVDPDK LDNTAAGGVS SGELPSETVC RESSEEAGLD KTLLPLIRPV

201  SQLHSLRPVS RGVHNEILYV FDAVLPETFL PENQDGEVAG FEKMDIGGLL

251  AAMLSGNMMH DAQLVTLDAF CRYGLIDAAH PLSEWLDGIR L*
```

ORF105a (SEQ ID NO: 414) and ORF105-1 (SEQ ID NO: 412) show 93.8% identity in 291 aa overlap:

```
                  10         20         30         40         50         60
orf105a.pep  MPTVRFTESVSKHDLDALFEWAKASYGAESCWKTLYLNGLPLGNLSPEWAERVKKDWEAG
             ||||||||||:||||||||||||||||||||||||||||||||||||||:|||||||||
orf105-1     MPTVRFTESVSKQDLDALFEWAKASYGAESCWKTLYLNGLPLGNLSPEWVERVKKDWEAG
                  10         20         30         40         50         60

70         80         90        100        110        120
orf105a.pep  CSESSDGIFLNADGWPDMGRRLQHLARIWKEAGLLHGWRDECFDLTDGGSNPLFALERAA
             |||||||||||||||||||| ||||||  |: ||||  |:||||||||:||||:|||||
orf105-1     CSESSDGIFLNADGWPDMGGRLQHLALGWHCAGLLDGWRNECFDLTDGGGNPLFTLERAA
                  70         80         90        100        110        120

130        140        150        160        170        180
orf105a.pep  FRPFGLLSRAVHLNGLVESDGRWHFWIGRRSPHKAVDPDKLDNTAAGGVSSGELPSETVC
             ||||||||||||||||:|||||||||||||||||||||:||||||||||||:||:|||:||
orf105-1     FRPFGLLSRAVHLNGLTESDGRWHFWIGRRSPHKAVDPNKLDNTAAGGVSGGEMPSEAVC
                 130        140        150        160        170        180

190        200        210        220        230        240
orf105a.pep  RESSEEAGLDKTLLPLIRPVSQLHSLRPVSRGVHNEILYVFDAVLPETFLPENQDGEVAG
             |||||||||||||||||||||||||||| |||||||||||||||||||||||||||||
orf105-1     RESSEEAGLDKTLLPLIRPVSQLHSLRSVSRGVHNEILYVFDAVLPETFLPENQDGEVAG
                 190        200        210        220        230        240

250        260        270        280        290
orf105a.pep  FEKMDIGGLLAAMLSGNMMHDAQLVTLDAFCRYGLIDAAHPLSEWLDGIRLX
             |||||||||| |||||||||||||||||||||||||||||||||||||||
orf105-1     FEKMDIGGLLDAMLSGNMMHDAQLVTLDAFCRYGLIDAAHPLSEWLDGIRLX
                 250        260        270        280        290
```

Homology with a Predicted ORF from *N.gonorrhoeae*

ORF105 (SEQ ID NO: 410) shows 87.5% identity over a 312aa overlap with a predicted ORF (ORF105.ng) (SEQ ID NO: 416) from *N. gonorrhoeae*:

```
orf105.pep  MVARRAHNPKVVGSNPXPATXFQTPRFNAEXVLXLPVSCFLFPAASVFCRIFLPAAISER   60
            ||||||||||||||| ||| :|||||| ||    |||||||||||||||||||||||||
orf105ng    MVARRAHNPKVVGSNPAPATKYQTPRFNAEGVLF-----FLFPAASVFCRIFLPAAISER   55 orf105.pep  QTAVCLRLQIQAVWLQSSALSSRKPTMPTVRFTESVSKQDLDALFEWAKASYGAESCWKT  120
            |:|||||||||||||||||| ||||:||||||||||||||||||||:|||||||||||
orf105ng    QAAVCLRLQIQAVWLQSSALCSRKPAMPTVRFTESVSKQDLDALFERAKASYGAESCWKT  115 orf105.pep  LYLNGXPLGNLSPEWVERVXKDWEAGCXESSDGIFLNADGWPDMGGRLQHLALGWHCAGL  180
            ||||  |||||||||||:||: |||||| |||:|||||||||||||||||||:  |||
orf105ng    LYLNRLPLGNLSPEWAERIKKDWEAGCSESSNGIFLNADGWPDMGGRLQHLARTWNKAGL  175 orf105.pep  LDGWRNECFDLTDGGGNPLFTLERAXXRPXGLLSRAVHLNGLTESDGRWHFWIGRRSPHK  240
            | ||||||||||||||||||||||| || ||| ||:|:||||||||||||||||
orf105ng    LHGWRNECFDLTDGGGNPLFTLERAAFRPFGLLIRAVHLNGLVESNGRWHFWIGRRSPHK  235 orf105.pep  AVDPNKLDNTXAGGVSGGEMPSEAVCRESSEEAGLDKTLLPLIRPVSQLHSLRSVSRGVH  300
            ||||:||||  :|||||||||||||||||||||||||||:|||||||:||||| |||||
orf105ng    AVDPGKLDNIAGGGVSGGEMPSEAVCRESSEEAGLDKTLFPLIRPVSRLHSLRPVSRGVH  295 orf105.pep  NEILYVFDAVLP                                                 312
            ||||||||||||
orf105ng    NEILYVFDAVLPETFLPENQDGEVAGFEKMDIGGLLDAMLSKNMMHDAQLVTLDAFYRYG  355
```

A complete length ORF105ng nucleotide sequence (SEQ ID NO: 415) was predicted to encode a protein having amino acid sequence (SEQ ID NO: 416):

```
  1  MVARRAHNPK VVGSNPAPAT KYQTPRFNAE GVLFFLFPAA SVFCRIFLPA
 51  AISERQAAVC LRLQIQAVWL QSSALCSRKP AMPTVRFTES VSKQDLDALF
101  ERAKASYGAE SCWKTLYLNR LPLGNLSPEW AERIKKDWEA GCSESSNGIF
151  LNADGWPDMG GRLQHLARTW NKAGLLHGWR NECFDLTDGG GNPLFTLERA
201  AFRPFGLLIR AVHLNGLVES NGRWHFWIGR RSPHKAVDPG KLDNIAGGGV
251  SGGEMPSEAV CRESSEEAGL DKTLFPLIRP VSRLHSLRPV SRGVHNEILY
301  VFDAVLPETF LPENQDGEVA GFEKMDIGGL LDAMLSKNMM HDAQLVTLDA
351  FYRYGLIDAA HPLSEWLDGI RL*
```

45

Further work revealed the complete nucleotide sequence (SEQ ID NO: 417):

```
  1  ATGCCGACCG TCCGTTTTAC CGAATCCGTC AGCAAACAAG ACCTTGATGC
 51  CCTGTTCGAG CGGGCAAAAG CAAGTTACGG TGCCGAAAGT TGCTGGAAAA
101  CGCTGTATCT GAACCGTCTT CCTTTGGGCA ATCTGTCGCC GGAATGGGCT
151  GAGCGCATCA AAAAGACTG GGAGGCAGGC TGCTCCGAGT CTTCAGACGG
201  CATTTTTCTG AATGCGGACG GCTGGCCGGA TATGGGCGGA CGCTTGCAGC
251  ACCTCGCCCG CACATGGAAC AAGGCGGGGC TGCTTCACGG ATGGCGCAAC
301  GAGTGTTTCG ACCTGACCGA CGGCGGCGGC AACCCCTTGT TCACGCTCGA
351  ACGCGCCGCT TTCCGTCCGT TCGGACTACT CAGCCGCGCC GTCCATCTCA
401  ACGGTTTGGT CGAATCGAAC GGCAGATGGC ATTTTTGGAT AGGCAGGCGC
451  AGTCCGCACA AAGCAGTCGa tcCCGGCAAG CTCGACAATA TTGCCGGCGG
```

```
-continued
501  CGGTGTTTCC GGCGGCGAAA TGCCGTCTGA AGCCGTGTGC CGCGAAAGCA

551  GCGAAGAAGC CGGTTTGGAT AAAACGCTGT TTCCGCTCAT CCGCCCAGTA

601  TCGCGGCTGC ACAGCCTTCG CCCCGTCAGC CGAGGTGTGC ACAATGAAAT

651  CCTGTATGTG TTCGATGCCG TCCTGCCCGA AACCTTCCTG CCTGAAAATC

701  AGGATGGCGA GGTAGCGGGT TTTGAAAAGA TGGACATTGG CGGCCTATTG

751  GATGCCATGT TGTCGAAAAA CATGATGCAC GACGCGCAAC TGGTTACGCT

801  GGACGCGTTT TACCGTTACG GTCTGATTGA TGCCGCCCAT CCGCTGTCCG

851  AGTGGCTGGA CGGCATACGT TTATAG
```

This corresponds to the amino acid sequence (SEQ ID NO: 418; ORF105ng-1):

```
  1  MPTVRFTESV SKQDLDALFE RAKASYGAES CWKTLYLNRL PLGNLSPEWA

51  ERIKKDWEAG CSESSDGIFL NADGWPDMGG RLQHLARTWN KAGLLHGWRN

101  ECFDLTDGGG NPLFTLERAA FRPFGLLSRA VHLNGLVESN GRWHFWIGRR

151  SPHKAVDPGK LDNIAGGGVS GGEMPSEAVC RESSEEAGLD KTLFPLIRPV

201  SRLHSLRPVS RGVHNEILYV FDAVLPETFL PENQDGEVAG FEKMDIGGLL

251  DAMLSKNMMH DAQLVTLDAF YRYGLIDAAH PLSEWLDGIR L*
```

ORG105ng-1 (SEQ ID NO: 418) and ORF105-1 (SEQ ID NO: 412) show 93.5% identity in 291 aa overlap:

```
                   10         20         30         40         50         60
orf105-1.pep  MPTVRFTESVSKQDLDALFEWAKASYGAESCWKTLYLNGLPLGNLSPEWVERVKKDWEAG
              ||||||||||||||||||||| ||||||||||||||||| ||||||||||| :|| :||||||||
orf105ng-1    MPTVRFTESVSKQDLDALFERAKASYGAESCWKTLYLNRLPLGNLSPEWAERIKKDWEAG
                   10         20         30         40         50         60

70         80         90        100        110        120
orf105-1.pep  CSESSDGIFLNADGWPDMGGRLQHLALGWHCAGLLDGWRNECFDLTDGGGNPLFTLERAA
              |||||||||||||||||||||||||||| |: |||| ||||||||||||||||||||||||
orf105ng-1    CSESSDGIFLNADGWPDMGGRLQHLARTWNKAGLLHGWRNECFDLTDGGGNPLFTLERAA
                   70         80         90        100        110        120

130        140        150        160        170        180
orf105-1.pep  FRPFGLLSRAVHLNGLTESDGRWHFWIGRRSPHKAVDPNKLDNTAAGGVSGGEMPSEAVC
              ||||||||||||||||:||:||||||||||||||||||||:|||| |:||||||||||||
orf105ng-1    FRPFGLLSRAVHLNGLVESNGRWHFWIGRRSPHKAVDPGKLDNIAGGGVSGGEMPSEAVC
                  130        140        150        160        170        180

190        200        210        220        230        240
orf105-1.pep  RESSEEAGLDKTLLPLIRPVSQLHSLRSVSRGVHNEILYVFDAVLPETFLPENQDGEVAG
              |||||||||||:|||||||:|||| ||||||||||||||||||||||||||||||||||
orf105ng-1    RESSEEAGLDKTLFPLIRPVSRLHSLRPVSRGVHNEILYVFDAVLPETFLPENQDGEVAG
                  190        200        210        220        230        240

250        260        270        280        290
orf105-1.pep  FEKMDIGGLLDAMLSGNMMHDAQLVTLDAFCRYGLIDAAHPLSEWLDGIRLX
              |||||||||||||||| ||||||||||||||| |||||||||||||||||||
orf105ng-1    FEKMDIGGLLDAMLSKNMMHDAQLVTLDAFYRYGLIDAAHPLSEWLDGIRLX
                  250        260        270        280        290
```

Furthermore, ORF105ng-1 (SEQ ID NO: 418) shows homology with a yeast enzyme(SEQ ID NO: 1139): sp|P41888|TNR3_SCHPO THIAMIN PYROPHOSPHO-KINASE (TPK) (THIAMIN KINASE)) gi|1076928|pir||S52350 thiamin pyrophosphokinase (EC 2.7.6.2)-fission yeast (*Schizosaccharomyces pombe*)) gi|666111 (X84417) thiamin pyrophosphokinase [*Schizosaccharomyces pombe*]) gi|2330852|gn1|PID|e334056 (Z98533) thiamin pyrophos-phokinase [*Schizosaccharomyces pombe*] Length=569 Score=105 bits (259), Expect=4e-22 Identities=64/192 (33%), Positives=94/192 (48%), Gaps=3/192 (1%)

```
sp|P41888|TNR3_SCHPO THIAMIN PYROPHOSPHOKINASE (TPK) (THIAMIN KINASE)
)gi|1076928|pir||S52350 thiamin pyrophosphokinase (EC 2.7.6.2) - fission yeast
(Schizosaccharomyces pombe) )gi|666111 (X84417) thiamin pyrophosphokinase
[Schizosaccharomyces pombe])gi|2330852|gnl|PID|e334056 (Z98533) thiamin
pyrophosphokinase [Schizosaccharomyces pombe] Length = 569
Score = 105 bits (259), Expect = 4e-22
Identities = 64/192 (33%), Positives = 94/192 (48%), Gaps = 3/192 (1%)

Query: 268 NKAGLLHGWRNECFDLTDGGGNPLFTLERAAFRPFGLLSRAVHLNGLVESNGRW--HFWI  441
           N  G+   WRNE + +       P+ +ER F FG LS VH    + +         W+
Sbjct:  96 NTFGIADQWRNELYTVYGKSKKPVLAVERGGFWLFGFLSTGVHCTMYIPATKEHPLRIWV  155

Query: 442 GRRSPHKAVDPGKLDNIAGGGVSGGEMPSEAVCRESSEEAGLDKTLFPLIRPVSRLHSLR  621
           RRSP K   P  LDN   GG++ G+    + +E SEEA LD +   LI P  +  ++
Sbjct: 156 PRRSPTKQTWPNYLDNSVAGGIAHGDSVIGTMIKEFSEEANLDVSSMNLI-PCGTVSYIK  214

Query: 622 PVSRG-VHNEILYVFDAVLPETFLPENQDGEVAGFEKMDIGGLLDAMLSKNMMHDAQLVT  798
            R  +  E+  YVFD + +   +P   DGEVAGF  + +L + K+   +  LV
Sbjct: 215 MEKRHWIQPELQYVFDLPVDDLVIPRINDGEVAGFSLLPLNQVLHELELKSFKPNCALVL  274

Query: 799 LDAFYRYGLIDAAHP                                              843
           LD   R+G+I   HP
Sbjct: 275 LDFLIRHGIITPQMP                                              289
```

Based on this analysis, including the presence of a putative transmembrane domain in the gonococcal protein, it is predicted that the proteins from *N.meningitidis* and *N.gonorrhoeae*, and their epitopes, could be useful antigens for vaccines or diagnostics, or for raising antibodies.

Example 49

The following DNA sequence, believed to be complete, was identified in *N.meningitidis* (SEQ ID NO: 419):

```
  1 ATGAATAGAC CCAAGCAACC CTTCTTCCGT CCCGAAGTCG CCGTTGCCCG
 51 CCAAACCAGC CTGACGGGTA AAGTGATTCT GACACGACCG TTGTCATTTT
101 CCCTATGGAC GACATTTGCA TCGATATCTG CGTTATTGAT TATCCTGTTT
151 TTGATATTTG GTAACTATAC GCGAAAGACA ACAGTGGAGG GACAAATTTT
201 ACCTGCATCG GGCGTAATCA GGGTGTATGC ACCGgATACG rGkACAATTA
251 CAGCGAAATT CGTGGAAGAT GGmsAAAAGG TTAAGGCTGG CGACAAGCTA
301 TTTGCGCTTT CGACCTCACG TTTCGGCGCA GGAGGTAGCG TGCAGCAGCA
351 GTTGAAAACG GAGGCAGTTT TGAAGAAAAC GTTGGCAGAA CAGGAACTGG
401 GTCGTCTGAA GCTGATACAC GGGAATGAAA CGCGCAgCcT TAAAGCAACT
451 GTCGAACGTT TGGAAAACCA GGAACTCCAT ATTTCGCAAC AGATAGACGG
501 TCAGAAAAGG CGCATTAGAC TTGCGGAAGA AATGTTGCAG AAATATCGTT
551 TCCTATCCGC .CAATGA
```

This corresponds to the amino acid sequence (SEQ ID NO: 420; ORF107):

```
  1 MNRPKQPFFR PEVAVARQTS LTGKVILTRP LSFSLWTTFA SISALLIILF
 51 LIFGNYTRKT TVEGQILPAS GVIRVYAPDT XTITAKFVED GXKVKAGDKL
101 FALSTSRFGA GGSVQQQLKT EAVLKKTLAE QELGRLKLIH GNETRSLKAT
151 VERLENQELH ISQQIDGQKR RIRLAEEMLQ KYRFLSXQ*
```

Computer analysis of this amino acid sequence gave the following results:
Homology with a Predicted ORF from *N.meningitidis* (Strain A)
ORF107 (SEQ ID NO: 420) shows 97.8% identity over a 186aa overlap with an ORF (ORF107a) (SEQ ID NO: 422) from strain A of *N. meningitidis*:

```
                   10        20        30        40        50        60
orf107.pep  MNRPKQPFFRPEVAVARQTSLTGKVILTRPLSFSLWTTFASISALLIILFLIFGNYTRKT
            ||||||||||||||||||||||||||||||||||||||||||||||||||||||||||||
orf107a     MNRPKQPFFRPEVAVARQTSLTGKVILTRPLSFSLWTTFASISALLIILFLIFGNYTRKT
                   10        20        30        40        50        60

70        80        90       100       110       120
orf107.pep  TVEGQILPASGVIRVYAPDTXTITAKFVEDGXKVKAGDKLFALSTSRFGAGGSVQQQLKT
            |||||||||||||||||||| ||||| ||| |||||||||||||||||||||| ||||||
orf107a     TVEGQILPASGVIRVYAPDTGTITAKFXEDGEKVKAGDKLFALSTSRFGAGDSVQQQLKT
                   70        80        90       100       110       120

130       140       150       160       170       180
orf107.pep  EAVLKKTLAEQELGRLKLIHGNETRSLKATVERLENQELHISQQIDGQKRRIRLAEEMLQ
            ||||||||||||||||||||||||||||||||||||||||||||||||||||||||||||
orf107a     EAVLKKTLAEQELGRLKLIHGNETRSLKATVERLENQELHISQQIDGQKRRIRLAEEMLQ
                  130       140       150       160       170       180

189
orf107.pep  KYRFLSXQX
            ||||||
orf107a     KYRFLSANDAVPKQEMMNVKAELLEQKAKLDAYRREEVGLLQEIRTQNLTLXSLPQAAX
                  190       200       210       220       230
```

The complete length ORF107a nucleotide sequence (SEQ ID NO: 421) is:

```
  1 ATGAATAGAC CCAAGCAACC NTTCTTCCGT CCCGAAGTCG CCGTTGCCCG

51 CCAAACCAGC CTGACGGGTA AAGTGATTCT GACACGACCG TTGTCATTTT

101 CCCTATGGAC GACATTTGCA TCGATATCTG CGTTATTGAT TATCCTGTTT

151 TTGATATTTG GTAACTATAC GCGAAAGACA ACAGTGGAGG GACAAATTTT

201 ACCTGCATCG GGCGTAATCA GGGTGTATGC ACCGGATACG GGGACAATTA

251 CNGCGAAATT CNTGGAAGAT GGAGAAAAGG TTAAGGCTGG CGACAAGCTA

301 TTTGCGCTTT CGACCTCACG TTTCGGCGCA GGAGATAGCG TGCAGCAGCA

351 GTTGAAAACG GAGGCAGTTT TGAAGAAAAC GTTGGCAGAA CAGGAACTGG

401 GTCGTCTGAA GCTGATACAC GGGAATGAAA CGCGCAGCCT TAAAGCAACT

451 GTCGAACGTT TGGAAAACCA GGAACTCCAT ATTTCGCAAC AGATAGACGG

501 TCAGAAAAGG CGCATTAGAC TTGCGGAAGA AATGTTGCAG AAATATCGTT

551 TCCTATCCGC CAATGATGCA GTGCCAAAAC AAGAAATGAT GAATGTCAAG

601 GCAGAGCTTT TAGAGCAGAA AGCCAAACTT GATGCCTACC GCCGAGAAGA

651 AGTCGGGCTG CTTCAGGAAA TCCGCACGCA GAATCTGACA TTGGNNAGCC

701 TCCCCCAAGC GGCATGA
```

This encodes a protein having amino acid sequence (SEQ ID NO: 422):

```
  1 MNRPKQPFFR PEVAVARQTS LTGKVILTRP LSFSLWTTFA SISALLIILF

51 LIFGNYTRKT TVEGQILPAS GVIRVYAPDT GTITAKFXED GEKVKAGDKL
```

-continued

```
101 FALSTSRFGA GDSVQQQLKT EAVLKKTLAE QELGRLKLIH GNETRSLKAT

151 VERLENQELH ISQQIDGQKR RIRLAEEMLQ KYRFLSANDA VPKQEMMNVK

201 AELLEQKAKL DAYRREEVGL LQEIRTQNLT LXSLPQAA*
```

Homology with a Predicted ORF from *N.gonorrhoeae*
ORF107 (SEQ ID NO: 420) shows 95.7% identity over a 188aa overlap with a predicted ORF (ORF107.ng) (SEQ ID NO: 424) from *N. gonorrhoeae*:

```
orf107.pep  MNRPKQPFFRPEVAVARQTSLTGKVILTRPLSFSLWTTFASISALLIILFLIFGNYTRKT   60
            ||||||||||||:|||||||||||||||||||||||||||||||||||||||||||||||
orf107ng    MNRPKQPFFRPEVAIARQTSLTGKVILTRPLSFSLWTTFASISALLIILFLIFGNYTRKT   60 orf107.pep  TVEGQILPASGVIRVYAPDTXTITAKFVEDGXKVKAGDKLFALSTSRFGAGGSVQQQLKT  120
            |:||||||||||||||||| |||||||||| |||||||||||||||||||||||||||||
orf107ng    TMEGQILPASGVIRVYAPDTGTITAKFVEDGEKVKAGDKLFALSTSRFGAGGSVQQQLKT  120 orf107.pep  EAVLKKTLAEQELGRLKLIHGNETRSLKATVERLENQELHISQQIDGQKRRIRLAEEMLQ  180
            |||||||||||||||||||| |||||||||||||||||:|||||||||||||||||||:
orf107ng    EAVLKKTLAEQELGRLKLIHENETRSLKATVERLENQKLHISQQIDGQKRRIRLAEEMLR  180 orf107.pep  KYRFLSXQ                                                      188
            |||||| |
orf107ng    KYRFLSAQ                                                      188
```

The complete length ORF107ng nucleotide sequence (SEQ ID NO: 423) is predicted to encode a protein having amino acid sequence (SEQ ID NO: 424):

```
  1 MNRPKQPFFR PEVAIARQTS LTGKVILTRP LSFSLWTTFA SISALLIILF

51 LIFGNYTRKT TMEGQILPAS GVIRVYAPDT GTITAKFVED GEKVKAGDKL

101 FALSTSRFGA GGSVQQQLKT EAVLKKTLAE QELGRLKLIH ENETRSLKAT

151 VERLENQKLH ISQQIDGQKR RIRLAEEMLR KYRFLSAQ*
```

Based on the presence of a putative ransmembrane domain in the gonococcal protein, it is predicted that the proteins from *N.meningitidis* and *N.gonorrhoeae*, and their epitopes, could be useful antigens for vaccines or diagnostics, or for raising antibodies.

Example 50

The following DNA sequence, believed to be complete, was identified in *N.meningitidis* (SEQ ID NO: 425):

```
  1 ATGCTGAATA CTTTTTTTGC CGTATTGGGC GGCTGCCTGC TGCT.TTGCC

51 GTGCGGCAAA TCCGTAAATA CGGCGGTACA GCCGCAAAAC GCGGTACAAA

101 GCGCGCCGAA ACCGGTTTTC AAAGTCATAT ATATCGACAA TACGGCGATT

151 GCCGGTTTGG ATTTGGGACA AAGCAGCGAA GGCAAAACCA ACGACGGCAA

201 AAAACAAATC AGTTATCCGA TTAAAGGCTT GCCGGAACAA AATGTTATCC

251 GACTGATCGG CAAGCATCCC GGCGACTTGG AAGCCGTCAG CGGCAAATGT

301 ATGGAAACCG ATGATAAGGA CAGTCCGGCA GGTTGGGCAG AAAACGGCGT

351 GTGCCATACC TTGTTTGCCA AACTGGTGGG CAATATCGCC GAAGACGGCG

401 GCAAACTGAC GGATTACCTA GTTTCGCATG CCGCCCTGCA ACCCTATCAG

451 GCAGGCAAAA GCGGCTATGC CGCCGTGCAG AACGGACGCT ATGTGCTGGA

501 AATCGACAGC GAAGGGGCGT TTTATTTCCG CCGCCGCCAT TATTGA
```

This corresponds to the amino acid sequence (SEQ ID NO: 426; ORF108):

```
  1 MLNTFFAVLG GCLLXLPCGK SVNTAVQPQN AVQSAPKPVF KVIYIDNTAI

51 AGLDLGQSSE GKTNDGKKQI SYPIKGLPEQ NVIRLIGKHP GDLEAVSGKC

101 METDDKDSPA GWAENGVCHT LFAKLVGNIA EDGGKLTDYL VSHAALQPYQ

151 AGKSGYAAVQ NGRYVLEIDS EGAFYFRRRH Y*
```

Further work revealed the following DNA sequence (SEQ ID NO: 427):

```
  1 ATGCTGAAAA CATCTTTTGC CGTATTGGGC GGCTGCCTGC TGCTTGCCGC

51 CTGCGGCAAA TCCGAAAATA CGGCGGAACA GCCGCAAAAC GCGGTACAAA

101 GCGCGCCGAA ACCGGTTTTC AAAGTCAAAT ATATCGACAA TACGGCGATT

151 GCCGGTTTGG ATTTGGGACA AAGCAGCGAA GGCAAAACCA ACGACGGCAA

201 AAAACAAATC AGTTATCCGA TTAAAGGCTT GCCGGAACAA AATGTTATCC

251 GACTGATCGG CAAGCATCCC GGCGACTTGG AAGCCGTCAG CGGCAAATGT

301 ATGGAAACCG ATGATAAGGA CAGTCCGGCA GGTTGGGCAG AAAACGGCGT

351 GTGCCATACC TTGTTTGCCA AACTGGTGGG CAATATCGCC GAAGACGGCG

401 GCAAACTGAC GGATTACCTA GTTTCGCATG CCGCCCTGCA ACCCTATCAG

451 GCAGGCAAAA GCGGCTATGC CGCCGTGCAG AACGGACGCT ATGTGCTGGA

501 AATCGACAGC GAAGGGGCGT TTTATTTCCG CCGCCGCCAT TATTGA
```

This corresponds to the amino acid sequence (SEQ ID NO: 428; ORF108-1):

```
  1 MLKTSFAVLG GCLLLAACGK SENTAEQPQN AVQSAPKPVF KVKYIDNTAI

51 AGLDLGQSSE GKTNDGKKQI SYPIKGLPEQ NVIRLIGKHP GDLEAVSGKC

101 METDDKDSPA GWAENGVCHT LFAKLVGNIA EDGGKLTDYL VSHAALQPYQ

151 AGKSGYAAVQ NGRYVLEIDS EGAFYFRRRH Y*
```

Computer analysis of this amino acid sequence gave the following results:
Homology with a Predicted ORF from N.gonorrhoeae ORF108 (SEQ ID NO: 428) shows 88.4% identity over a 181aa overlap with a predicted ORF (ORF108.ng) (SEQ ID NO: 430) from N. gonorrhoeae:

```
orf108.pep  MLNTFFAVLGGCLLXLPCGKSVNTAVQPQNAVQSAPKPVFKVIYIDNTAIAGLDLGQSSE   60
            ||: ||||||||  |||| || |||||:||||||||||| ||||||||| ||||||
orf108ng    MLKIPFAVLGGCLLLAACGKSENTAEQPQNAAQSAPKPVFKVKYIDNTAIAGLALGQSSE   60 orf108.pep  GKTNDGKKQISYPIKGLPEQNVIRLIGKHPGDLEAVSGKCMETDDKDSPAGWAENGVCHT  120
            ||||||||||||||||||||||::|| ||||:||||| |||||||| ||:|:||||||||
orf108ng    GKTNDGKKQISYPIKGLPEQNAVRLTGKHPNDLEAVVGKCMETDGKDAPSGWAENGVCHT  120 orf108.pep  LFAKLVGNIAEDGGKLTDYLVSHAALQPYQAGKSGYAAVQNGRYVLEIDSEGAFYFRRRHY  181
            ||||||||||||||||||||:||:||||||||||||||||||||||||||||||||||||
orf108ng    LFAKLVGNIAEDGGKLTDYLISHSALQPYQAGKSGYAAVQNGRYVLEIDSEGAFYFRRRHY  181
```

ORF108-1 (SEQ ID NO: 428) shows 92.3% identity with ORF108ng (SEQ ID NO: 430) over the same 181 aa overlap:

```
orf108-1.pep  MLKTSFAVLGGCLLLAACGKSENTAEQPQNAVQSAPKPVFKVKYIDNTAIAGLDLGQSSE   60
              |||  ||||||||||||||||||||||||||:||||||||||||||||||||||| |||||
orf108ng-1    MLKIPFAVLGGCLLLAACGKSENTAEQPQNAAQSAPKPVFKVKYIDNTAIAALALGQSSE   60 orf108-1.pep  GKTNDGKKQISYPIKGLPEQNVIRLIGKHPGDLEAVSGKCMETDDKDSPAGWAENGVCHT  120
              ||||||||||||||||||||||::|| ||||:||||| |||||||| ||:|||||||||
orf108ng-1    GKTNDGKKQISYPIKGLPEQNAVRLTGKHPNDLEAVVGKCMETDGKDAPSGWAENGVCHT  120 orf108-1.pep  LFAKLVGNIAEDGGKLTDYLVSHAALQPYQAGKSGYAAVQNGRYVLEIDSEGAFYFRRRHY 181
              ||||||||||||||||||||:||:||||||||||||||||||||||||||||||||||||
orf108ng-1    LFAKLVGNIAEDGGKLTDYLISHSALQPYQAGKSGYAAVQNGRYVLEIDSEGAFYFRRRHY 181
```

The computer length ORF108ng nucleotide sequence (SEQ ID NO: 429) is:

```
  1  ATGCTGAAAa tacctTTTGC CGTGTtgggc ggCtgcctGC TGCTTGCCGC
 51  CTGCGGCAAA TCCGAAAATa cggcggaACA GCCGCAAAAT gcggCACAAA
101  GCGCGCCGAA ACCGGTTTTC AAAGTCAAAT ACATCGACAA TACGGCGATT
151  GCCGGTTTGG CTTTGGGACA AGTAGCGAA GGCAAAACCA acgacgGCAA
201  AAAACAAATC AGTTATccgA TTAAAGGCTT GCCGGAACAA Aacgccgtcc
251  gGCTGACCGG AAAGCATCCC AACGACTTGG AagccgtcgT CGGCAAATGT
301  ATGGAAACCG ACGGAAAGGA CGCGCCTTCG GGCTGGGCGG AAAACGGCGT
351  GTGCCATACC TTGTTTGCCA AACTGGTGGG CAATATCGCC GAAGACGGCG
401  GCAAACTGAC TGATTACCTG ATTTCGCATT CCGCCCTGCA ACCCTATCAG
451  GCAGGCAAAA GCGGCTATGC CGCCGTGCAG AACGGACGCT ATGTGCTGGA
501  AATCGACAGC GagggGGCGT TTTATttccg ccgccgccat tattgA
```

This encodes a protein having amino acid sequence (SEQ ID NO: 430):

```
  1  MLKIPFAVLG GCLLLAACGK SENTAEQPQN AAQSAPKPVF KVKYIDNTAI
 51  AGLALGQSSE GKTNDGKKQI SYPIKGLPEQ NAVRLTGKHP NDLEAVVGKC
101  METDGKDAPS GWAENGVCHT LFAKLVGNIA EDGGKLTDYL ISHSALQPYQ
151  AGKSGYAAVQ NGRYVLEIDS EGAFYFRRRH Y*
```

Based on this analysis, including the presence of a predicted prokaryotic membrane lipoprotein lipid attachment site (underlined) and a putative ATP/GTP-binding site, motif A (P-loop, double-underlined) in the gonococcal protein, it is predicted that the proteins from *N.meningitidis* and *N.gonorrhoeae*, and their epitopes, could be useful antigens for vaccines or diagnostics, or for raising antibodies.

Example 51

The following DNA sequence was identified in *N.meningitidis* (SEQ ID NO: 431):

```
  1  ATGGAAGATT TATATATAAT ACTCGCTTTG GGTTTGGTTG CGATGATTGC
 51  CGgATTTATC GATgcgatTg cGggCGGGGG TGGTTTGATT ACGCTGCCCG
101  CACTCTTGTT GGCAGGTATT CCTCCCGTGT CGGCAATTGC CACCAACAAG
151  CTGCAAgCAG CCGCTGCTAC GTTTTCAGCT ACGGTTTCTT TTGCACGCAA
201  AGGTTTGATT GATTGGAAGA AAGGTCTCCC GATTGCCGCA GCATCGTTTG
```

-continued
```
251 TAGGCGGCGT GGCCGGTGCA TTATCGGTCA GCTTGGTTTC CAAAGATATT

301 CTgCTgGCGG TCGTGCCGGT TTTGTTGATA TTTGTCGCAC TGTATTTTGT

351 GTTTTCGCCC AAGCTCGACG GCAGTAAGGA AGGCAAAGCC AGAATGTCTT

401 TTTTTCTGTT CGGGCTGACG GTCGC.ACCG CTTTTGGGTT TTTACGACGG

451 TGTGTTCGGA CCGGGTGTCG GCTCGTTTTT TCTGATTGCC TTTATTGTTT

501 TGCTCGGCTG CAAgCTGTTG AACGCGATGT CTTACACCAA ATTGGCGAAC

551 GTTGCCTGCA ATCTTGGTTC GCTATCGGTA TTCCTGCTGC ACGGTTCGAT

601 TATTTTCCCG ATTGCGGCAA CGaTGGCGGT CGGTGCGTTT GTCGGtGCGA

651 ATTTAgGTGC GAGATTTGCC GTaCgctTCG GTTCGAAGCT GATTAA
```

This corresponds to the amino acid sequence (SEQ ID NO: 432; ORF109):

```
  1 MEDLYIILAL GLVAMIAGFI DAIAGGGGLI TLPALLLAGI PPVSAIATNK

51 LQAAAATFSA TVSFARKGLI DWKKGLPIAA ASFVGGVAGA LSVSLVSKDI

101 LLAVVPVLLI FVALYFVFSP KLDGSKEGKA RMSFFLFGLT VXTAFGFLRR

151 CVRTGCRLVF SDCLYCFARL QAVERDVLHQ IGERCLQSWF AIGIPAARFD

201 YFPDCGNDGG RCVCRCEFRC EICRTLRFEA D*
```

Further work revealed the following DNA sequence (SEQ ID NO: 433):

```
  1 ATGGAAGATT TATATATAAT ACTCGCTTTG GGTTTGGTTG CGATGATTGC

51 CGGATTTATC GATGCGATTG CGGGCGGGGG TGGTTTGATT ACGCTGCCCG

101 CACTCTTGTT GGCAGGTATT CCTCCCGTGT CGGCAATTGC CACCAACAAG

151 CTGCAAGCAG CCGCTGCTAC GTTTTCAGCT ACGGTTTCTT TTGCACGCAA

201 AGGTTTGATT GATTGGAAGA AAGGTCTCCC GATTGCCGCA GCATCGTTTG

251 TAGGCGGCGT GGCCGGTGCA TTATCGGTCA GCTTGGTTTC CAAAGATATT

301 CTGCTGGCGG TCGTGCCGGT TTTGTTGATA TTTGTCGCAC TGTATTTTGT

351 GTTTTCGCCC AAGCTCGACG GCAGTAAGGA AGGCAAAGCC AGAATGTCTT

401 TTTTTCTGTT CGGGCTGACG GTCGCACCGC TTTTGGGTTT TTACGACGGT

451 GTGTTCGGAC CGGGTGTCGG CTCGTTTTTT CTGATTGCCT TTATTGTTTT

501 GCTCGGCTGC AAGCTGTTGA ACGCGATGTC TTACACCAAA TTGGCGAACG

551 TTGCCTGCAA TCTTGGTTCG CTATCGGTAT TCCTGCTGCA CGGTTCGATT

601 ATTTTCCCGA TTGCGGCAAC GATGGCGGTC GGTGCGTTTG TCGGTGCGAA

651 TTTAGGTGCG AGATTTGCCG TCCGCTTCGG TTCGAAGCTG ATTAAGCCGC

701 TGCTGATTGT CATCAGCATT TCGATGGCTG TGAAATTGTT GATAGACGAG

751 AGAAATCCGC TGTATCAGAT GATTGTTTCG ATGTTTTAA
```

This corresponds to the amino acid sequence (SEQ ID NO: 434; ORF109-1):

```
  1 MEDLYIILAL GLVAMIAGFI DAIAGGGGLI TLPALLLAGI PPVSAIATNK

51 LQAAAATFSA TVSFARKGLI DWKKGLPIAA ASFVGGVAGA LSVSLVSKDI

101 LLAVVPVLLI FVALYFVFSP KLDGSKEGKA RMSFFLFGLT VAPLLGFYDG

151 VFGPGVGSFF LIAFIVLLGC KLLNAMSYTK LANVACNLGS LSVFLLHGSI

201 IFPIAATMAV GAFVGANLGA RFAVRFGSKL IKPLLIVISI SMAVKLLIDE

251 RNPLYQMIVS MF*
```

Computer analysis of amino acid sequence gave the following results:
Homology with Predicted ORF from *N.meningitidis* (Strain A)

ORF109 (SEQ ID NO: 432) shows 95.9% identity over a 147aa overlap with an ORF (ORF109a) (SEQ ID NO: 436) from strain A of *N. meningitidis*:

```
                       10        20        30        40        50        60
orf109.pep  MEDLYIILALGLVAMIAGFIDAIAGGGGLITLPALLLAGIPPVSAIATNKLQAAAATFSA
            ||||||||||||||||||||||||||||||||||||||||||||||||||||||||||||
orf109a     MEDLYIILALGLVAMIAGFIDAIAGGGGLITLPALLLAGIPPVSAIATNKLQAAAATFSA
                       10        20        30        40        50        60

70        80        90       100       110       120
orf109.pep  TVSFARKGLIDWKKGLPIAAASFVCGVAGALSVSLVSKDILLAVVPVLLIFVALYFVFSP
            |||||||||||||||||||||||:|||:||||||||||||||||||||||||||||||||
orf109a     TVSFARKGLIDWKKGLPIAAASFAGGVVGALSVSLVSKDILLAVVPVLLIFVALYFVFSP
                       70        80        90       100       110       120

130       140       150       160       170       180
orf109.pep  KLDGSKEGKARMSFFLFGLTVXTAFGRLRRCVRTGCRLVFSDCLYCFARLQAVERDVLHQ
            ||||||||||||||||||||||||    :||
orf109a     KLDGSKEGKARMSFFLFGLTVAPLLGFYDGVFGPGVGSFFLIAFIVLLGCKLLNAMSYTK
                      130       140       150       160       170       180
```

The complete length ORF109a nucleotide sequence (SEQ ID NO: 435) is:

```
  1 ATGGAAGATT TATACATAAT ACTCGCTTTG GGTTTGGTTG CGATGATTGC

51 CGGATTTATC GATGCGATTG CGGGTGGGGG TGGTTTGATT ACGCTGCCTG

101 CACTCTTGTT GGCAGGTATT CCTCCCGTGT CGGCAATTGC CACCAACAAG

151 CTGCAAGCAG CCGCTGCTAC GTTTTCGGCT ACGGTTTCTT TTGCACGCAA

201 AGGTTTGATT GATTGGAAGA AAGGTCTCCC GATTGCGGCA GCATCGTTTG

251 CAGGCGGCGT GGTCGGTGCA TTATCGGTCA GCTTGGTTTC CAAAGATATT

301 CTGCTGGCGG TCGTGCCGGT TTTGTTGATA TTTGTCGCGC TGTATTTTGT

351 GTTTTCGCCC AAGCTCGACG GCAGTAAGGA AGGCAAAGCC AGAATGTCTT

401 TTTTTCTGTT CGGTCTGACG GTTGCACCAC TTTTGGGTTT TTACGACGGT

451 GTGTTCGGAC CGGGTGTCGG CTCGTTTTTT CTGATTGCCT TTATTGTTTT

501 GCTCGGCTGC AAGCTGTTGA ACGCGATGTC TTACACCAAA TTGGCGAACG

551 TTGCCTGCAA TCTTGGTTCG CTATCGGTAT TCCTGCTGCA CGGTTCGATT

601 ATTTTCCCGA TTGCGGCAAC GATGGCGGTC GGTGCGTTTG TCGGTGCGAA

651 TTTAGGTGCG AGATTTGCCG TCCGCTTCGG TTCGAAGCTG ATTAAGCCGC

701 TGCTGATTGT CATCAGCATT TCGATGGCTG TGAAATTGTT GATAGACGAG

751 AGAAATCCGC TGTATCAGAT GATTGTTTCG ATGTTTTAA
```

This encodes a protein having amino acid sequence (SEQ ID NO: 436):

```
  1 MEDLYIILAL GLVAMIAGFI DAIAGGGGLI TLPALLLAGI PPVSAIATNK

51 LQAAAATFSA TVSFARKGLI DWKKGLPIAA ASFAGGVVGA LSVSLVSKDI

101 LLAVVPVLLI FVALYFVFSP KLDGSKEGKA RMSFFLFGLT VAPLLGFYDG

151 VFGPGVGSFF LIAFIVLLGC KLLNAMSYTK LANVACNLGS LSVFLLHGSI

201 IFPIAATMAV GAFVGANLGA RFAVRFGSKL IKPLLIVISI SMAVKLLIDE

251 RNPLYQMIVS MF*
```

ORF109a (SEQ ID NO: 436) and ORF109-1 (SEQ ID NO: 434) show 99.2% identity in 262 aa overlap:

```
                    10        20        30        40        50        60
orf109a.pep MEDLYIILALGLVAMIAGFIDAIAGGGGLITLPALLLAGIPPVSAIATNKLQAAAATFSA
            ||||||||||||||||||||||||||||||||||||||||||||||||||||||||||||
orf109-1    MEDLYIILALGLVAMIAGFIDAIAGGGGLITLPALLLAGIPPVSAIATNKLQAAAATFSA
                    10        20        30        40        50        60

70        80        90       100       110       120
orf109a.pep TVSFARKGLIDWKKGLPIAAASFAGGVVGALSVSLVSKDILLAVVPVLLIFVALYFVFSP
            |||||||||||||||||||||||:|||:||||||||||||||||||||||||||||||||
orf109-1    TVSFARKGLIDWKKGLPIAAASFVGGVAGALSVSLVSKDILLAVVPVLLIFVALYFVFSP
                    70        80        90       100       110       120

130       140       150       160       170       180
orf109a.pep KLDGSKEGKARMSFFLFGLTVAPLLGFYDGVFGPGVGSFFLIAFIVLLGCKLLNAMSYTK
            ||||||||||||||||||||||||||||||||||||||||||||||||||||||||||||
orf109-1    KLDGSKEGKARMSFFLFGLTVAPLLGFYDGVFGPGVGSFFLIAFIVLLGCKLLNAMSYTK
                   130       140       150       160       170       180

190       200       210       220       230       240
orf109a.pep LANVACNLGSLSVFLLMGSIIFPIAATMAVGAFVGANLGARFAVRFGSKLIKPLLIVISI
            ||||||||||||||||:|||||||||||||||||||||||||||||||||||||||||||
orf109-1    LANVACNLGSLSVFLLHGSIIFPIAATMAVGAFVGANLGARFAVRFGSKLIKPLLIVISI
                   190       200       210       220       230       240

250       260
orf109a.pep SMAVKLLIDERNPLYQMIVSMFX
            |||||||||||||||||||||||
orf109-1    SMAVKLLIDERNPLYQMIVSMFX
                   250       260
```

Homology with a Predicted ORF from N.gonorrhoeae

ORF109 (SEQ ID NO: 432) shows 98.3% identity over a 231aa overlap with a predicted ORF (ORF109.ng) (SEQ ID NO: 438) from N. gonorrhoeae:

```
orf109.pep  MEDLYIILALGLVAMIAGFIDAIAGGGGLITLPALLLAGIPPVSAIATNKLQAAAATFSA   60
            ||||||||||||||||||||||||||||||||||||||||||||||||||||||||||||
orf109ng    MEDLYIILALGLVAMIAGFIDAIAGGGGLITLPALLLAGIPPVSAIATNKLQAAAATFSA   60 orf109.pep  TVSFARKGLIDWKKGLPIAAASFVGGVAGALSVSLVSKDILLAVVPVLLIFVALYFVFSP  120
            |||||||||||||||||||||||:|||:||||||||||||||||||||||||||||||||
orf109ng    TVSFARKGLIDWKKGLPIAAASFAGGVVGALSVSLVSKDILLAVVPVLLIFVALYFVFSP  120 orf109.pep  KLDGSKEGKARMSFFLFGLTVXTAFGFLRRCVRTGCRLVFSDCLYCFARLQAVERDVLHQ  180
            |||||||||||||||||||||| |||||||||||||||||||||||||||||||||||||
orf109ng    KLDGSKEGKARMSFFLFGLTVATAFGFLRRCVRTGCRLVFSDCLYCFARLQAVERDVLHQ  180 orf109.pep  IGERCLQSWFAIGIPAARFDYFPDCGNDGGRCVCRCEFRCEICRTLRFEAD           231
            |||||||||||||||||||||||||||||||||||||||||||| |||||
orf109ng    IGERCLQSWFAIGIPAARFDYFPDCGNDGGRCVCRCEFRCEICRPLRFEAD           231
```

An ORF109ng nucleotide sequence (SEQ ID NO: 437) was predicted to encode a protein having amino acid sequence (SEQ ID NO: 438):

```
  1 MEDLYIILAL GLVAMIAGFI DAIAGGGGLI TLPALLLAGI PPVSAIATNK

51 LQAAAATFSA TVSFARKGLI DWKKGLPIAA ASFAGGVVGA LSVSLVSKDI

101 LLAVVPVLLI FVALYFVFSP KLDGSKEGKA RMSFFLFGLT VATAFGFLRR

151 CVRTGCRLVF SDCLYCFARL QAVERDVLHQ IGERCLQSWF AIGIPAARFD

201 YFPDCGNDGG RCVCRCEFRC EICRPLRFEA D*
```

Further work revealed the following gonococcal DNA sequence (SEQ ID NO: 439):

```
  1 ATGGAAGATT TATACATAAT ACTCGCTTTG GGTTTGGTTG CGATGATCGC

51 CGGATTTATC GATGCGATTG CGGGCGGGGG TGGTTTGATT ACGCTGCCTG

101 CACTCTTGTT GGCAGGTATT CCTCCCGTGT CGGCAATTGC CACCAACAAG

151 CTGCAAGCAG CCGCTGCTAC GTTTTCGGCT ACGGTTTCTT TTGCACGCAA

201 AGGTTTGATT GATTGGAAGA AAGGTCTCCC GATTGCCGCA GCATCGTTTG

251 CAGGCGGCGT GGTCGGTGCA TTATCGGTCA GCTTGGTTTC CAAAGATATT

301 TTGCTGGCGG TCGTGCCGGT TTTGTTGATA TTTGTCGCGC TGTATTTTGT

351 GTTTTCGCCC AAGCTCGACG GCAGTAAGGA AGGCAAAGCC AGAATGTCTT

401 TTTTTCTATT CGGGCTGACG GTTGCACCGC TTTTGGGTTT TTACGACGGT

451 GTGTTCGGAC CGGGTGTCGG CTCGTTTTTT CTGATTGCCT TTATTGTTTT

501 GCTCGGCTGC AAGCTGTTGA ACGCGATGTC TTACACCAAA TTGGCGAACG

551 TTGCTTGCAA TCTTGGTTCG CTATCGGTAT TCCTGCTGCA CGGTTCGATT

601 ATTTTCCCGA TTGTGGCAAC GATGGCGGTC GGTGCGTTTG TCGGTGCGAA

651 TTTAGGTGCG AGATTTGCCG TCCGCTTCGG TTCGAAGCTG ATTAAGCCGC

701 TGCTGATTGT CATCAGCATT TCGATGGCTG TGAAATTGTT GATAGACGAG

751 AGAAATCCGC TGTATCAGAT GATTGTTTCG ATGTTTTAA
```

This corresponds to the amino acid sequence (SEQ ID NO: 440; ORF109ng-1):

```
  1 MEDLYIILAL GLVAMIAGFI DAIAGGGGLI TLPALLLAGI PPVSAIATNK

51 LQAAAATFSA TVSFARKGLI DWKKGLPIAA ASFAGGVVGA LSVSLVSKDI

101 LLAVVPVLLI FVALYFVFSP KLDGSKEGKA RMSFFLFGLT VAPLLGFYDG

151 VFGPGVGSFF LIAFIVLLGC KLLNAMSYTK LANVACNLGS LSVFLLHGSI

201 IFPIVATMAV GAFVGANLGA RFAVRFGSKL IKPLLIVISI SMAVKLLIDE

251 RNPLYQMIVS MF*
```

ORF109ng-1 (SEQ ID NO: 440) and ORF109-1 (SEQ ID NO: 434) show 98.9% identity in 262 aa overlap:

```
                      10        20        30        40        50        60
orf109ng-1.pep MEDLYIILALGLVAMIAGFIDAIAGGGGLITLPALLLAGIPPVSAIATNKLQAAAATFSA
               ||||||||||||||||||||||||||||||||||||||||||||||||||||||||||||
orf109-1       MEDLYIILALGLVAMIAGFIDAIAGGGGLITLPALLLAGIPPVSAIATNKLQAAAATFSA
                      10        20        30        40        50        60
```

```
                        -continued
                 70        80        90       100       110       120
orf109ng-1.pep  TVSFARKGLIDWKKGLPIAAASFAGGVVGALSVSLVSKDILLAVVPVLLIFVALYFVFSP
                ||||||||||||||||||||||||:|||:|||||||||||||||||||||||||||||||
orf109-1        TVSFARKGLIDWKKGLPIAAASFVGGVAGALSVSLVSKDILLAVVPVLLIFVALYFVFSP
                 70        80        90       100       110       120

130       140       150       160       170       180
orf109ng-1.pep  KLDGSKEGKARMSFFLFGLTVAPLLGFYDGVFGPGVGSFFLIAFIVLLGCKLLNAMSYTK
                ||||||||||||||||||||||||||||||||||||||||||||||||||||||||||||
orf109-1        KLDGSKEGKARMSFFLFGLTVAPLLGFYDGVFGPGVGSFFLIAFIVLLGCKLLNAMSYTK
                130       140       150       160       170       180

190       200       210       220       230       240
orf109ng-1.pep  LANVACNLGSLSVFLLHGSIIFPIVATMAVGAFVGANLGARFAVRFGSKLIKPLLIVISI
                |||||||||||||||||||||||||:||||||||||||||||||||||||||||||||||
orf109-1        LANVACNLGSLSVFLLHGSIIFPIAATMAVGAFVGANLGARFAVRFGSKLIKPLLIVISI
                190       200       210       220       230       240

250       260
orf109ng-1.pep  SMAVKLLIDERNPLYQMIVSMFX
                |||||||||||||||||||||||
orf109-1        SMAVKLLIDERNPLYQMIVSMFX
                250       260
```

In addition, ORF109ng-1 (SEQ ID NO: 440) shows homology to a hypothetical Pseudomonas protein (SEQ ID NO: 1140):

```
sp|P29942|YCB9_PSEDE HYPOTHETICAL 27.4 KD PROTEIN IN COBO 3'REGION (ORF9)
)gi|94984|pir|  |I38164 hypothetical protein 9 - Pseudomonas sp )gi|551929 (M62866)
ORF9 [Pseudomonas denitrificans] Length = 261
  Score = 175 bits (439), Expect = 3e-43
  Identities = 83/214 (38%), Positives = 131/214 (60%), Gaps = 1/214 (0%)

Query:   41   PPVSAIATNKLQXXXXXXXXXXXXXXRKGLIDWKKGLPIXXXXXXXXXXXXXXXXXXXKDI    100
              PP+  + TNKLQ              R+G ++ K+ LP+                   D+
Sbjct:   43   PPLQTLGTNKLQGLFGSGSATLSYARRGHVNLKEQLPMALMSAAGAVLGALLATIVPGDV    102

Query:  101   LLAVVPVLLIFVALYFVFSPKLDGSKEGKARMSFFLFGLTVAPLLGFYDGVFGPGVGSFF    160
              L A++P LLI +ALYF   P + G  +  +R++ F+F LT+ PL+GFYDGVFGPG GSFF
Sbjct:  103   LKAILPFLLIAIALYFGLKPNM-GDVDQHSRVTPFVFTLTLVPLIGFYDGVFGPGTGSFF    161

Query:  161   LIAFIVLLGCKLLNAMSYTKLANVACNLGSLSVFLLHGSIIFPIVATMAVGAFVGANLGA    220
              ++ F+ L G  +L A ++TK N    N+G+  VFL G++++ +   M  +G F+GA +G+
Sbjct:  162   MLGFVTLAGFGVLKATAHTKFLNFGSNVGAFGVFLFFGAVLWKVGLLMGLGQFLGAQVGS    221

Query:  221   RFAVRFGSKLIKPLLIVISISMAVKLLIDERNPL    254
              R+A+  G+K+IKPLL+++SI++A++LL D  +PL
Sbjct:  222   RYAMAKGAKIIKPLLVIVSIALAIRLLADPTHPL    255
```

Based on this analysis, including the presence of a putative leader sequence (double-underlined) and several putative transmembrane domains (single-underlined) in the gonococcal protein, it is predicted that the proteins from *N.meningitidis* and *N.gonorrhoeae*, and their epitopes, could be useful antigens for vaccines or diagnostics, or for raising antibodies.

Example 52

The following partial DNA sequence was identified in *N.meningitidis* (SEQ ID NO: 441):

```
  1   ..CTGCTAGGGT ATTGCATCGG TTATCGGTAC GGCTGTTGCA GCAAAACCAG

51   CCGCAGACGG ATTATTTGGT CAAATTCGGA TCGTTTTGGG CGAG.ATTTT

101   TGGTTTTCTG GGACTGTATG ACGTCTATGC TTCGGCATGG TTTGTCGTTA

151   TCATGATGTT TTTGGTGGTT TCTACCAGTT TGTGCCTGAT TCGCAATGTG

201   CCGCCGTTCT GGCGCGAAAT GAAGTCTTTT CGGGAAAAGG TTAAAGAAAA

251   ATCTCTGGCG GCGATGCGCC ATTCTTCGCT GTTGGATGTA AAAATTGCGC
```

-continued

```
301   CCGAGGTTGC CAAACGTTAT CTGGAAGTAC AAGGTTTTCA GGGGAAAACC

351   ATTAACCGTG AAGACGGGTC GGTTCTGATT GCCGCCAAAA AAGGCACAAT

401   GAACAAATGG GGCTATATCT TTGCCCATGT TGCTTTGATT GTCATTTGCC

451   TGGGCGGGTT GATAGACAGT AACCTGCTGT TGAAACTGGG TATGCTGACC

501   GGTCGGATTG TTCCGGACAA TCAGGCGGTT TATGCCAAGG ATTTC.AAGC

551   CCGAAAGTAT .TTTGGGTGC gTCCAATCTC TCATTTAGGG GCAACGTCAA

601   TATTTCCG.A GGGGCAGAgT GCGGATGTGG TTTTCCTGA
```

This corresponds to the amino acid sequence (SEQ ID NO: 442; ORF110):

```
  1   ..LLGIASVIGT LLQQNQPQTD YLVKFGSFWA XIFGFLGLYD VYASAWFVVI

51   MMFLVVSTSL CLIRNVPPFW REMKSFREKV KEKSLAAMRH SSLLDVKIAP

101   EVAKRYLEVQ GFQGKTINRE DGSVLIAAKK GTMNKWGYIF AHVALIVICL

151   GGLIDSNLLL KLGMLTGRIF RTIRRFMPRI XKPESXFGCV QSLI*GQRQY

201   FXRGRVRMWF S*
```

Computer analysis of this amino acid sequence gave the following results:
Homology with ORF88a from *N.meningitidis* (Strain A)

ORF110 (SEQ ID NO: 442) shows 91.5% identity over a 188aa overlap with ORF88a (SEQ ID NO: 332) from strain A of *N. meningitidis*:

```
                          10         20         30         40         50         60
orf88a.pep    MSKSRRSPPLLSRPWFAFFSSMRFAVALLSLLGIASVIGTVLQQNQPQTDYLVKFGSFWA
                                      |||||||||:||||||||||||||||||
orf110                                LLGIASVIGTLLQQNQPQTDYLVKFGSFWA
                                                 10         20         30

70         80         90        100        110        120
orf88a.pep    QIFGFLGLYDVYASAWFVVIMMFLVVSTSLCLIRNVPPFWREMKSFREKVKEKSLAAMRH
              ||||||||||||||||||||||||||||||||||||||||||||||||||||||||||||
orf110        XIFGFLGLYDVYASAWFVVIMMFLVVSTSLCLIRNVPPFWREMKSFREKVKEKSLAAMRH
                         40         50         60         70         80         90

130        140        150        160        170        180
orf88a.pep    SSLLDVKIAPEVAKRYLEVQGFQGKTINREDGSVLIAAKKGTMNKWGYIFAHVALIVICL
              ||||||||||||||||||||||||||||||||||||||||||||||||||||||||||||
orf110        SSLLDVKIAPEVAKRYLEVQGFQGKTINREDGSVLIAAKKGTMNKWGYIFAHVALIVICL
                        100        110        120        130        140        150

190        200        210        220        230        240
orf88a.pep    GGLIDSNLLLKLGMLTGRIVPDNQAVYAKDFKPESILGASNLSFRGNVNISEGQSADVVF
              |||||||||||||||||||     :  : :  ||||  :|
orf110        GGLIDSNLLLKLGMLTGRIFRTIRRFMPRIXKPESXFGCVQSLIXGQRQYFXRGRVRMWF
                        160        170        180        190        200        210

250        260        270        280        290        300
orf88a.pep    LNADNGILVQDLPFEVKLKKFHIDFYNTGMPRDFASDIEVTDKATGEKLERTIRVNHPLT orf110        SX
```

However, ORF88 (SEQ ID NO: 328) and ORF110 (SEQ D NO: 442) do not align, because they represent two diffferent fragments of the same protein.

Homology with a Predicted ORF from *N.gonorrhoeae*

ORF110 (SEQ ID NO: 442) shows 88.6% identity over a 211 aa overlap with a predicted ORF (ORF110.ng) (SEQ ID NO: 444) from *N. gonorrhoeae*:

```
orf110.pep                             LLGIASVIGTLLQQNQPQTDYLVKFGSFWA   30
                                       ||||||||||:||||||||||||||| ||:
orf110ng    MSKSRISPTLLSRPWFAFFSSMRFAVALLSLLGIASVIGTVLQQNQPQTDYLVKFGPFWT   60 orf110.pep  XIFGFLGLYDVYASAWFVVIMMFLVVSTSLCLIRNVPPFWREMKSFREKVKEKSLAAMRH   90
            || |||||||||||||||||||||||||||||||||||||||||||||||||||||||||
orf110ng    RIFDFLGLYDVYASAWFVVIMMFLVVSTSLCLIRNVPPFWREMKSFREKVKEKSLAAMRH  120 orf110.pep  SSLLDVKIAPEVAKRYLEVQGFQGKTINREDGSVLIAAKKGTMNKWGYIFAHVALIVICL  150
            ||||||||||||||||||||:||||||::|||||||||||||||||||||| ||||||||
orf110ng    SSLLDVKIAPEVAKRYLEVRGFQGKTVSREDGSVLIAAKKGTMNKWGYIXAHVALIVICL  180 orf110.pep  GGLIDSNLLLKLGMLTGRIFRTIRRFMPRIXKPESXFGCVQSLIXGQRQYFXRGRVRMWF  210
            |  ||: |||||||||:| |||: || |||| |||| :| ||||| |||||| ||:||||
orf110ng    GRLINXNLLLKLGMLAGSIFRNNRRVMPRISKPESIWGGVQSLIKGQRQYFQRGKVRMWF  240 orf110.pep  S                                                             211
            |
orf110ng    S                                                             241
```

The complete length ORF110ng nucleotide sequence (SEQ ID NO: 443) is predicted to encode a protein having amino acid sequence (SEQ ID NO: 444):

```
  1  MSKSRISPTL LSRPWFAFFS SMRFAVALLS LLGIASVIGT VLQQNQPQTD
 51  YLVKFGPFWT RIFDFLGLYD VYASAWFVVI MMFLVVSTSL CLIRNVPPFW
101  REMKSFRFKV KEKSLAAMRH SSLLDVKIAP EVAKRYLEVR GFQGKTVSRE
151  DGSVLIAAKK GTMNKWGYIX AHVALIVICL GRLINXNLLL KLGMLAGSIF
201  RNNRRVMPRI SKPESIWGGV QSLIKGQRQY FQRGKVRMWF S*
```

Based on the putative transmembrane domains in the gonococcal protein, it is predicted that the proteins from *N.meningitidis* and *N.gonorrhoeae*, and their epitopes, could be useful antigens for vaccines or diagnostics, or for raising antibodies.

Example 53

The following DNA sequence was identified in *N.meningitidis* (SEQ ID NO: 445):

```
  1  ATGCCGTCTG AAACACGCCT GCCGAACTTT ATCCGCGTCT TGATATTTGC
 51  CCTGGGTTTC ATCTTCCTGA ACGCCTGTTC GGAACAAACC GCGCAAACCG
101  TTACCCTGCA AGGCGAAACG ATGGGCACGA CCTATACCGT CAAATACCTT
151  TCAAATAATC GGGACAAACT CCCCTCACCT GCCGAAATAC AAAAACGCAT
201  CGATGACGCG CTTAAAGAAG TCAACCGGCA GATGTCCACC TATCAGCCCG
251  ACTCCGAAAT CAGCCGGTTC AACCAACACA CAGCCGGCAA GCCCCTCCGC
301  ATTTCAAGCG ACTTCGCACA CGTTACTGCC GAAGCCGTCC GCCTGAACCG
351  CCTGACACAC GGCGCGCTGG ACGTAACCGT CGGCCCCTTG GTCAACCTTT
401  GGGGATTCGG CCCCGACAAA TCCGTTACCC GTGAACCGTC GCCGGAACAA
451  ATCAAACAGG CGGCATCTTA TACGGGCATA GACAAAATCA TTTTGAAACA
501  AGGCAAAGAT TACGCTTCCT TGAGCAAAAC CCACCCCAAG GCCTATTTGG
```

```
 551   ATTTATCTTC GATTGCCAAA GGCTTCGGCG TTGATAAAGT TGCGGGCGAA

601   CTGGAAAAAT ACGGCATTCA AAATTATCTG GTCGAAATCG GCGGCGAGTT

651   GCACGGCAAA GGCAAAAACG CGCGCGGCGA ACCGTGGCGC ATCGGTATCG

701   AGCAGCCCAA TATCGTCCAA GGCGGCAATA CGCAGATTAT CGTCCCGCTG

751   AACAACCGTT CGCTTGCCAC TTCCGGCGAT TACCGTATTT TCCACGTCGA

801   TAAAAACGGC AAACGCCTCT CCCATATCAT CAACCCGAAC AACAAACGAC

851   CCATCAGCCA CAACCTCGCC TCCATCAGCG TGGTCGCAGA CAGTGCGATG

901   ACGGCGGACG GCTTGTCCAC AGGATTATTC GTATTGGGCG AAACCGAAGC

951   CTTAAAGCTG GCAGAGCGCG AAAAACTCGC TGTTTTCCTG ATTGTCAGGG

1001   ATAAAGGCGG CTACCGCACC GCCATGTCTT CCGAATTTGA AAAACTGCTC

1051   CGCTAA
```

This corresponds to the amino acid sequence (SEQ ID NO: 446; ORF111):

```
  1   MPSETRLPNF IRVLIFALGF IFLNACSEQT AQTVTLQGET MGTTYTVKYL

51   SNNRDKLPSP AEIQKRIDDA LKEVNRQMST YQPDSEISRF NQHTAGKPLR

101   ISSDFAHVTA EAVRLNRLTH GALDVTVGPL VNLWGFGPDK SVTREPSPEQ

151   IKQAASYTGI DKIILKQGKD YASLSKTHPK AYLDLSSIAK GFGVDKVAGE

201   LEKYGIQNYL VEIGGELHGK GKNARGEPWR IGIEQPNIVQ GGNTQIIVPL

251   NNRSLATSGD YRIFHVDKNG KRLSHIINPN NKRPISHNLA SISVVADSAM

301   TADGLSTGLF VLGETEALKL AEREKLAVFL IVRDKGGYRT AMSSEFEKLL

351   R*
```

Computer analysis of this amino acid sequence gave the following results:
Homology with a Predicted ORF from *N.meningitidis* (Strain A)

ORF111 (SEQ ID NO: 446) shows 96.9% identity over a 351 aa overlap with an ORF (ORF111a) (SEQ ID NO: 448) from strain A of *N. meningitidis*:

```
                       10         20         30         40         50         60
orf111a.pep   MPSETRLPNFIRTLIPALSFIFLNACSEQTAQTVTLQGETMGTTYTVKYLSNNRDXLPSP
              ||||||||||:|||||:||||||||||||||||||||||||||||||||||||| ||||
orf111        MPSETRLPNFIRVLIFALGFIFLNACSEQTAQTVTLQGETMGTTYTVKYLSNNRDKLPSP
                       10         20         30         40         50         60

70         80         90        100        110        120
orf111a.pep   AEIQXRIDDALKEVNRQMSTYQPDSEISRFNQHTAGKPLRISSDFAHVTAEAVHLNRLTH
              |||| |||||||||||||||||||||||||||||||||||||||||||||||||:|||||
orf111        AEIQKRIDDALKEVNRQMSTYQPDSEISRFNQHTAGKPLRISSDFAHVTAEAVRLNRLTH
                       70         80         90        100        110        120

130        140        150        160        170        180
orf111a.pep   GALDVTVGPLVNLWGFGPDKSVTREPSPEQIKQAASYTGIDKIILKQGKDYASLSKTHPK
              ||||||||||||||||||||||||||||||||||||||||||||||||||||||||||||
orf111        GALDVTVGPLVNLWGFGPDKSVTREPSPEQIKQAASYTGIDKIILKQGKDYASLSKTHPK
                      130        140        150        160        170        180

190        200        210        220        230        240
orf111a.pep   AYLDLSSIAKGFGVDXVAGELEKYGIQNYLVEIGGELHGKXKNARGEPWRIGIEQPNIVQ
              |||||||||||||||| ||||||||||||||||||||||| |||||||||||||||||||
orf111        AYLDLSSIAKGFGVDKVAGELEKYGIQNYLVEIGGELHGKGKNARGEPWRIGIEQPNIVQ
                      190        200        210        220        230        240
```

```
                250        260        270        280        290        300
orf111a.pep GGNTQIIVPLNNRSXATSGDYRIFHVDKSGKRLSHIINPNNKRPISHNLASISVXADSAM
            ||||||||||||||| |||||||||||||||:|||||||||||||||||||||| ||||
orf111      GGNTQIIVPLNNRSLATSGDYRIFHVDKNGKRLSHIINPNNKRPISHNLASISVVADSAM
                250        260        270        280        290        300

310        320        330        340        350
orf111a.pep TADGXSTGLFVLGETEALKLAEREKLAVFLIVRDKGGYRTAMSSEFEKLLRX
            |||| |||||||||||||||||||||||||||||||||||||||||||||||
orf111      TADGLSTGLFVLGETEALKLAEREKLAVFLIVRDKGGYRTAMSSEFEKLLRX
                310        320        330        340        350
```

The complete length ORF111a nucleotide sequence (SEQ ID NO: 447) is:

```
   1  ATGCCGTCTG AAACACGCCT GCCGAACTTT ATCCGCACCT TGATATTTGC
  51  CCTGAGTTTT ATCTTCCTGA ACGCCTGTTC GGAACAAACC GCGCAAACCG
 101  TTACCCTGCA AGGTGAAACG ATGGGCACGA CCTATACCGT CAAATACCTT
 151  TCAAATAATC GGGACNAACT CCCNTCACCT GCCGAAATAC AAAANCGCAT
 201  CGATGACGCG CTTAAAGAAG TCAACCGGCA GATGTCCACC TATCAGCCCG
 251  ACTCCGAAAT CAGCCGGTTC AACCAACACA CAGCCGGCAA GCCCCTCCGC
 301  ATTTCAAGCG ACTTCGCACA CGTTACTGCC GAAGCCGTCC ACCTGAACCG
 351  CCTGACACAC GGCGCGCTGG ACGTAACCGT CGGCCCCTTG GTCAACCTTT
 401  GGGGATTCGG CCCCGACAAA TCCGTTACCC GTGAACCGTC GCCGGAACAA
 451  ATCAAACAAG CAGCATCTTA TACGGGCATA GACAAAATCA TTTTGAAACA
 501  AGGCAAAGAT TACGCTTCCT TGAGCAAAAC CCACCCCAAG GCCTATTTGG
 551  ATTTATCTTC GATTGCCAAA GGCTTCGGCG TTGATNANGT TGCGGGCGAA
 601  CTGGAAAAAT ACGGCATTCA AAATTATCTG GTCGAAATCG GCGGNGAGTT
 651  GCACGGCAAA GNCAAAAACG CGCGCGGCGA ACCTTGGCGC ATCGGCATCG
 701  AACAGCCCAA CATCGTCCAA GGCGGCAATA CGCAGATTAT CGTCCCGCTG
 751  AACAACCGTT CGNTTGCCAC TTCCGGCGAT TACCGTATTT CCACGTCGA
 801  TAAAAGCGGC AAACGCCTCT CCCATATCAT TAATCCGAAC AACAAACGAC
 851  CCATCAGCCA CAACCTCGCC TCCATCAGCG TGNTCGCAGA CAGTGCGATG
 901  ACGGCGGACG GCTTNTCCAC AGGATTATTC GTATTGGGCG AAACCGAAGC
 951  CTTAAAGCTG GCAGAGCGCG AAAAACTCGC TGTTTTCCTG ATTGTCAGGG
1001  ATAAAGGCGG CTACCGCACC GCCATGTCTT CCGAATTTGA AAAACTGCTC
1051  CGCTAA
```

This encodes a protein having amino acid sequence (SEQ ID NO: 448):

```
   1  MPSETRLPNF IRTLIFALSF IFLNACSEQT AQTVTLQGET MGTTYTVKYL
  51  SNNRDXLPSP AEIQXRIDDA LKEVNRQMST YQPDSEISRF NQHTAGKPLR
 101  ISSDFAHVTA EAVHLNRLTH GALDVTVGPL VNLWGFGPDK SVTREPSPEQ
 151  IKQAASYTGI DKIILKQGKD YASLSKTHPK AYLDLSSIAK GFGVDXVAGE
 201  LEKYGIQNYL VEIGGELHGK XKNARGEPWR IGIEQPNIVQ GGNTQIIVPL
 251  NNRSXATSGD YRIFHVDKSG KRLSHIINPN NKRPISHNLA SISVXADSAM
 301  TADGXSTGLF VLGETEALKL AEREKLAVFL IVRDKGGYRT AMSSEFEKLL
 351  R*
```

Homology with a Predicted ORF from N.gonorrhoeae
ORF111 (SEQ ID NO: 446) shows 96.6% identity over a
351aa overlap with a predicted ORF (ORF111.ng) (SEQ ID
NO: 450) from N. gonorrhoeae:

```
                10        20        30        40        50        60
orf111ng MPSETRLPNLIRALIFALGFIFLNACSEQTAQTVTLQGETMGTTYTVKYLSNNRDKLPSP
         ||||||||:||:||||||||||||||||||||||||||||||||||||||||||||||||
orf111   MPSETRLPNFIRVLIFALGFIFLNACSEQTAQTVTLQGETMGTTYTVKYLSNNRDKLPSP
                10        20        30        40        50        60

70        80        90       100       110       120
orf111   AKIQKRIDDALKEVNRQMSTYQTDSEISRFNQHTAGKPLRISSDFAHVTAEAVRLNRLTH
         |:|||||||||||||||||||| |||||||||||||||||||||||||||||||||||||
orf111   AEIQKRIDDALKEVNRQMSTYQPDSEISRFNQHTAGKPLRISSDFAHVTAEAVRLNRLTH
                70        80        90       100       110       120

130       140       150       160       170       180
orf111ng GALDVTVGPLVNLWGFGPDKSVTREPSPEQIKQAASYTGIDKIILQQGKDYASLSKTHPK
         |||||||||||||||||||||||||||||||||||||||||||:||||||||||||||||
orf111   GALDVTVGPLVNLWGFGPDKSVTREPSPEQIKQAASYTGIDKIILKQGKDYASLSKTHPK
               130       140       150       160       170       180

190       200       210       220       230       240
orf111ng AYLDLSSIAKGFGVDKVAGELEKYGIQNYLVEIGGELHGKGKNAHGEPWRIGIEQPNIIQ
         |||||||||||||||||||||||||||||||||||||||||||:|||||||||||||:|
orf111   AYLDLSSIAKGFGVDKVAGELEKYGIQNYLVEIGGELHGKGKNARGEPWRIGIEQPNIVQ
               190       200       210       220       230       240

250       260       270       280       290       300
orf111ng GGNTQIIVPLNNRSLATSGDYRIFHVDKNGKRLSHIINPNNKRPISHNLASISVVSDSAM
         |||||||||||||||||||||||||||||||||||||||||||||||||||||||:|||
orf111   GGNTQIIVPLNNRSLATSGDYRIFHVDKNGKRLSHIINPNNKRPISHNLASISVVADSAM
               250       260       270       280       290       300

310       320       330       340       350
orf111ng TADGLSTGLFVLGETEALRLAEQEKLAVFLIVRDKDGYRTAMSSEFAKLLRX
         |||||||||||||||||:|||:|||||||||||| |||||||||||| ||||
orf111   TADGLSTGLFVLGETEALKLAEREKLAVFLIVRDKGGYRTAMSSEFEKLLRX
               310       320       330       340       350
```

The complete length ORF111ng nucleotide sequence
(SEQ ID NO: 449) is:

```
  1   ATGCCGTCTG AAACACGCCT GCCGAACCTT ATCCGCGCCT TGATATTTGC

51   CCTGGGTTTC ATCTTCCTGA ACGCCTGTTC GGaacaaacC GCGCAaaccg

101   TTACCCTGCA AGGCGAAAcg aTGGGTACGA CCTATACCGT CAAATACCTT

151   TCAAATAATC GGGACAAACT CCCCTCCCCT GCCAAAATAC AAAAGCGCAT

201   TGATGATGCG CTTAAAGAAG TCAACCGGCA GATGTCCACC TACCAGACCG

251   ATTCCGAAAT CAGCCGGTTC AACCAACACA CAGCCGGCAA GCCCCTCCGC

301   ATTTCAAGCG ATTTCGCACA CGTTACCGCC GAAGCCGTCC GCCTGAACCG

351   CCTGACTCAC GGCGCACTGG ACGTAACCGT CGGCCCTTTG GTCAACCTTT

401   GGGGGTTCGG CCCCGACAAA TCCGTTACCC GTGAACCGTC GCCGGAACAA

451   ATCAAACAGG CGGCATCTTA TACGGGCATA GACAAAATCA TTTTGCAACA

501   AGGCAAAGAT TACGCTTCCT TGAGCAAAAC CCACCCCAAA GCCTATTTGG

551   ATTTATCTTC GATTGCCAAA GGCTTCGGCG TTGATAAAGT TGCGGGCGAA

601   CTGGAAAAAT ACGGCATTCA AAATTATCTG GTCGAAAtcg gcggcGAGTT

651   GCACGGCAAA GGCAAAAATG CGCACGGCGA ACCGTGGCGC ATCGGTATAG

701   AGCAACCCAA TATCATCCAA GgcgGCAata CGCAGATTAt cgtcccgctg 751   aaCaaccgtt cgctTGCCAC TTCCGGCGAT TAccgtaTTT tccacgtcgA
```

```
-continued
 801  TAAAAAcggc aaacgcctttt cccacaTCAT CAATCCCaAC aacAAACgac 851  ccATCAGcca caacctcgcc tccatcagcg tggtctcAGA CAGTGCAATG 901  ACGGCGGACG GTTtatCCAC AGGATTATTT GTTTTAGGCG AAACCGAAGC

951  CTTAAGGCTG GCAGAACAAG AAAAACTCGC TGTTTTCCTA ATTGTCCGGG

1001  ATAAGGACGG CTACCGCACC GCCATGTCTT CCGAATTTGC CAAGCTGCTC

1051  CGCTAA
```

This encodes a protein having amino acid sequence (SEQ ID NO: 450):

```
  1  MPSETRLPNL IRALIFALGF IFLNACSEQT AQTVTLQGET MGTTYTVKYL

51  SNNRDKLPSP AKIQKRIDDA LKEVNRQMST YQTDSEISRF NQHTAGKPLR

101  ISSDFAHVTA EAVRLNRLTH GALDVTVGPL VNLWGFGPDK SVTREPSPEQ

151  IKQAASYTGI DKIILQQGKD YASLSKTHPK AYLDLSSIAK GFGVDKVAGE

201  LEKYGIQNYL VEIGGELHGK GKNAHGEPWR IGIEQPNIIQ GGNTQIIVPL

251  NNRSLATSGD YRIFHVDKNG KRLSHIINPN NKRPISHNLA SISVVSDSAM

301  TADGLSTGLF VLGETEALRL AEQEKLAVFL IVRDKDGYRT AMSSEFAKLL

351  R*
```

This protein shosw homology with a hypothetical lipoprotein precursor (SEQ ID NO: 1141) from *H.influenzae*:

```
sp|P44550|YOJL_HAEIN HYPOTHETICAL LIPOPROTEIN HI0172 PRECURSOR )gi|1074292|pir|4
hypothetical protein HI0172 - Haemophilus influenzae (strain Rd KW20) )gi|1573128
(U32702) hypothetical [Haemophilus influenzae]Length = 346
Score = 353 bits (896), Expect = 9e-97
Identities = 181/344 (52%), Positives = 247/344 (71%), Gaps = 4/344 (1%)

Query:      7  LPNLIRALIFALGFIFLNACSEQTAQTVTLQGETMGTTYTVKYLSNNRDKLPSPAKIQKR     66
               + LI +I   + L AC ++T + ++L G+TMGTTY VKYL +    S K  +
Sbjct:      1  MKKLISGIIAVAMALSLAACQKET-KVISLSGKTMGTTYHVKYLDDGSITATSE-KTHEE   58

Query:     67  IDDALKEVNRQMSTYQTDSEISRFNQHT-AGKPLRISSDFAHVTAEAVRLNRLTHGALDV  125
               I+  LK+VN +MSTY+ DSE+SRFNQ+T    P+ IS+DFA V AEA+RLN++T GALDV
Sbjct:     59  IEAILKDVNAKMSTYKKDSELSRFNQNTQVNTPIEISADFAKVLAEAIRLNKVTEGALDV  118

Query:    126  TVGPLVNLWGFGPDKSVTREPSPEQIKQAASYTGIDKIILQQGKDYASLSKTHPKAYLDL  185
               TVGP+VNLWGFGP+K   ++P+PEG+ +  ++ GIDKI L   K+ A+LSK  P+ Y+DL
Sbjct:    119  TVGPVVNLWGFGPEKRPEKQPTPEQLEARQAWVGIDKITLDTNKEKATLSKALPQVYVDL  178

Query:    186  SSIAKGFGVDKVAGELEKYGIQNYLVEIGGELHGKGKNAHGEPWRIGIEQPNIIQGGNTQ  245
               SSIAKGFGVD+VA +LE+   QNY+VEIGGE+  KGKN G+PW+I IE+P+
Sbjct:    179  SSIAKGFGVDQVERKLEQLNAQNYMVEIGGEIRAKGKNIEGKPWQIAIEKPTTTGERAVE  238

Query:    246  IIVPLNNRSLATSGDYRIFHVDKNGKRLSHIINPNNKRPISHNLASISVVSDSAMTADGL  305
               ++ LNN  +A+SGDYRI+  ++NGKR +H I+P    PI H+LASI+V++ ++MTADGL
Sbjct:    239  AVIGLNNMGMASSGDYRIY-FEENGKRFAHEIDPKTGYPIQHHLASITVLAPTSMTADGL  297

Query:    306  STGLFVLGETEALRLAEQEKLAVFLIVRDKDGYRTAMSSEFAKL                 349
               STGLFVLGE +AL +AE+  LAV+LI+R  +G+ T  SS F KL
Sbjct:    298  STGLFVLGEDKALEVAEKNNLAVYLIIRTDNGFVTKSSSAFKKL                 341
```

Based on this analysis, it is predicted that the proteins from *N.meningitidis* and *N.gonorrhoeae*, and their epitopes, could be useful antigens for vaccines or diagnostics, or for raising antibodies.

Example 54

The following partial DNA sequence was identified in *N.meningitidis* (SEQ ID NO: 451):

```
  1  ..CCGTGCCGCC GACAGGGCGA CGACGTGTAT GCGGCGCACG CGTCCCGTCA
 51    AAAATTGTGG CTGCGCTTCA TCGGCGGCCG GTCGCATCAA AATATACGGG
101    GCGGCGCGGC TGCGGACGGG TGGCGCAAAG GCGTGCAAAT CGGCGGCGAG
151    GTGTTTGTAC GGCAAAATGA AGGCAGCCkA yTGGCAATCG GCGTGATGGG
201    CGGCAGGGCC GGCCAGCACG CwTCAGTCAA CGGCAAAGGC GGTGCGGCAG
251    gCAGTGATTT GTATGGTTAT GgCGGGGgTG TTTATGCTgC GTGGCATCAG
301    TTGCGCGATA AACAAACGGG TgCGTATTTG GACGGCTGGT TGCAATACCA
351    ACGTTTCAAA CACCGCATCA ATGATGAAAA CCGTGCGGAA CgCTACAAAA
401    CCAAAGGTTG GACGGCTTCT GTCGAAGGCG GCTACAACGC GCTTGTGGCG
451    GAAGGCATTG TCGGAAAAGG CAATAATGTG CGGTTTTACC TACAACCGCA
501    GgCGCAGTTT ACCTACTTGG GCGTAAACGG CGGCTTTACC GACAGCGAGG
551    GGACGGCGGT CGGACTGCTC GGCAGCGGTC AGTGGCAAAG CCGCGCCGGC
601    AtTCGGGCAA AAACCCGTTT TGCTTTGCGT AACGGTGTCA ATCTTCAGCC
651    TTTTGCCGCT TTTAATGTtt TGCACAGGTC AAAATCTTTC GGCGTGGAAA
701    TGGACGGCGA AAAACAGACG CTGGCAGGCA GGACGGCACT CGAAGGGCGG
751    TTCGGTATTG AAGCCGGTTG GAAAGGCCAT ATGTCCGCA..
```

This corresponds to the amino acid sequence (SEQ ID NO: 452; ORF35):

```
  1  ..PCRRQGDDVY AAHASRQKLW LRFIGGRSHQ NIRGGAAADG WRKGVQIGGE
 51    VFVRQNEGSX LAIGVMGGRA GQHASVNGKG GAAGSDLYGY GGGVYAAWHQ
101    LRDKQTGAYL DGWLQYQRFK HRINDENRAE RYKTKGWTAS VEGGYNALVA
151    EGIVGKGNNV RFYLQPQAQF TYLGVNGGFT DSEGTAVGLL GSGQWQSRAG
201    IRAKTRFALR NGVNLQPFAA FNVLHRSKSF GVEMDGEKQT LAGRTALEGR
251    FGIEAGWKGH MSA..
```

Computer analysis of this amino acid sequence gave the following results:
Homology with Putative Secreted VirG-homolgue of *N.meningitidis* (Accession Number A32247) ORF (SEQ ID NO: 452) and virg-h protein (SEQ ID NO: 1146) show 51% aa identity in 261 aa overlap:

```
Orf35     5 QGDDVYAAHASRQKLWLRFIGGRSHQNIRGGAA-ADGWRKGVQIGGEVFVRQNEGSXLAI  63
            + D++      R+ LWLR I G S+Q ++G   A  +G+RKGVQ+GGEVF  QNE + L+I
virg-h  396 KNSDIFDRTLPRKGLWLRVIDGHSNQWVQGKTAPVEGYRKGVQLGGEVFTWQNESNQLSI  455

Orf35    64 GVMGGRAGQHASVNGKG--GAAGSDLYGYGGGVYAAWHQLRDKQTGAYLDGWLQYQRFKH 121
            G+MGG+A Q ++ +           ++ G+G GVYA WHQL+DKQTGAY D W+QYQRF+H
virg-h  456 GLMGGQAEQRSTFHNPDTDNLTTGNVKGFGAGVYATWHQLQDKQTGAYADSWMQYQRFRH 515

Orf35   122 RINDENRAERYKTKGWTASVEGGYNALVAEGIVGKGNNVRFYLQPQAQFTYLGVNGGFTD 181
            RIN E+  ER+ +KG TAS+E GYNAL+AE    KGN++R YLQPQAQ TYLGVNG F+D
virg-h  516 RINTEDGTERFTSKGITASIEAGYNALLAEHFTKKGNSLRVYLQPQAQLTYLGVNGKFSD 575
```

-continued

```
Orf35   182 SEGTAVGLLGSGQWQSRAGIRAKTRFALRNGVNLQPFAAFNVLHRSKSFGVEMDGEKQTL 241
            SE   V LLGS Q Q+R G++AK +F+L   + ++PFAA N L+ +K FGVEMDGE++ +
virg-h  576 SENAHVNLLGSRQLQTRVGVQAKAQFSLYKNIAIEPFAAVNALYHNKPFGVEMDGERRVI 635

Orf35   242 AGRTALEGRFGIEAGWKGHMS                                        262
            +TA+E + G+    K H++
virg-h  636 NNKTAIESQLGVAVKIKSHLT                                        656
```

Homology with a Predicted ORF from *N.meningitidis* (Strain A)

ORF35 (SEQ ID NO: 452) shows 96.9% identity over a 259aa overlap with an ORF (ORF35a) (SEQ ID NO: 454) from strain A of *N. meningitidis*:

```
                            10        20        30
orf35.pep                   PCRRQGDDVYAAHASRQKLWLRFIGGRSHQNIRG
                            :|||||||  |||||||||||||||||||||||
orf35a     QRLAIPEAEAVLYAQQAYAANTLFGLRAADRGDDVYAADPSRQKLWLRFIGGRSHQNIRG
           310       320       330       340       350       360

40        50        60        70        80        90
orf35.pep  GAAADGWRKGVQIGGEVFVRQNEGSXLAIGVMGGRAGQHASVNGKGGAAGSDLYGYGGGV
           ||||||  ||||||||||||||||| ||||||||||||||||||||||||||  ||||||
orf35a     GAAADGRRKGVQIGGEVFVRQNEGSRLAIGVMGGRAGQHASVNGKGGAAGSYLHGYGGGV
           370       380       390       400       410       420

100       110       120       130       140       150
orf35.pep  YAAWHQLRDKQTGAYLDGWLQYQRFKHRINDENRAERYKTKGWTASVEGGYNALVAEGIV
           |||||||||||||||||||||||||||||||||||||||||||||||||||||||||:|
orf35a     YAAWHQLRDKQTGAYLDGWLQYQRFKHRINDENRAERYKTKGWTASVEGGYNALVAEGVV
           430       440       450       460       470       480

160       170       180       190       200       210
orf35.pep  GKGNNVRFYLQPQAQFTYLGVNGGFTDSEGTAVGLLGSGQWQSRAGIRAKTRFALRNGVN
           ||||||||||||||||||||||||||||||||||||||||||||||||||||||||||||
orf35a     GKGNNVRFYLQPQAQFTYLGVNGGFTDSEGTAVGLLGSGQWQSRAGIRAKTRFALRNGVN
           490       500       510       520       530       540

220       230       240       250       260
orf35.pep  LQPFAAFNVLHRSKSFGVEMDGEKQTLAGRTALEGRFGIEAGWKGHMSA
           |||||||||||||||||||||||||||||||||||||||||||||||||
orf35a     LQPFAAFNVLHRSKSFGVEMDGEKQTLAGRTALEGRFGIEAGWKGHMSARIGYGKRTDGD
           550       560       570       580       590       600 orf35a     KEAALSLKWLFX
           610       620
```

The complete length ORF35a nucleotide sequence (SEQ ID NO; 453) is:

```
  1   ATGTTCAGAG CTCAGCTTGG TTCAAATACT CGTTCTACCA AAATCGGCGA

51   CGATGCCGAT TTTTCATTTT CAGACAAGCC GAAACCCGGC ACTTCCCATT

101   ATTTTTCCAG CGGTAAAACC GATCAAAATT CATCCGAATA TGGGTATGAC

151   GAAATCAATA TCCAAGGTAA AAACTACAAT AGCGGCATAC TCGCCGTCGA

201   TAATATGCCC GTTGTTAAGA AATATATTAC AGATACTTAC GGGGATAATT

251   TAAAGGATGC GGTTAAGAAG CAATTACAGG ATTTATACAA AACAAGACCC

301   GAAGCTTGGG AAGAAAATAA AAAACGGACT GAGGAGGCGT ATATAGAACA

351   GCTTGGACCA AAATTTAGTA TACTCAAACA GAAAAACCCC GATTTAATTA

401   ATAAATTGGT AGAAGATTCC GTACTCACTC CTCATAGTAA TACATCACAG

451   ACTAGTCTCA ACAACATCTT CAATAAAAAA TTACACGTCA AAATCGAAAA

501   CAAATCCCAC GTCGCCGGAC AGGTGTTGGA ACTGACCAAG ATGACGCTGA
```

```
 551  AAGATTCCCT TTGGGAACCG CGCCGCCATT CCGACATCCA TATGCTGGAA
 601  ACTTCCGATA ATGCCCGCAT CCGCCTGAAC ACGAAAGATG AAAAACTGAC
 651  CGTCCATAAA GCGTATCAGG GCGGTGCGGA TTTCCTGTTC GGCTACGACG
 701  TGCGGGAGTC GGACAAACCC GCCCTGACCT TTGAAGAAAA AGTCAGCGGA
 751  CAATCCGGCG TGGTTTTGGA ACGCCGGCCG GAAAATCTGA AAACGCTCGA
 801  CGGGGGCAAA CTGATTGCGG CGGAAAAGGC AGACTCTAAT TCGTTTGCGT
 851  TTAAACAAAA TTACCGGCAG GGACTGTACG AATTATTGCT CAAGCAATGC
 901  GAAGGCGGAT TTTGCTTGGG CGTGCAGCGT TTGGCTATCC CCGAGGCGGA
 951  AGCGGTTTTA TATGCCCAAC AGGCTTATGC GGCAAATACT TTGTTCGGGC
1001  TGCGTGCCGC CGACAGGGGC GACGACGTGT ATGCCGCCGA TCCGTCCCGT
1051  CAAAAATTGT GGCTGCGCTT CATCGGCGGC CGGTCGCATC AAAATATACG
1101  GGGCGGCGCG GCTGCGGACG GCGGCGCAA AGGCGTGCAA ATCGGCGGCG
1151  AGGTGTTTGT ACGGCAAAAT GAAGGCAGCC GGCTGGCAAT CGGCGTGATG
1201  GGCGGCAGGG CTGGCCAGCA CGCATCAGTC AACGGCAAAG GCGGTGCGGC
1251  AGGCAGTTAT TTGCATGGTT ATGGCGGGGG TGTTTATGCT GCGTGGCATC
1301  AGTTGCGCGA TAAACAAACG GGTGCGTATT TGGACGGCTG GTTGCAATAC
1351  CAACGTTTCA ACACCGCAT CAATGATGAA AACCGTGCGG AACGCTACAA
1401  AACCAAAGGT TGGACGGCTT CTGTCGAAGG CGGCTACAAC GCGCTTGTGG
1451  CGGAAGGCGT TGTCGGAAAA GGCAATAATG TGCGGTTTTA CCTGCAACCG
1501  CAGGCGCAGT TTACCTACTT GGGCGTAAAC GGCGGCTTTA CCGACAGCGA
1551  GGGGACGGCG GTCGGACTGC TCGGCAGCGG TCAGTGGCAA AGCCGCGCCG
1601  GCATTCGGGC AAAAACCCGT TTTGCTTTGC GTAACGGTGT CAATCTTCAG
1651  CCTTTTGCCG CTTTTAATGT TTTGCACAGG TCAAAATCTT TCGGCGTGGA
1701  AATGGACGGC GAAAACAGA CGCTGGCAGG CAGGACGGCG CTCGAAGGGC
1751  GGTTCGGCAT TGAAGCCGGT TGGAAAGGCC ATATGTCCGC ACGCATCGGA
1801  TACGGCAAAA GGACGGACGG CGACAAAGAA GCCGCATTGT CGCTCAAATG
1851  GCTGTTTTGA
```

This encodes a protein having amino acid sequence (SEQ ID NO: 454):

```
  1  MFRAQLGSNT RSTKIGDDAD FSFSDKPKPG TSHYFSSGKT DQNSSEYGYD
 51  EINIQGKNYN SGILAVDNMP VVKKYITDTY GDNLKDAVKK QLQDLYKTRP
101  EAWEENKKRT EEAYIEQLGP KFSILKQKNP DLINKLVEDS VLTPHSNTSQ
151  TSLNNIFNKK LHVKIENKSH VAGQVLELTK MTLKDSLWEP RRHSDIHMLE
201  TSDNARIRLN TKDEKLTVHK AYQGGADFLF GYDVRESDKP ALTFEEKVSG
251  QSGVVLERRP ENLKTLDGRK LIAAEKADSN SFAFKQNYRQ GLYELLLKQC
301  EGGFCLGVQR LAIPEAEAVL YAQQAYAANT LFGLRAADRG DDVYAADPSR
351  QKLWLRFIGG RSHQNIRGGA AADGRRKGVQ IGGEVFVRQN EGSRLAIGVM
401  GGRAGQHASV NGKGGAAGSY LHGYGGGVYA AWHQLRDKQT GAYLDGWLQY
451  QRFKHRINDE NRAERYKTKG WTASVEGGYN ALVAEGVVGK GNNVRFYLQP
```

```
501  QAQFTYLGVN GGFTDSEGTA VGLLGSGQWQ SRAGIRAKTR FALRNGVNLQ

551  PFAAFNVLHR SKSFGVEMDG EKQTLAGRTA LEGRFGIEAG WKGHMSARIG

601  YGKRTDGDKE AALSLKWLF*
```

Homology with a Predicted ORF from N.gonorrhoeae

ORF35 (SEQ ID NO: 452) shows 51.7% identity over a 261aa overlap with a predicted ORF (ORF35ngh) (SEQ ID NO: 456) from N. gonorrhoeae:

```
orf35.pep                             PCRRQGDDVYAAHASRQKLWLRFIGGRSHQNIRG  34
                                      :::|::    |: |||| | |:|:| ::|
orf35ngh  FTKVQERDDIAIYAQQAQAANTLFALRLNDKNSDIFDRTLPRKGLWLRVIDGHSNQWVQG  370 orf35.pep GAA-ADGWRKGVQIGGEVFVRQNEGSXLAIGVMGGRAGQHASVNGKG--GAAGSDLYGYG  91
          :| ::|:||||:||||: |||:: |:||:|||:| |:::  :   : : ::: |:|
orf35ngh  KTAPVEGYRKGVQLGGEVFTWQNESNQLSIGLMGGQAEQRSTFRNPDTDNLTTGNVKGFG  430 orf35.pep GGVYAAWHQLRDKQTGAYLDGWLQYQRFKHRINDENRAERYKTKGWTASVEGGYNALVAE  151
          :||||:|||:|||||||||:|:|:|||||:|||| | :||: :|| |||:|:||||:||
orf35ngh  AGVYATWHQLQDKQTGAYVDSWMQYQRFRHRINTEYATERFTSKGITASIEAGYNALLAE  490 orf35.pep GIVGKGNNVRFYLQPQAQFTYLGVNGGFTDSEGTAVGLLGSGQWQSRAGIRAKTRFALRN  211
          ::  |||::| ||||||||:||||||: |:|||::  |:|||| |  |||:|::||::| |
orf35ngh  HFTKKGNSLRVYLQPQAQLTYLGVNGKFSDSENAQVNLLGSRQLQSRVGVQAKAQFAFTN  550 orf35-pep GVNLQPFAAFNVLHRSKSFGVEMDGEKQTLAGRTALEGRFGIEAGWKGHMSA  263
          ||::|||:| | ::::| ||||:|:::::::::::| ::|:| | |:|::
orf35ngh  GVTFQPFVAVNSIYQQKPFGVEIDGDRRVINNKTVIETQLGVAAKIKSHLTLQASFNRQT  610
```

A partial ORF35ngh nucleotide sequence (SEQ ID NO: 455) is predicted to encode a protein having partial amino acid sequence (SEQ ID NO: 456):

```
  1  ..KKLRDRNSEY WKEETYHIKS NGRTYPNIPA LFPKHPFDPF ENINNSKKIS

51    FYDKEYTEDY LVGFARGFGV EKRNGEEEKP LRQYFKDCVN TENSNNDNCK

101    ISSFGNYGPI LIKSDIFALA SQIKNSHINS EILSVGNYIE WLRPTLNKLT

151    GWQEHLYAGL DPFHYIEVTD NSHVIGQTID LGALELTNSL WKPRWNSNID

201    YLITKNAEIR FNTKNESLLV KEDYAGGARF RFAYDLKDKV PEIPVLTFEK

251    NITGTSDIIF EGKALDNLKH LDGHQIVKVN DTADKDAFRL SSKYRKGIYT

301    LSLQQRPEGF FTKVQERDDI AIYAQQAQAA NTLFALRLND KNSDIFDRTL

351    PRKGLWLRVI DGHSNQWVQG KTAPVEGYRK GVQLGGEVFT WQNESNQLSI

401    GLMGGQAEQR STFRNPDTDN LTTGNVKGFG AGVYATWHQL QDKQTGAYVD

451    SWMQYQRFRH RINTEYATER FTSKGITASI EAGYNALLAE HFTKKGNSLR

501    VYLQPQAQLT YLGVNGKFSD SENAQVNLLG SRQLQSRVGV QAKAQFAFTN

551    GVTFQPFVAV NSIYQQKPFG VEIDGDRRVI NNKTVIETQL GVAAKIKSHL

601    TLQASFNRQT SKHHHAKQGA LNLQWTF*
```

Based on this prediction, these proteins from N.meningitidis and N.gonorrhoeae, and their epitopes, could be useful antigens for vaccines or diagnostics, or for raising antibodies.

Example 55

The following partial DNA sequence was identified in N.meningitidis (SEQ ID NO: 457):

```
  1  ..GCGGAATATG TTCAGTTCTC TATAGATTTG TTCAGTGTGG GTAAATCGGG

51    GGGCGGTATA CCTAAGGCTA AGCCTGTGTT TGATGCGAAA CCGAGATGGG
```

-continued

```
101     AGGTTGATAG GAAGCTTAAT AAATTGACAA CTCGTGAGCA GGTGGAGAAA

151     AATGTTCAGG AAACGAGAAG AAGGAGTCAG AGTAGTCAGT TTAAAGCCCA

201     TGCGCAACGA GAATGGGAAA ATAAAACAGG GTTAGATTTT AATCATTTTA

251     TAGGTGGTGA TATCAATAAA AAAGGCACAG TAACAGGAGG GCATAGTCTA

301     ACCCGTGGTG ATGTACGGGT GATACAACAA ACCTCGGCAC CTGATAAACA

351     TGGGGT.TTA TCAAGCGACA GTGGAAATTN A
```

This corresponds to the amino acid sequence (SEQ ID NO: 458; ORF46):

```
  1     ..AEYVQFSIDL FSVGKSGGGI PKAKPVFDAK PRWEVDRKLN KLTTREQVEK

51     NVQETRRRSQ SSQFKAHAQR EWENKTGLDF NHFIGGDINK KGTVTGGHSL

101     TRGDVRVIQQ TSAPDKHGXL SSDSGNX
```

Further work revealed further partial nucleotide sequence (SEQ ID NO: 459):

```
  1     ..GCAGTGTGCC TnCCGATGCA TGCACACGCC TCAnATTTGG CAAACGATTC

51     TTTTATCCGG CAGGTTCTCG ACCGTCAGCA TTTCGAACCC GACGGGAAAT

101     ACCACCTATT CGGCAGCAGG GGGGAACTTG CCGAGCGCCA GTCTCATATC

151     GGATTGGGAA AAATACAAAG CCATCAGTTG GGCAACCTGA TGATTCAACA

201     GGCGGCCATT AAAGGAAATA TCGGCTACAT TGTCCGCTTT TCCGATCACG

251     GGCACGAAGT CCATTCCCCs TTCGACAACC ATGCCTCACA TTCCGATTCT

301     GATGAAGCCG GTAGTCCCGT TGACGGATTT AGCCTTTACC GCATCCATTG

351     GGACGGATAC GAACACCATC CCGCCGACGG CTATGACGGG CCACAGGGCG

401     GCGGCTATCC CGCTCCCAAA GGCGCGAGGG ATATATACAG TTACGACATA

451     AAAGGCGTTG CCCAAAATAT CCGCCTCAAC CTGACCGACA ACCGCAGCAC

501     CGGACAACGG CTTGCCGACC GTTTCCACAA TGCCGGTAGT ATGCTGACGC

551     AAGGAGTAGG CGACGGATTC AAACGCGCCA CCCGATACAG CCCCGAGCTG

601     GACAGATCGG GCAATGCCGC CGAAGCCTTC AACGGCACTG CAGATATCGT

651     TAAAAACATC ATCGGCGCTG CAGGAGAAAT TGT
```

This corresponds to the amino acid sequence (SEQ ID NO: 460; ORF46-1):

```
  1     ..AVCLPMHAHA SXLANDSFIR QVLDRQHFEP DGKYHLFGSR GELAERQSHI

51     GLGKIQSHQL GNLMIQQAAI KGNIGYIVRF SDHGHEVHSP FDNHASHSDS

101     DEAGSPVDGF SLYRIHWDGY EHHPADGYDG PQGGGYPAPK GARDIYSYDI

151     KGVAQNIRLN LTDNRSTGQR LADRFHNAGS MLTQGVGDGF KRATRYSPEL

201     DRSGNAAEAF NGTADIVKNI IGAAGEI
```

Computer analysis of this amino acid sequence gave the following results:
Homology with a Predicted ORF from N.gonorrhoeae ORF46 (SEQ ID NO: 458) shows 98.2% identity over a 111aa overlap with a predicted ORF (ORF46ng) (SEQ ID NO: 462) from N. gonorrhoeae:

```
orf46.pep              AEYVQFSIDLFSVGKSGGGIPKAKPVFDAKPRWEVDRKLNKLTTR   45
                       ||||||||||||||||||||||||||||||||||||||||||||
orf46ng    PKTGVPFDGKGFPNFEKHVKYDTKLDIQELSGGGIPKAKPVFDAKPRWEVDRKLNKLTTR  217 orf46.pep  EQVEKNVQETRRRSQSSQFKAHAQREWENKTGLDFNHFIGGDINKKGTVTGGHSLTRGDV  105
           |||||||||||||||||||||||||||||||||||||||||||||:|||||||||||||
orf46ng    EQVEKNVQETRRRSQSSQFKAHAQREWENKTGLDFNHFIGGDINKKGAVTGGHSLTRGDV  277 orf46.pep  RVIQQTSAPDKHGXLSSDSGN                                         126
           ||||||||||||| |||||||
orf46ng    RVIQQTSAPDKHGVLSSDSGN                                         298
```

A partial ORF46ng nucleotide sequence (SEQ ID NO: 461) is predicted to encode a protein having partial amino acid sequence (SEQ ID NO: 462):

```
  1   ..RRLKHCCHAR LGSAFHRKQD GAHQRFGRYG ATQRLCRSSH PRLGSPKPQC
 51     RTRHRSRQQY LYGSHPHQRD WSCPGKIQLG RHHGTSCRAV ADXRDRICER
101     EIRRQRQXCR CRLGKIPSLS IPKYPLKLEQ RYGKENITSS TVPPSNGKNV
151     KLADQRHPKT GVPFDGKGFP NFEKHVKYDT KLDIQELSGG GIPKAKPVFD
201     AKPRWEVDRK LNKLTTREQV EKNVQETRRR SQSSQFKAHA QREWENKTGL
251     DFNHFIGGDI NKKGAVTGGH SLTRGDVRVI QQTSAPDKHG VLSSDSGN*
```

Further work revealed the complete gonococcal DNA sequence (SEQ ID NO: 463):

```
   1   TTGGGCATTT CCCGCAAAAT ATCCCTTATT CTGTCCATAC TGGCAGTGTG
  51   CCTGCCGATG CATGCACACG CCTCAGATTT GGcaAACGAT CCCTTTATCC
 101   GgCaggttcT CGaccGTCAG CATTTCGaac ccgacggGAa ATACCaCCTA
 151   TTcggCaGCA GGGGGGAGCT TgccnagcGC aacggccATa tcggattggG
 201   aaacaTAcaa AgccatcagtG tGggccacct gatgattcaa caggcggccg
 251   ttgaaggaaA TAtcgGctac attgtccgct tttccgatca cgggcacaaa
 301   ttccattcgc ccttcGAcaa ccaTGCCTCA CATTCCGATT CTGACGAAGC
 351   CGGTAGTCCC GTTGACGGAT TCAGCCTTTA CCGCATCCAT TGGGACGGAT
 401   ACGAACACCA TCCCGCCGAC GGCTATGACG GCCACAGGG CGGCGGCTAT
 451   CCCGCTCCCA AAGGCGCGAG GGATATATAC AGCTACGACA TAAAAGGCGT
 501   TGCCCAAAAT ATCCGCCTCA ACCTGACCGA CAACCGCAGC ACCGGACAAC
 551   GGCTTGCCGA CCGTTTCCAC AATGCCGGCG CTATGCTGAC GCAAGGAGTA
 601   GGCGACGGAT TCAAACGCGC CACCCGATAC AGCCCCGAGC TGGACAGATC
 651   GGGCAATGCc gccGAAGCCT TCAACGGCAC TGCAGATATC GTCAAAAACA
 701   TCATCGGCGC GGCAGGAGAA ATTGTCGGCG CAGGCGATGC CGTGCAgGGT
 751   ATAAGCGAAG GCTCAAACAT TGCTGTCATG CACGGCTTGG GTCTGCTTTC
 801   CACCGAAAAC AAGATGGCGC GCATCAACGA TTTGGCAGAT ATGGCGCAAC
 851   TCAAAGACTA TGCCGCAGCA GCCATCCGCG ATTGGGCAGT CCAAAACCCC
 901   AATGCCGCAC AAGGCATAGA AGCCGTCAGC AATATCTTTA TGGCAGCCAT
 951   CCCCATCAAA GGGATTGGAG CTGTCCGGGG AAAATACGGC TTGGGCGGCA
1001   TCACGGCACA TCCTGTCAAG CGGTCGCAGA TGGGCGCGAT CGCATTGCCG
```

```
                  -continued
1051    AAAGGGAAAT CCGCCGTCAG CGACAATTTT GCCGATGCGG CATACGCCAA

1101    ATACCCGTCC CCTTACCATT CCCGAAATAT CCGTTCAAAC TTGGAGCAGC

1151    GTTACGGCAA AGAAAACATC ACCTCCTCAA CCGTGCCGCC GTCAAACGGC

1201    AAAAATGTCA AACTGGCAGA CCAACGCCAC CCGAAGACAG GCGTACCGTT

1251    TGACGGTAAA GGGTTTCCGA ATTTTGAGAA GCACGTGAAA TATGATACGA

1301    AGCTCGATAT TCAAGAATTA TCGGGGGCG GTATACCTAA GGCTAAGCCT

1351    GTGTTTGATG CGAAACCGAG ATGGGAGGTT GATAGGAAGC TTAATAAATT

1401    GACAACTCGT GAGCAGGTGG AGAAAAATGT TCAGGAAACG AGAAGAAGGA

1451    GTCAGAGTAG TCAGTTTAAA GCCCATGCGC AACGAGAATG GGAAAATAAA

1501    ACAGGGTTAG ATTTTAATCA TTTTATAGGT GGTGATATCA ATAAGAAAGG

1551    CACAGTAACA GGAGGGCATA GTCTAACCCG TGGTGATGTA CGGGTGATAC

1601    AACAAACCTC GGCACCTGAT AAACATGGGG TTTATCAAGC GACAGTGGAA

1651    ATTAAAAAGC CTGATGGAAG TTGGGAGGTG AAAACGAAAA AAGGTGGGAA

1701    AGTGATGACC AAGCACACCA TGTTCCCAAA AGATTGGGAT GAGGCTAGAA

1751    TTAGGGCTGA AGTTACTTCG GCTTGGGAAA GTAGAATAAT GCTTAAGGAT

1801    AATAAATGGC AGGGTACAAG TAAATCGGGT ATTAAAATAG AAGGATTTAC

1851    CGAACCTAAT AGAACAGCAT ATCCCATTTA TGAATAG
```

This corresponds to the amino acid sequence (SEQ ID NO: 464; ORF46ng-1):

```
  1   LGISRKISLI LSILAVCLPM HAHASDLAND PFIRQVLDRQ HFEPDGKYHL

51   FGSRGELAXR NGHIGLGNIQ SHQLGHLMIQ QAAVEGNIGY IVRFSDHGHK

101   FHSPFDNHAS HSDSDEAGSP VDGFSLYRIH WDGYEHHPAD GYDGPQGGGY

151   PAPKGARDIY SYDIKGVAQN IRLNLTDNRS TGQRLADRFH NAGAMLTQGV

201   GDGFKRATRY SPELDRSGNA AEAFNGTADI VKNIIGAAGE IVGAGDAVQG

251   ISEGSNIAVM HGLGLLSTEN KMARINDLAD MAQLKDYAAA AIRDWAVQNP

301   NAAQGIEAVS NIFMAAIPIK GIGAVRGKYG LGGITAHPVK RSQMGAIALP

351   KGKSAVSDNF ADAAYAKYPS PYHSRNIRSN LEQRYGKENI TSSTVPPSNG

401   KNVKLADQRH PKTGVPFDGK GFPNFEKHVK YDTKLDIQEL SGGGIPKAKP

451   VFDAKPRWEV DRKLNKLTTR EQVEKNVQET RRRSQSSQPK AHAQREWENK

501   TGLDFNHFIG GDINKKGTVT GGHSLTRGDV RVIQQTSAPD KHGVYQATVE

551   IKKPDGSWEV KTKKGGKVMT KHTMFPKDWD EARIRAEVTS AWESRIMLKD

601   NKWQGTSKSG IKIEGFTEPN RTAYPIYE*
```

ORF46-1 (SEQ ID NO: 460) show 94.7% identity in 227 aa

```
                        10         20         30         40
orf46-1.pep             AVCLPMHAHASXLANDSFIRQVLDRQHFEPDGKYHLFGSRGELAER
                        ||||||||||  ||||  |||||||||||||||||||||||||| |
orf46ng-1   LGISRKISLILSILAVCLPMHAHASDLANDPFIRQVLDRQHFEPDGKYHLFGSRGELAXR
                    10         20         30         40         50         60
```

```
                    50        60        70        80        90       100
orf46-1.pep  QSHIGLGKIQSHQLGNLMIQQAAIKGNIGYIVRFSDHGHEVHSPFDNHASHSDSDEAGSP
             ::|||||:||||||:|||||::|||||||||||||:||||||||||||||||||||||
orf46ng-1    NGHIGLGNIQSHQLGHLMIQQAAVEGNIGYIVRFSDHGHKFHSPFDNHASHSDSDEAGSP
                    70        80        90       100       110       120

110       120       130       140       150       160
orf46-1.pep  VDGFSLYRIHWDGYEHHPADGYDGPQGGGYPAPKGARDIYSYDIKGVAQNIRLNLTDNRS
             ||||||||||||||||||||||||||||||||||||||||||||||||||||||||||||
orf46ng-1    VDGFSLYRIHWDGYEHHPADGYDGPQGGGYPAPKGARDIYSYDIKGVAQNIRLNLTDNRS
                   130       140       150       160       170       180

170       180       190       200       210       220
orf46-1.pep  TGQRLADRFHNAGSMLTQGVGDGFKRATRYSPELDRSGNAAEAFNGTADIVKNIIGAAGE
             ||||||||||||||:|||||||||||||||||||||||||||||||||||||||||||||
orf46ng-1    TGQRLADRFHNAGAMLTQGVGDGFKRATRYSPELDRSGNAAEAFNGTADIVKNIIGAAGE
                   190       200       210       220       230       240 orf4G-1.pep  I
             |
orf46ng-1    IVGAGDAVQGISEGSNIAVMHGLGLLSTENKMARINDLADMAQLKDYAAAAIRDWAVQNP
                   250       260       270       280       290       300
```

Homology with a Predicted ORF from *N.meningitidis* (Strain A) ORF46ng-1 (SEQ ID NO: 464) shows 87.4% identity over a 486aa overlap with an ORF (ORF46a) (SEQ ID NO: 466) from strain A *N. meningitidis*:

```
                    10        20        30        40        50        60
orf46a.pep   LGISRKISLILSILAVCLPMHAHASDLANDSFIRQVLDRQHFEPDGKYHLFGSRGELAER
             |||||||||||||||||||||||||||||||||||||||||||||||||||||||||| |
orf46ng-1    LGISRKISLILSILAVCLPMHAHASDLANDPFIRQVLDRQHFEPDGKYHLFGSRGELAXR
                    10        20        30        40        50        60

70        80        90       100       110       120
orf46a.pep   SGHIGLGNIQSHQLGNLFIQQAAIKGNIGYIVRFSDHGHEVHSPFDNHASHSDSDEAGSP
             :|||||||||||||:|:|||||::|||||||||||||||: |||||||||||||||||||
orf46ng-1    NGHIGLGNIQSHQLGHLMIQQAAVEGNIGYIVRFSDHGHKFHSPFDNHASHSDSDEAGSP
                    70        80        90       100       110       120

130       140       150       160       170       180
orf46a.pep   VDGFSLYRIHWDGYEHHPADGYDGPQGGGYPAPKGARDIYSYDIKGVAQNIRLNLTDNRS
             ||||||||||||||||||||||||||||||||||||||||||||||||||||||||||||
orf46ng-1    VDGFSLYRIHWDGYEHHPADGYDGPQGGGYPAPKGARDIYSYDIKGVAQNIRLNLTDNRS
                   130       140       150       160       170       180

190       200       210       220       230       240
orf46a.pep   TGQRLVDRFHNTGSMLTQGVGDGFKRATRYSPELDRSGNAAEAFNGTADIVKNIIGAAGE
             |||||:||||:|:|||||||||||||||||||||||||||||||||||||||||||||||
orf46ng-1    TGQRLADRFHNAGAMLTQGVGDGFKRATRYSPELDRSGNAAEAFNGTADIVKNIIGAAGE
                   190       200       210       220       230       240

250       260       270       280       290       300
orf46a.pep   IVGAGDAVQGISEGSNIAVMHGLGLLSTENKMARINDLADMAQLKDYAAAAIRDWAVQNP
             ||||||||||||||||||||||||||||||||||||||||||||||||||||||||||||
orf46ng-1    IVGAGDAVQGISEGSNIAVMHGLGLLSTENKMARINDLADMAQLKDYAAAAIRDWAVQNP
                   250       260       270       280       290       300

310       320       330       340       350       360
orf46a.pep   NAAQGIEAVSNIFTAVIPVKGIGAVRGKYGLGGITAHPVKRSQMGEIALPKGKSAVSDNF
             |||||||||||||:||:|||||||||||||||||||||||||||||||:||||||||||
orf46ng-1    NAAQGIEAVSNIFMAAIPIKGIGAVRGKYGLGGITAHPVKRSQMGAIALPKGKSAVSDNF
                   310       320       330       340       350       360

370       380       390       400       410       420
orf46a.pep   ADAAYAKYPSPYHSRNIRSNLEQRYGKENITSSTVPPSNGKNVKLANKRHPKTKVPFDGK
             ||||||||||||||||||||||||||||||||||||||||||||||::|||||  ||||||
orf46ng-1    ADAAYAKYPSPYHSRNIRSNLEQRYGKENITSSTVPPSNGKNVKLADQRHPKTGVPFDGK
                   370       380       390       400       410       420

430       440       450       460       470
orf46a.pep   GFPNFEKDVKYDTRINTAVPQVN----PIDEPVFN--PKGSVGSAHSWSITARIQYAKLP
             |||||||  ||||:::  : :::   | :|||:  |:  |     : ::|:| |   |
orf46ng-1    GFPNFEKHVKYDTKLD--IQELSGGGIPKAKPVFDAKPRWEVDRKLN-KLTTREQVEKNV
                   430       440       450       460       470
```

```
                      480       490       500        510       520       530
orf46a.pep   RQGRIRYIPPKNYSPSAPLPKGPNNGYLDKFGNEWTKGPSRTKGQEFEWDVQLSKTGREQ
             ::    | |
orf46ng-1    QETRRRSQSSQFKAHAQREWENKTGLDFNHFIGGDINKKGTVTGGHSLTRGDVRVIQQTS
                      480       490       500        510       520       530
```

The complete length ORF46a DNA sequence (SEQ ID NO: 465) is:

```
   1  TTGGGCATTT CCCGCAAAAT ATCCCTTATT CTGTCCATAC TGGCAGTGTG

51  CCTGCCGATG CATGCACACG CCTCAGATTT GGCAAACGAT TCTTTTATCC

101  GGCAGGTTCT CGACCGTCAG CATTTCGAAC CCGACGGGAA ATACCACCTA

151  TTCGGCAGCA GGGGGGAACT TGCCGAGCGC AGCGGTCATA TCGGATTGGG

201  AAACATACAA AGCCATCAGT TGGGCAACCT GTTCATCCAG CAGGCGGCCA

251  TTAAAGGAAA TATCGGCTAC ATTGTCCGCT TTTCCGATCA CGGGCACGAA

301  GTCCATTCCC CCTTCGACAA CCATGCCTCA CATTCCGATT CTGATGAAGC

351  CGGTAGTCCC GTTGACGGAT TCAGCCTTTA CCGCATCCAT TGGGACGGAT

401  ACGAACACCA TCCCGCCGAC GGCTATGACG GGCCACAGGG CGGCGGCTAT

451  CCCGCTCCCA AAGGCGCGAG GGATATATAC AGCTACGACA TAAAAGGCGT

501  TGCCCAAAAT ATCCGCCTCA ACCTGACCGA CAACCGCAGC ACCGGACAAC

551  GGCTTGTCGA CCGTTTCCAC AATACCGGTA GTATGCTGAC GCAAGGAGTA

601  GGCGACGGAT TCAAACGCGC CACCCGATAC AGCCCCGAGC TGGACAGATC

651  GGGCAATGCC GCCGAAGCTT TCAACGGCAC TGCAGATATC GTCAAAAACA

701  TCATCGGCGC GGCAGGAGAA ATTGTCGGCG CAGGCGATGC CGTGCAGGGT

751  ATAAGCGAAG GCTCAAACAT TGCTGTTATG CACGGCTTGG GTCTGCTTTC

801  CACCGAAAAC AAGATGGCGC GCATCAACGA TTTGGCAGAT ATGGCGCAAC

851  TCAAAGACTA TGCCGCAGCA GCCATCCGCG ATTGGGCAGT CCAAAACCCC

901  AATGCCGCAC AAGGCATAGA AGCCGTCAGC AATATCTTTA CGGCAGTCAT

951  CCCCGTCAAA GGGATTGGAG CTGTTCGGGG AAAATACGGC TTGGGCGGCA

1001  TCACGGCACA TCCTGTCAAG CGGTCGCAGA TGGGCGAGAT CGCATTGCCG

1051  AAAGGGAAAT CCGCCGTCAG CGACAATTTT GCCGATGCGG CATACGCCAA

1101  ATACCCGTCC CCTTACCATT CCCGAAATAT CCGTTCAAAC TTGGAGCAGC

1151  GTTACGGCAA AGAAAACATC ACCTCCTCAA CCGTGCCGCC GTCAAACGGA

1201  AAGAATGTGA AACTGGCAAA CAAACGCCAC CGAAGACCA AAGTGCCGTT

1251  TGACGGTAAA GGGTTTCCGA ATTTTGAAAA AGACGTAAAA TACGATACGA

1301  GAATTAATAC CGCTGTACCA CAAGTGAATC CTATAGATGA ACCCGTCTTT

1351  AATCCTAAAG GTTCTGTCGG ATCGGCTCAT TCTTGGTCTA TAACTGCCAG

1401  AATTCAATAC GCAAAATTAC CAAGGCAAGG TAGAATCAGA TATATCCCAC

1451  CTAAAAATTA CTCTCCTTCA GCACCGCTAC CAAAAGGACC TAATAATGGA

1501  TATTTGGATA AATTTGGTAA TGAATGGACT AAAGGTCCAT CAAGAACTAA

1551  AGGTCAAGAA TTTGAATGGG ATGTTCAATT GTCTAAAACA GGAAGAGAGC

1601  AACTTGGATG GGCTAGTAGG GATGGTAAGC ATTTAAATAT ATCAATTGAT

1651  GGAAAGATTA CACACAAATG A
```

This corresponds to the amino acid sequence (SEQ ID NO: 466):

```
  1  LGISRKISLI LSILAVCLPM HAHASDLAND SFIRQVLDRQ HFEPDGKYHL

51  FGSRGELAER SGHIGLGNIQ SHQLGNLFIQ QAAIKGNIGY IVRFSDHGHE

101  VHSPFDNHAS HSDSDEAGSP VDGFSLYRIH WDGYEHHPAD GYDGPQGGGY

151  PAPKGARDIY SYDIKGVAQN IRLNLTDNRS TGQRLVDRFH NTGSMLTQGV

201  GDGFKRATRY SPELDRSGNA AEAFNGTADI VKNIIGAAGE IVGAGDAVQG

251  ISEGSNIAVM HGLGLLSTEN KMARINDLAD MAQLKDYAAA AIRDWAVQNP

301  NAAQGIEAVS NIFTAVIPVK GIGAVRGKYG LGGITAHPVK RSQMGEIALP

351  KGKSAVSDNF ADAAYAKYPS PYHSRNIRSN LEQRYGKENI TSSTVPPSNG

401  KNVKLANKRH PKTKVPFDGK GFPNFEKDVK YDTRINTAVP QVNPIDEPVF

451  NPKGSVGSAH SWSITARIQY AKLPRQGRIR YIPPKNYSPS APLPKGPNNG

501  YLDKFGNEWT KGPSRTKGQE FEWDVQLSKT GREQLGWASR DGKHLNISID

551  GKITHK*
```

Based on this analysis, including the presence of a RGD sequence in the gonococcal protein, typical of adhesins, it is predicted that the proteins from *N.meningitidis* and *N.gonorrhoeae*, and their epitopes, could be useful antigens for vaccines or diagnostics, or for raising antibodies.

Example 56

The following partial DNA sequence was identified in *N.meningitidis* (SEQ ID NO: 467):

```
  1  ATGAATATTC ACACCCTGCT CTCCAAACAA TGGACGCTGC CGCCATTCCT

51  GCCGAAACGG CTGCTGCTGT CCCTGCTGAT ACTGCTTGCC CCCAATGCGG

101  TGTTTTGGGT TTTGGCACTG CTGACCGCCA CCGCCCGCCC GATTGTCAAT

151  TTGGACTATC TTCCCGCCGC GCTGCTGATC GCCCTGCCTT GGCGTTTCGT

201  CAAAATTGCC GGCGTATTGG CGTTTTGGCT GGCGGTTTTG TTTGACGGGC

251  TGATGATGGT GATCCAACTC TTCCCTTTTA TGGATCTCAT CGGCGCCATC

301  AACCTCGTCC CCTTCATCCT GACCGCCCCC GCCCCTTATC AGATAATGAC

351  CGGGCTG...
```

This corresponds to the amino acid sequence (SEQ ID NO: 468; ORF48):

```
  1  MNIHTLLSKQ WTLPPFLPKR LLLSLLILLA PNAVFWVLAL LTATARPIVN

51  LDYLPAALLI ALPWRFVKIA GVLAFWLAVL FDGLMMVIQL FPFMDLIGAI

101  NLVPFILTAP APYQIMTGL...
```

Further work revealed the complete nucleotide sequence (SEQ ID NO: 469):

```
  1  ATGAATATTC ACACCCTGCT CTCCAAACAA TGGACGCTGC CGCCATTCCT

51  GCCGAAACGG CTGCTGCTGT CCCTGCTGAT ACTGCTTGCC CCCAATGCGG

101  TGTTTTGGGT TTTGGCACTG CTGACCGCCA CCGCCCGCCC GATTGTCAAT

151  TTGGACTATC TTCCCGCCGC GCTGCTGATC GCCCTGCCTT GGCGTTTCGT
```

```
 201  CAAAATTGCC GGCGTATTGG CGTTTTGGCT GGCGGTTTTG TTTGACGGGC
 251  TGATGATGGT GATCCAACTC TTCCCTTTTA TGGATCTCAT CGGCGCCATC
 301  AACCTCGTCC CCTTCATCCT GACCGCCCCC GCCCCTTATC AGATAATGAC
 351  CGGGCTGTTG CTGCTGTATA TGCTGGCGAT GCCGTTTGTG TTGCAGAAAG
 401  CCGCCGCCAA AACCGACTTC CGGCACATTG CCGTCTGCGC CGCCGTTGTG
 451  GCGGCAGCCG GCTATTTCAC CGGCCATTTG AGTTACTACG ACCGGGTCG
 501  GATGGCCAAT ATCTTCGGCG CAAACAACTT CTACTACGCC AAAAGTCAGG
 551  CGATGCTCTA CACCGTCAGC CAGAATGCCG ACTTTATTAC CGCCGGCCTG
 601  GTCGATCCCG TCTTCCTCCC CTTGGGCAAT CAACAGCGTG CCGCCACGCA
 651  TCTGAACGAG CCGAAATCTC AAAAAATCCT CTTTATCGTC GCCGAATCTT
 701  GGGGGCTGCC GGCCAATCCC GAACTTCAAA ACGCCACTTT TGCCAAACTG
 751  CTGGCGCAAA AAGACCGTTT TTCGGTTTGG GAAAGCGGCA GTTTTCCCTT
 801  CATCGGCGCG ACGGTCGAAG GCGAAATGCG CGAACTGTGT GCCTACGGCG
 851  GTTTGCGCGG GTTCGCACTG CGCCGCGCGC CGACGAAAA ATTTGCCCGC
 901  TGCCTCCCCA ACCGTTTGAA ACAAGAAGGT TACGCCACCT TTGCGATGCA
 951  CGGCGCGGGC AGTTCGCTTT ACGACCGCTT CAGCTGGTAT CCGAGGGCGG
1001  GCTTTCAAGA AATCAAAACC GCCGAAAACC TGATCGGTAA AAAAACCTGC
1051  GCCATTTTCG GCGGCGTGTG CGACAGCGAG CTGTTCGGCG AAGTGTCGGC
1101  ATTTTTCAAA AAACACGACA AGGGACTGTT TTACTGGATG ACGCTGACCA
1151  GCCACGCCGA CTATCCCGAA TCCGACATTT TCAACCACAG GCTCAAATGC
1201  ACCGAATATG GCCTGCCCGC CGAAACCGAC CTCTGCCGCA ATTTCAGCCT
1251  GCACACCCAA TTCTTCGACC AACTGGCGGA TTTGATCCAA CGCCCCGAAA
1301  TGAAAGGCAC GGAAGTCATC ATCGTCGGCG ACCATCCGCC GCCCGTCGGC
1351  AACCTCAATG AAACCTTCCG CTACCTCAAA CAGGGGCACG TCGCCTGGCT
1401  GAACTTCAAA ATCAAATAA
```

This corresponds to the amino acid sequence (SEQ ID NO: 470; ORF48-1):

```
  1  MNIHTLLSKQ WTLPPFLPKR LLLSLLILLA PNAVFWVLAL LTATARPIVN

51  LDYLPAALLI ALPWRFVKIA GVLAFWLAVL FDGLMMVIQL FPFMDLIGAI

101  NLVPFILTAP APYQIMTGLL LLYMLAMPFV LQKAAAKTDF RHIAVCAAVV

151  AAAGYFTGHL SYYDRGRMAN IFGANNFYYA KSQAMLYTVS QNADFITAGL

201  VDPVFLPLGN QQRAATHLNE PKSQKILFIV AESWGLPANP ELQNATFAKL

251  LAQKDRFSVW ESGSFPFIGA TVEGEMRELC AYGGLRGFAL RRAPDEKFAR

301  CLPNRLKQEG YATFAMHGAG SSLYDRFSWY PRAGFQEIKT AENLIGKKTC

351  AIFGGVCDSE LFGEVSAFFK KHDKGLFYWM TLTSHADYPE SDIFNHRLKC

401  TEYGLPAETD LCRNFSLHTQ FFDQLADLIQ RPEMKGTEVI IVGDHPPPVG

451  NLNETFRYLK QGHVAWLNFK IK*
```

Computer analysis of this amino acid sequence gave the following results:

Homology with a Predicted ORF from *N.meningitidis* (Strain A)

ORF48 (SEQ ID NO: 468) shows 94.1% identity over a 119aa overlap with an ORF (ORF48a) (SEQ ID NO: 472) from strain A of *N. meningitidis*:

```
                   10        20        30        40        50        60
orf48.pep  MNIHTLLSKQWTLPPFLPKRLLLSLLILLAPNAVFWVLALLTATARPIVNLDYLPAALLI
           |||||||||||||||||||||||||||| ||||||||||||||||||||| ||||||||
orf48a     MNIHTLLSKQWTLPPFLPKRLLLSLLILLXPNAVFWVLALLTATARPIVNLXYLPAALLI
                   10        20        30        40        50        60

70        80        90       100       110       119
orf48.pep  ALPWRFVKIAGVLAFWLAVLFDGLMMVIQLFPFMDLIGAINLVPFILTAPAPYQIMTGL
           ||||| ||| |||| |||||||||||||||||||||||||||||||| ||||| |||||
orf48a     ALPWRXVKIXGVLAXWLAVLFDGLMMVIQLFPFMDLIGAINLVPFIXTAPALYQIMTGLL
                   70        80        90       100       110       120 orf48a     LLYMLAMPFVLQKAAAKTDFRHIAACAAVVVAAGYFTGHLSXYDRGRMANIFGANNFYYA
                  130       140       150       160       170       180
```

The complete length ORF48a nucleotide sequence (SEQ ID NO: 471) is:

```
   1  ATGAATATTC ACACCCTGCT CTCCAAACAA TGGACGCTGC CGCCATTCCT
  51  GCCGAAACGG CTGCTGCTGT CCCTGCTGAT ACTGCTNNCC CCCAATGCGG
 101  TGTTTTGGGT TTTGGCACTG CTGACCGCCA CCGCCCGCCC GATTGTCAAT
 151  TTGGANTACC TTCCCGCCGC GCTGCTGATC GCCCTGCCTT GGCGTNTCGT
 201  CAAAATTGNC GGCGTATTGG CGTNTTGGCT GGCGGTTTTG TTTGACGGGC
 251  TGATGATGGT GATCCAACTC TTCCCTTTTA TGGATCTCAT CGGCGCCATC
 301  AACCTCGTCC CCTTCATCNT GACCGCCCCC GCCCTTTATC AGATAATGAC
 351  CGGGCTGTTA CTGCTGTATA TGCTGGCGAT GCCGTTTGTG TTGCAGAAAG
 401  CCGCCGCCAA AACCGACTTC CGACACATTG CCGCCTGTGC CGCCGTTGTG
 451  GTGGCAGCCG GCTATTTTAC CGGCCATTTG AGTTANTACG ACCGGGGGCG
 501  GATGGCCAAT ATCTTCGGCG CAAACAACTT CTATTACGCC AAAAGTCAGG
 551  CGATGCTCTA CACCGTCAGC CAGAATGCCG ACTTTATTAC CGCCGGCCTG
 601  GTCGATCCCG TCTTCCTCCC CTTGGGCAAT CAACAGCGTG CCGCCACGCA
 651  TCTGAACGAG CCGAAATCTC AAAAAATCCT CTTTATCGTC GCCGAATCTT
 701  GGGGGCTGCC GGCCAATCCC GAACTTCAAA ACGCCACTTT TGCCAAACTG
 751  CTGGCGCAAA AAGANCGTTT TTCGGTTTGG GAAAGCGGCA GTTTTCCCTT
 801  CATCGGCGCG ACGATCGAAG GCGAAATGCG CGAACTGTGT GCCTACGGCG
 851  GTTTGCGCGG GTTCGCACTG CGCCGCGCGC CCGACGAAAA ATTTGCCCGC
 901  TGCCTCCCCA ACCGTTTGAA ACAAGAAGGT TACGCCACCT TTGCGATGCA
 951  CGGCGCGGGC AGTTCGCTTT ACGACCGCTT CAGCTGGTAT CCGAGGGCGG
1001  GCTTTCAAGA AATCAAAACC GCCGAAAACC TGATCGGTAA AAAAACCTGC
1051  GCCATTTTCG GCGGCGTGTG CGACAGCGAG CTGTTCGGCG AAGTGTCGGC
1101  ANTTTTCAAA AAACACGACA AGGGACTGTT TTACTGGATG ACGCTGACCA
1151  GCCACGCCGA CTATCCCGAA TCNGACATTT TCAACCACAG GCTCAAATGC
1201  ACCGAATATG GCCTGCCCGC CGAAACCGAC NTCTGCCGCA ATTTCAGCCT
```

-continued

```
1251   GCACACCCAA TTCTTCGACC AACTGGCGGA TTTGATCCAA CGCCCCGAAA

1301   TGAAAGGCAC GGAAGTCATC ATCGTCGGCG ACCATCCGCC GCCCGTCGGC

1351   AACCTCAATG AAACCTTCCG CTACCTCAAA CAGGGGCACG TCGNCTGGCT

1401   GAACTTCAAA ATCAAATAA
```

This encodes a protein having amino acid sequence (SEQ ID NO: 472):

```
  1   MNIHTLLSKQ WTLPPFLPKR LLLSLLILLX PNAVFWVLAL LTATARPIVN

51   LXYLPAALLI ALPWRXVKIX GVLAXWLAVL FDGLMMVIQL FPFMDLIGAI

101   NLVPFIXTAP ALYQIMTGLL LLYMLAMPFV LQKAAAKTDF RHIAACAAVV

151   VAAGYFTGHL SXYDRGRMAN IFGANNFYYA KSQAMLYTVS QNADFITAGL

201   VDPVFLPLGN QQRAATHLNE PKSQKILFIV AESWGLPANP ELQNATFAKL

251   LAQKXRFSVW ESGSFPFIGA TIEGEMRELC AYGGLRGFAL RRAPDEKFAR

301   CLPNRLKQEG YATFAMHGAG SSLYDRFSWY PRAGFQEIKT AENLIGKKTC

351   AIFGGVCDSE LFGEVSAXFK KHDKGLFYWM TLTSHADYPE SDIFNHRLKC

401   TEYGLPAETD XCRNFSLHTQ FFDQLADLIQ RPEMKGTEVI IVGDHPPPVG
```

ORF48a (SEQ ID NO: 472) and ORF48-1 (SEQ ID NO: 470) show 96.8% identity in 472 aa overlap:

```
                   10         20         30         40         50         60
orf48a.pep  MNIHTLLSKQWTLPPFLPKRLLLSLLILLXPNAVFWVLALLTATARPIVNLXYLPAALLI
            ||||||||||||||||||||||||||||| ||||||||||||||||||||| ||||||||
orf48-1     MNIHTLLSKQWTLPPFLPKRLLLSLLILLAPNAVFWVLALLTATARPIVNLDYLPAALLI
                   10         20         30         40         50         60

70         80         90        100        110        120
orf48a.pep  ALPWRXVKIXGVLAXWLAVLFDGLMMVIQLFPFMDLIGAINLVPFIXTAPALYQIMTGLL
            ||||| ||| |||| |||||||||||||||||||||||||||||||| ||||||||||||
orf48-1     ALPWRFVKIAGVLAFWLAVLFDGLMMVIQLFPFMDLIGAINLVPFILTAPAPYQIMTGLL
                   70         80         90        100        110        120

130        140        150        160        170        180
orf48a.pep  LLYMLAMPFVLQKAAAKTDFRHIAACAAVVVAAGYFTGHLSXYDRGRMANIFGANNFYYA
            |||||||||||||||||||||||||:|||||:|||||||||| |||||||||||||||||
orf48-1     LLYMLAMPFVLQKAAAKTDFRHIAVCAAVVAAAGYFTGHLSYYDRGRMANIFGANNFYYA
                  130        140        150        160        170        180

190        200        210        220        230        240
orf48a.pep  KSQAMLYTVSQNADFITAGLVDPVFLPLGNQQRAATHLNEPKSQKILFIVAESWGLPANP
            ||||||||||||||||||||||||||||||||||||||||||||||||||||||||||||
orf48-1     KSQAMLYTVSQNADFITAGLVDPVFLPLGNQQRAATHLNEPKSQKILFIVAESWGLPANP
                  190        200        210        220        230        240

250        260        270        280        290        300
orf48a.pep  ELQNATFAKLLAQKXRFSVWESGSFPFIGATIEGEMRELCAYGGLRGFALRRAPDEKFAR
            |||||||||||||| |||||||||||||||:|||||||||||||||||||||||||||||
orf48-1     ELQNATFAKLLAQKDRFSVWESGSFPFIGATVEGEMRELCAYGGLRGFALRRAPDEKFAR
                  250        260        270        280        290        300

310        320        330        340        350        360
orf48a.pep  CLPNRLKQEGYATFAMHGAGSSLYDRFSWYPRAGFQEIKTAENLIGKKTCAIFGGVCDSE
            ||||||||||||||||||||||||||||||||||||||||||||||||||||||||||||
orf48-1     CLPNRLKQEGYATFAMHGAGSSLYDRFSWYPRAGFQEIKTAENLIGKKTCAIFGGVCDSE
                  310        320        330        340        350        360
```

```
                        -continued
                370       380       390       400       410       420
orf48a.pep  LPGEVSAXFKKHDKGLFYWMTLTSHADYPESDIFNHRLKCTEYGLPAETDXCRNFSLHTQ
            |||||||  |||||||||||||||||||||||||||||||||||||||| |||||||||
orf48-1     LFGEVSAFFKKHDKGLFYWMTLTSHADYPESDIFNHRLKCTEYGLPAETDLCRNFSLHTQ
                370       380       390       400       410       420

430       440       450       460       470
orf48a.pep  FFDQLADLIQRPEMKGTEVIIVGDHPPPVGNLNETFRYLKQGHVXWLNFKIKX
            ||||||||||||||||||||||||||||||||||||||||||| ||||||||
orf48-1     FFDQLADLIQRPEMXGTEVIIVGDHPPPVGNLNETFRYLKQGHVAWLNFKIKX
                430       440       450       460       470
```

Homology with a Predicted ORF from *N. gonorrhoeae*

ORF48 (SEQ ID NO: 468) shows 97.5% identity over a 119aa overlap with a predicted ORF (ORF48ng) (SEQ ID NO: 474) from *N. gonorrhoeae*:

```
orf48.pep  MNIHTLLSKQWTLPPFLPKRLLLSLLILLAPNAVFWVLALLTATARPIVNLDYLPAALLI   60
           ||||:|||:||||||||||||||||||||||||||||||||||||||||||||||||||
orf48ng    MNIHALLSEQWTLPPFLPKRLLLSLLILLAPNAVFWVLALLTATARPIVNLDYLPAALLI   60 orf48.pep  ALPWRFVKIAGVLAFWLAVLFDGLMMVIQLFPFMDLIGAINLVPFILTAPAPYQIMTGL   119
           ||||||||||||||||| |||||||||||||||||||||||||||||||||||||||||
orf48ng    ALPWRFVKIAGVLAFWPAVLFDGLMMVIQLFPFMDLIGAINLVPFILTAPAPYQIMTGLL  120
```

The ORF48ng nucleotide sequence (SEQ ID NO: 473) was predicted to encode a protein having amino acid sequence (SEQ ID NO: 474):

```
  1  MNIHALLSEQ WTLPPFLPKR LLLSLLILLA PNAVFWVLAL LTATARPIVN

51  LDYLPAALLI ALPWRFVKIA GVLAFWPAVL FDGLMMVIQL FPFMDLIGAI

101  NLVPFILTAP APYQIMTGLL LLYMLAMPFV LQKAAVKTDF RHIAVCAAVV

151  AAARYFTGPF ELLRTGGRWQ YVQHRRLLLS GSRASFRRRQ KADVLRRLGN

201  PYASMGNGG..
```

Further work identified the complete gonococcal DNA sequence (SEQ ID NO: 475):

```
  1  ATGAATATTC ACGCCCTGCT CTCCGAACAA TGGACGCTGC CGCCATTCCT

51  GCCGAAACGG CTGCTGCTGT CCCTGCTGAT ACTGCTGGCC CCCAATGCGG

101  TGTTTTGGGT TTTGGCACTG CTGACCGCCA CCGCCCGCCC GATTGTCAAT

151  TTGGACTACC TTCCCGCCGC GCTGCTGATC GCCCTGCCTT GGCGTTTCGT

201  CAAAATTGCC GGCGTATTGG CGTTTTGGCC GGCGGTTTTG TTTGACGGGC

251  TGATGATGGT GATCCAACTC TTCCCTTTTA TGGACCTCAT CGGCGCCATC

301  AACCTCGTCC CCTTCATCCT GACCGCCCCC GCCCCTTATC AGATAATGAC

351  CGGGCTGTTG CTGCTGTATA TGCTGGCGAT GCCGTTTGTG TTGCAAAAAG

401  CCGCCGTCAA AACCGACTTC CGACACATTG CCGTCTGTGC CGCCGTTGTG

451  GCGGCAGCCG GCTATTTCAC CGGCCATTTG AGTTACTACG ACCGGGGCG

501  GATGGCCAAT ATCTTCGGCG CAAACAACTT CTATTACGCc aAAAGTCAGG

551  CGATGCTCTA CACCGTCAGC CAGAATGCCG ACTTTATTAC CGCCGgcctG

601  GTCGACCCCG TCTTCCTCCC CTTGGGCAAT CAGCAGCGTG CCGCCACGCG
```

```
 651   GCTGAGTGAG CCGAAATCTC AAAAAATCCT CTTTATCGTC GCCGAATCTT

701   GGGGGCTGCC GGGCAATCCC GAGCTTCAAA ACGCCACTTT TGCCAAACTG

751   CTGGCGCAAA AAGACCGTTT TTCGGTTTGG GAAAGCGGCA GTTTTCCCTT

801   CATCGGCGCG ACGGTCGAAG GCGAAATGCG CGAATTGTGC GCCTACGGCG

851   GTTTGCGCGG GTTCGCACTG CGCCGCGCGC CCGACGAAAA ATTTGCCCGC

901   TGCCTCCCCA ACCGTTTGAA ACAAGAAGGT TACGCCACCT TTGCGATGCA

951   CGGCGCGGGT AGTTCGCTTT ACGACCGCTT CAGCTGGTAT CCGAGGGCGG

1001   GCTTTCAAAA AATCAAAACC GCCGAAAACC TGATCGGTAA AAAAACCTGC

1051   GCCATTTTCG GCGGCGTGTG CGACAGCGAG CTGTTCGGCG AAGTGTCGGC

1101   ATTTTTCAAA AAACACGACA AGGGACTGTT TTACTGGATG ACGCTGACCA

1151   GCCACGCCGA CTATCCCGAA TCCGACATTT TCAACCACAG GCTCAAATGC

1201   ACCGAATACG GCCTGCCCGC CGAAACCGAC CTCTGCCGCA ATTTCAGCCT

1251   GCACACCCAA TtcttcgACC AACTGGCGGA TTTGATCCGA CGCCCCGAAA

1301   TGAAAGGCAC GGAAGTCATC ATCGTCGGCG ACCATCCGCC GCCCGTCGGC

1351   AACCTCAATG AAACCTTCCG CTACCTCAAA CAGGGACACG TCGCCTGGCT

1401   GCACTTCAAA ATCAAATAA
```

This encodes a protein having amino acid sequence (SEQ ID NO: 476; ORF48ng-1):

```
  1   MNIHALLSEQ WTLPPFLPKR LLLSLLILLA PNAVFWVLAL LTATARPIVN

51   LDYLPAALLI ALPWRFVKIA GVLAFWPAVL FDGLMMVIQL FPFMDLIGAI

101   NLVPFILTAP APYQIMTGLL LLYMLAMPFV LQKAAVKTDF RHIAVCAAVV

151   AAAGYFTGHL SYYDRGRMAN IFGANNFYYA KSQAMLYTVS QNADFITAGL

201   VDPVFLPLGN QQRAATRLSE PKSQKILFIV AESWGLPGNP ELQNATFAKL

251   LAQKDRFSVW ESGSFPFIGA TVEGEMRELC AYGGLRGFAL RRAPDEKFAR

301   CLPNRLKQEG YATFAMHGAG SSLYDRFSWY PRAGFQKIKT AENLIGKKTC

351   AIFGGVCDSE LFGEVSAFFK KHDKGLFYWM TLTSHADYPE SDIFNHRLKC

401   TEYGLPAETD LCRNFSLHTQ FFDQLADLIR RPEMKGTEVI IVGDHPPPVG

451   NLNETFRYLK QGHVAWLHFK IK*
```

ORG48ng-1 (SEQ ID NO: 476) and ORF48-1 (SEQ ID NO: 470) show 97.9% identity in 472 aa overlap:

```
                    10         20         30         40         50         60
orf48-1.pep MNIHTLLSKQWTLPPFLPKRLLLSLLILLAPNAVFWVLALLTATARPIVNLDYLPAALLI
            ||||:|||:||||||||||||||||||||||||||||||||||||||||||||||||||
orf46ng-1   MNIHALLSEQWTLPPFLPKRLLLSLLILLAPNAVFWVLALLTATARPIVNLDYLPAALLI
                    10         20         30         40         50         60

70         80         90        100        110        120
orf48-1.pep ALPWRFVKIAGVLAFWLAVLFDGLMMVIQLFPFMDLIGAINLVPFILTAPAPYQIMTGLL
            |||||||||||||||| ||:|||||||||||||||||||||||||||||||||||||||
orf48ng-1   ALPWRFVKIAGVLAFWPAVLFDGLMMVIQLFPFMDLIGAINLVPFILTAPAPYQIMTGLL
                    70         80         90        100        110        120

130        140        150        160        170        180
orf48-1.pep LLYMLAMPFVLQKAAAKTDFRHIAVCAAVVAAAGYFTGHLSYYDRGRMANIFGANNFYYA
            ||||||||||||||||:|||||||||||||||||||||||||||||||||||||||||||
orf48ng-1   LLYMLAMPFVLQKAAVKTDFRHIAVCAAVVAAAGYFTGHLSYYDRGRMANIFGANNFYYA
                   130        140        150        160        170        180
```

```
                  190        200        210        220        230        240
orf48-1.pep  KSQAMLYTVSQNADFITAGLVDPVFLPLGNQQRAATHLNEPKSQKILFIVAESWGLPANP
             ||||||||||||||||||||||||||||||||||:|:||||||||||||||||||||:||
orf48ng-1    KSQAMLYTVSQNADFITAGLVDPVFLPLGNQQRAATRLSEPKSQKILFIVAESWGLPGNP
                  190        200        210        220        230        240

250        260        270        280        290        300
orf48-1.pep  ELQNATFAKLLAQKDRFSVWESGSFPFIGATVEGEMRELCAYGGLRGFALRRAPDEKFAR
             ||||||||||||||||||||||||||||||||||||||||||||||||||||||||||||
orf48ng-1    ELQNATFAKLLAQKDRFSVWESGSFPFIGATVEGEMRELCAYGGLRGFALRRAPDEKFAR
                  250        260        270        280        290        300

310        320        330        340        350        360
orf48-1.pep  CLPNRLKQEGYATFAMHGAGSSLYDRFSWYPRAGFQEIKTAENLIGKKTCAIFGGVCDSE
             |||||||||||||||||||||||||||||||||||||:||||||||||||||||||||||
orf48ng-1    CLPNRLKQEGYATFAMHGAGSSLYDRFSWYPRAGFQKIKTAENLIGKKTCAIFGGVCDSE
                  310        320        330        340        350        360

370        380        390        400        410        420
orf48-1.pep  LFGEVSAFFKKHDKGLFYWMTLTSHADYPESDIFNHRLKCTEYGLPAETDLCRNFSLHTQ
             ||||||||||||||||||||||||||||||||||||||||||||||||||||||||||||
orf48ng-1    LFGEVSAFFKKHDKGLFYWMTLTSHADYPESDIFNHRLKCTEYGLPAETDLCRNFSLHTQ
                  370        380        390        400        410        420

430        440        450        460        470
orf48-1.pep  FFDQLADLIQRPEMKGTEVIIVGDHPPPVGNLNETFRYLKQGHVAWLNFKIKX
             ||||||||:||||||||||||||||||||||||||||||||||||||:|||||
orf48ng-1    FFDQLADLIRRPEMKGTEVIIVGDHPPPVGNLNETFRYLKQGHVAWLHFKIKX
                  430        440        450        460        470
```

Based on this analysis, including the presence of a putative leader sequence (double-underlined) and two putative transmembrane domains (single-underlined) in the gonococcal protein, it is predicted that the proteins from *N.meningitidis* and *N.gonorrhoeae*, and their epitopes, could be useful antigens for vaccines or diagnostics, or for raising antibodies.

Example 57

The following partial DNA sequence was identified in *N.meningitidis* (SEQ ID NO: 477):

```
  1  ..GTGAGCGGAC GTTACCGCGC TTTGGATCGC GTTTCCAAAA TCATCATCGT
 51    TACTTTGAGT ATCGCCACGC TTGCCGCCGC CGGCATCGCT ATGTCGCGCG
101    GTATGCAGAT GCAGTCCGAT TTTATCGAGC CGACACCGTG GACGCTTGCC
151    GGTTTGGGCT TCCTGATCGC GCTGATGGGC TGGATGCCCG CGCCGATTGA
201    AATTTCCGCC ATCAATTCTT TGTGGGTAAC CGAAAAACAA CGCATCAATC
251    CTTCCGAATA CCGCGACGGG ATTTTTGAAT TCAACGTCGG TTATATCGCC
301    AGTGCGGTTT TGGCTTTGGT TTTCCTTGCA CTGGGCGC.G TAGCGCCGAA
351    CGGCAACGGC GA.ACAGTGC AGATGGCGGG CGGCAAATAT AACGGGCAAT
401    TGATCAATAT GTACGCC..
```

This corresponds to the amino acid sequence (SEQ ID NO: 478; ORF53):

```
  1  ..VSGRYRALDR VSKIIIVTLS IATLAAAGIA MSRGMQMQSD FIEPTPWTLA
 51    GLGFLIALMG WMPAPIEISA INSLWVTEKQ RINPSEYRDG IFEFNVGYIA
101    SAVLALVFLA LGXVAPNGNG XTVQMAGGKY NGQLINMYA..
```

Further work revealed the complete nucleotide sequence (SEQ ID NO: 479):

```
  1   ATGTCCGAAC AACATATTTC GACTTGGAAA AGTAAAATCA ACGCATTGGG
 51   TCCGGGGATC ATGATGGCTT CGGCGGCGGT CGGCGGTTCG CACCTGATTG
```

```
                    -continued
 101    CCTCGACGCA GGCGGGCGCG CTTTACGGCT GGCAGATCGC GCTCATCATC

151    ATCCTGACCA ACCTCTTCAA ATACCCGTTT TTCCGCTTCA GCGCGCATTA

201    CACGCTGGAC ACGGGCAAGA GCCTGATTGA AGGTTATGCC GAGAAAAGCC

251    GCGTTTATTT GTGGGTATTC CTGATTTTGT GCATCCTCTC CGCCACGATT

301    AACGCGGGCG CGGTCGCCAT TGTAACCGCC GCCATCGTCA AAATGGCGAT

351    TCCCTCGCTG ATGTTTGATG CCGGCACGGT TGCCGCCTTG ATTATGGCAT

401    CCTGCCTGAT TATTTTGGTG AGCGGACGTT ACCGCGCTTT GGATCGCGTT

451    TCCAAAATCA TCATCGTTAC TTTGAGTATC GCCACGCTTG CCGCCGCCGG

501    CATCGCTATG TCGCGCGGTA TGCAGATGCA GTCCGATTTT ATCGAGCCGA

551    CACCGTGGAC GCTTGCCGGT TTGGGCTTCC TGATCGCGCT GATGGGCTGG

601    ATGCCCGCGC CGATTGAAAT TCCGCCATC AATTCTTTGT GGGTAACCGA

651    AAAACAACGC ATCAATCCTT CCGAATACCG CGACGGGATT TTTGATTTCA

701    ACGTCGGTTA TATCGCCAGT GCGGTTTTGG CTTTGGTTTT CCTTGCACTG

751    GGCGCGTTTG TGCAATACGG CAACGGCGAA GCAGTGCAGA TGGCGGGCGG

801    CAAATATATC GGGCAATTGA TCAATATGTA CGCCGTTACC ATCGGCGGCT

851    GGTCGCGCCC GCTGGTGGCG TTTATCGCGT TTGCCTGTAT GTACGGCACG

901    ACGATTACCG TCGTGGACGG CTATGCCCGT GCCATTGCCG AACCCGTGCG

951    CCTGCTGCGC GGAAAAGACA AAACGGGCAA CGCCGAATTC TTTGCCTGGA

1001    ATATTTGGGT GGCGGGCAGC GGTTTGGCGG TGATTTTCTG GTTTGACGGC

1051    GTAATGGCGA ATCTGCTCAA ATTTGCGATG ATTGCCGCTT TTGTGTCCGC

1101    CCCTGTGTTT GCCTGGCTGA ATTACCGTTT GGTTAAAGGT GATGAAAAAC

1151    ACAAACTCAC ATCAGGTATG AATGCCCTTG CATTGGCAGG CTTGATTTAT

1201    CTGACCGGTT TTACCGTTTT GTTCTTATTG AATTTGGCGG AATGTTCAA

1251    ATGA
```

This corresponds to the amino acid sequence (SEQ ID NO: 480; ORF53-1):

```
  1   MSEQHISTWK SKINALGPGI MMASAAVGGS HLIASTQAGA LYGWQIALII

51   ILTNLFKYPF FRFSAHYTLD TGKSLIEGYA EKSRVYLWVF LILCILSATI

101   NAGAVAIVTA AIVKMAIPSL MFDAGTVAAL IMASCLIILV SGRYRALDRV

151   SKIIIVTLSI ATLAAAGIAM SRGMQMQSDF IEPTPWTLAG LGFLIALMGW

201   MPAPIEISAI NSLWVTEKQR INPSEYRDGI FDFNVGYIAS AVLALVFLAL

251   GAFVQYGNGE AVQMAGGKYI GQLINMYAVT IGGWSRPLVA FIAFACMYGT

301   TITVVDGYAR AIAEPVRLLR GKDKTGNAEF FAWNIWVAGS GLAVIFWFDG

351   VMANLLKFAM IAAFVSAPVF AWLNYRLVKG DEKHKLTSGM NALALAGLIY

401   LTGFTVLFLL NLAGMFK*
```

Computer analysis of this amino acid sequence gave the following results:

Homology with a Predicted ORF from *N.meningitidis* (Strain A)

ORF53 (SEQ ID NO: 478) shows 93.5% identity over a 139aa overlap with an ORF (ORF53a) (SEQ ID NO: 482) from strain A of *N. meningitidis*:

```
                                          10        20        30
orf53.pep                        VSGRYRALDRVSKIIIVTLSIATLAAAGIA
                                 ||||||||||||||||||||||||||||||
orf53a      AAIVKMAIPSLMFDAGTVAALIMASCLIILVSGRYRALDRVSKIIIVTLSIATLAAAGIA
              110       120       130       140       150       160

40        50        60        70        80        90
orf53.pep   MSRGMQMQSDFIEPTPWTLAGLGFLIALMGWMPAPIEISAINSLWVTEKQRINPSEYRDG
            ||||||||||||||||||||||||||||||||||||||||||||||||||||||||||||
orf53a      MSRGMQMQSDFIEPTPWTLAGLGFLIALMGWMPAPIEISAINSLWVTEKQRINPSEYRDG
              170       180       190       200       210       220

100       110       120       130       139
orf53.pep   IFEFNVGYIASAVLALVFLALGXVAPNGNGXTVQMAGGKYNGQLINMYA
            ||:|||||||||||||||||| :   |||:||||||| ||||||||||
orf53a      IFDFNVGYIASAVLALVFLALGAFVQYGNGEAVQMAGGKYIGQLINMYAVTIGGWSRPLV
              230       240       250       260       270       280 orf53a      AFIAFACMYGTTITVVDGYARAIAEPVRLLRGKDKTGNAEFFAWNIWVAGSGLAVIFWFD
              290       300       310       320       330       340
```

The complete length ORF53a nucleotide sequence (SEQ ID NO: 481) is:

```
   1    ATGTCCGAAC AACATATTTC GACTTGGAAA AGTAAAATCA ACGCATTGGG
  51    ACCGGGGATT ATGATGGCTT CGGCGGCGGT CGGCGGTTCG CACCTGATTG
 101    CCTCGACGCA GGCGGGCGCG CTTTACGGCT GGCAGATCGC GCTCATCATC
 151    ATCCTGACCA ACCTCTTCAA ATACCCGTTT TTCCGCTTCA GCGCGCATTA
 201    CACGCTGGAC ACGGGCAAGA GCCTGATTGA AGGTTATGCC GAGAAAAGCC
 251    GCGTTTATTT GTGGGTATTC CTGATTTTGT GCATCCTCTC CGCCACGATT
 301    AACGCGGGCG CGGTCGCCAT TGTAACCGCC GCCATCGTCA AAATGGCGAT
 351    TCCCTCGCTG ATGTTTGATG CCGGCACGGT TGCCGCCTTG ATTATGGCAT
 401    CCTGCCTGAT TATTTTGGTG AGCGGACGTT ACCGCGCTTT GGATCGCGTT
 451    TCCAAAATCA TCATCGTTAC TTTGAGTATC GCCACGCTTG CCGCCGCCGG
 501    CATCGCTATG TCGCGCGGTA TGCAGATGCA GTCCGATTTT ATCGAGCCGA
 551    CACCGTGGAC GCTTGCCGGT TTGGGCTTCC TGATCGCGCT GATGGGCTGG
 601    ATGCCCGCGC CGATTGAAAT TTCCGCCATC AATTCTTTGT GGGTAACCGA
 651    AAAACAACGC ATCAATCCTT CCGAATACCG CGACGGGATT TTTGATTTCA
 701    ACGTCGGTTA TATCGCCAGT GCGGTTTTGG CTTTGGTTTT CCTTGCACTG
 751    GGCGCGTTTG TGCAATACGG CAACGGCGAA GCAGTGCAGA TGGCGGGCGG
 801    CAAATATATC GGGCAATTGA TCAATATGTA CGCCGTTACC ATCGGCGGCT
 851    GGTCGCGCCC GCTGGTGGCG TTTATCGCGT TTGCCTGTAT GTACGGCACG
 901    ACGATTACCG TTGTGGACGG CTATGCCCGT GCCATTGCCG AACCCGTGCG
 951    CCTGCTGCGC GGAAAAGACA AAACGGGCAA CGCCGAATTC TTTGCCTGGA
1001    ATATTTGGGT GGCGGGCAGC GGTTTGGCGG TGATTTTCTG GTTTGACGGC
1051    GTAATGGCGA ATCTGCTCAA ATTTGCGATG ATTGCCGCTT TTGTGTCCGC
```

```
                       -continued
1101    CCCTGTGTTT GCCTGGCTGA ATTACCGTTT GGTCAAAGGT GATGAAAAAC

1151    ACAAACTCAC ATCAGGTATG AATGCCCTTG CATTGGCAGG CTTGATTTAT

1201    CTGACCGGTT TTACCGTTTT GTTCTTATTG AATTTGGCGG AATGTTCAA

1251    ATGA
```

This encodes a protein having amino acid sequence (SEQ ID NO: 482):

```
  1    MSEQHISTWK SKINALGPGI MMASAAVGGS HLIASTQAGA LYGWQIALII

51    ILTNLFKYPF FRFSAHYTLD TGKSLIEGYA EKSRVYLWVF LILCILSATI

101    NAGAVAIVTA AIVKMAIPSL MFDAGTVAAL IMASCLIILV SGRYRALDRV

151    SKIIIVTLSI ATLAAAGIAM SRGMQMQSDF IEPTPWTLAG LGFLIALMGW

201    MPAPIEISAI NSLWVTEKQR INPSEYRDGI FDFNVGYIAS AVLALVFLAL

251    GAFVQYGNGE AVQMAGGKYI GQLINMYAVT IGGWSRPLVA FIAFACMYGT

301    TITVVDGYAR AIAEPVRLLR GKDKTGNAEF FAWNIWVAGS GLAVIFWFDG

351    VMANLLKFAM IAAFVSAPVF AWLNYRLVKG DEKHKLTSGM NALALAGLIY

401    LTGFTVLFLL NLAGMFK*
```

ORF 53a (SEQ ID NO: 482) shows 100.0% identity in 417 aa overlap with ORF53-1 (SEQ ID NO: 480):

```
                    10         20         30         40         50         60
orf53a.pep  MSEQHISTWKSKINALGPGIMMASAAVGGSHLIASTQAGALYGWQIALIIILTNLFKYPF
            ||||||||||||||||||||||||||||||||||||||||||||||||||||||||||||
orf53-1     MSEQHISTWKSKINALGPGIMMASAAVGGSHLIASTQAGALYGWQIALIIILTNLFKYPF
                    10         20         30         40         50         60

70         80         90        100        110        120
orf53a.pep  FRFSAHYTLDTGKSLIEGYAEKSRVYLWVFLILCILSATINAGAVAIVTAAIVKMAIPSL
            ||||||||||||||||||||||||||||||||||||||||||||||||||||||||||||
orf53-1     FRFSAHYTLDTGKSLIEGYAEKSRVYLWVFLILCILSATINAGAVAIVTAAIVKMAIPSL
                    70         80         90        100        110        120

130        140        150        160        170        180
orf53a.pep  MFDAGTVAALIMASCLIILVSGRYRALDRVSKIIIVTLSIATLAAAGIAMSRGMQMQSDF
            ||||||||||||||||||||||||||||||||||||||||||||||||||||||||||||
orf53-1     MFDAGTVAALIMASCLIILVSGRYRALDRVSKIIIVTLSIATLAAAGIAMSRGMQMQSDF
                   130        140        150        160        170        180

190        200        210        220        230        240
orf53a.pep  IEPTPWTLAGLGFLIALMGWMPAPIEISAINSLWVTEKQRINPSEYRDGIFDFNVGYIAS
            ||||||||||||||||||||||||||||||||||||||||||||||||||||||||||||
orf53-1     IEPTPWTLAGLGFLIALMGWMPAPIEISAINSLWVTEKQRINPSEYRDGIFDFNVGYIAS
                   190        200        210        220        230        240

250        260        270        280        290        300
orf53a.pep  AVLALVFLALGAFVQYGNGEAVQMAGGKYIGQLINMYAVTIGGWSRPLVAFIAFACMYGT
            ||||||||||||||||||||||||||||||||||||||||||||||||||||||||||||
orf53-1     AVLALVFLALGAFVQYGNGEAVQMAGGKYIGQLINMYAVTIGGWSRPLVAFIAFACMYGT
                   250        260        270        280        290        300

310        320        330        340        350        360
orf53a.pep  TITVVDGYARAIAEPVRLLRGKDKTGNAEFFAWNIWVAGSGLAVIFWFDGVMANLLKFAM
            ||||||||||||||||||||||||||||||||||||||||||||||||||||||||||||
orf53-1     TITVVDGYARAIAEPVRLLRGKDKTGNAEFFAWNIWVAGSGLAVIFWFDGVMANLLKFAM
                   310        320        330        340        350        360

370        380        390        400        410
orf53a.pep  IAAFVSAPVFAWLNYRLVKGDEKHKLTSGMNALALAGLIYLTGFTVLFLLNLAGMFKX
            |||||||||||||||||||||||||||||||||||||||||||||||||||||||||
orf53-1     IAAFVSAPVFAWLNYRLVKGDEKHKLTSGMNALALAGLIYLTGFTVLFLLNLAGMFK
                   370        380        390        400        410
```

Homology with a Predicted ORF from *N.gonorrhoeae*
ORF53 (SEQ ID NO: 478) shows 92.1% identity over a 139aa overlap with a predicted ORF (ORF53ng) (SEQ ID NO: 484) from *N. gonorrhoeae*:

```
orf53.pep                                VSGRYRALDRVSKIIVTLSIATLAAAGIA   30
                                         |||||||||||||||||||||||||||||
orf53ng     AAIVKMAIPSLMFDAGTVAALIMASCLIILVSGRYRALDRVSKIIVTLSIATLAAAGIA   91 orf53.pep   MSRGMQMQSDFIEPTPWTLAGLGFLIALMGWMPAPIEISAINSLWVTEKQRINPSEYRDG   90
            ||||||||| ||||||||||||||||||||||||||||||||||||||||||||||||||
orf53ng     MSRGMQMQPDFIEPTPWTLAGLGFLIALMGWMPAPIEISAINSLWVTEKQRINPSEYRDG  151 orf53.pep   IFEFNVGYIASAVLALVFLALGXVAPNGNGXTVQMAGGKYNGQLINMYA             139
            ||:||||||||||||||||||| :   ||| :||:||||  ||||||||
orf53ng     IFDFNVGYIASAVLALVFLALGAFVQYGNGEAVQMGGGKYIGQLINMYAVTIGGGSRPLV  211
```

An ORF53ng nucleotide sequence (SEQ ID NO: 483) was predicted to encode a protein having amino acid sequence (SEQ ID NO: 484):

```
  1  MPKKSCVYLW VFLILCIASA TINAGAVAIV TAAIVKMAIP SLMFDAGTVA

51  ALIMASCLII LVSGRYRALD RVSKIIIVTL SIATLAAAGI AMSRGMQMQP

101  DFIEPTPWTL AGLGFLIALM GWMPAPIEIS AINSLWVTEK QRINPSEYRD

151  GIFDFNVGYI ASAVLALVFL ALGAFVQYGN GEAVQMGGGK YIGQLINMYA

201  VTIGGGSRPL VAFIAFACMY GAASTVVDGY ARAIAEPVRL LRGKDKTARP

251  IVLLEKLGGR HRFGRDFLV*
```

Further analysis revealed further partial DNA gonococcal sequence (SEQ ID NO: 485):

```
  1  ..aagaAAAGCT GCGTTTATTT GTGGGTTTTT TTGATTTTGT GTATCGCCTC

51      CGCCACGATT AACGCGGGCG CGGTCGCCAT TGTAACCGCC GCCATCGTCA

101      AAATGGCGAT TCCCTCGCTG ATGTTTGATG CCGGCACGGT TGCCGCCTTG

151      ATTATGGCAT CCTGCCTGAT TATTTTGGTG AGCGGACGTT ACCGCGCTTT

201      GGATCGTGTT TCCAAAATCA TCATTGTTAC TTTGAGCATC GCCACGCTTG

251      CCGCCGCCGG CATCGCTATG TCGCGCGGTA TGCAGATGCA GCCCGATTTT

301      ATCGAGCCGA CACCGTGGAC GCTTGCCGGT TTGGGCTTCC TGATCGCGCT

351      GATGGGCTGG ATGCCCGCGC CGATCGAAAT TTCCGCCATC AATTCTTTGT

401      GGGTAACCGA AAAACAACGC ATCAATCCTT CTGAATACCG CGACGGGATT

451      TTCGATTTCA ACGTCGGTTA TATCGCcagT GCGGTTTTGG CTTTGGTTTT

501      CCTTGCACTG GGCGCGTTTG TGCAATACGG CAACGGCGAA GCAGTGCAGA

551      TGGCGGGCGG CAAATATATC GGGCAATTGA TTAATATGTA TGCCGTAACC

601      ATCGGCGGCT GGTCTCGTCC GCTGGTGGCG TTTATCGCGT TTGCCTGTAT

651      GTACGGCACG ACGATTACCG TTGTGGACGG TTATGCGCGT GCCATTGCCG

701      AACCCGTGCG CCTGCTGCGC GGCAGGGATA AAACCGGCAA CGCCGAGTTG

751      TTtgccTGGA ATATTTGGGT GGCGGGCAGC GGTTTGGCGG TGATTTTCTG

801      GTTTGACggc gcaaTGGCgG AACtgcTCAA ATTTGCGATG ATtgccgcCT

851      TTGTGTCCGC CCCTGTGTTC GCCTGGCTCA ACTACCGCCT CGTCAAAGGG
```

```
                -continued
901    GACAAACGCC ACAGGCTTAC CGCCGGTATG AACGCCCTTG CCATTGTCGG

951    CCTGCTCTAC CTGGCCGGGT TTGCCGTTTT GTTCCTGTTG AACCTTACCG

1001   GACTTTTGGC ATAG
```

This corresponds to the amino acid sequence (SEQ ID NO: 486; ORF53ng-1):

```
  1    ..KKSCVYLWVF LILCIASATI NAGAVAIVTA AIVKMAIPSL MFDAGTVAAL

51    IMASCLIILV SGRYRALDRV SKIIIVTLSI ATLAAAGIAM SRGMQMQPDF

101    IEPTPWTLAG LGFLIALMGW MPAPIEISAI NSLWVTEKQR INPSEYRDGI

151    FDFNVGYIAS AVLALVFLAL GAFVQYGNGE AVQMAGGKYI GQLINMYAVT

201    IGGWSRPLVA FIAFACMYGT TITVVDGYAR AIAEPVRLLR GRDKTGNAEL

251    FAWNIWVAGS GLAVIFWFDG AMAELLKFAM IAAFVSAPVF AWLNYRLVKG

301    DKRHRLTAGM NALAIVGLLY LAGFAVLFLL NLTGLLA*
```

ORF53ng-1 (SEQ ID NO: 486) and ORF53-1 (SEQ ID NO: 480) show 94.0% identity in 336 aa overlap:

```
                     60        70        80        90       100       110
orf53-1.pep  ILTNLFKYPFFRFSAHYTLDTGKSLIEGYAEKSRVYLWVFLILCILSATINAGAVAIVTA
                                            :|| |||||||||| ||||||||||||||
orf53ng-1                                KKSCVYLWVFLILCIASATINAGAVAIVTA
                                                    10        20        30

120       130       140       150       160       170
orf53-1.pep  AIVKMAIPSLMFDAGTVAALIMASCLIILVSGRYRALDRVSKIIIVTLSIATLAAAGIAM
             ||||||||||||||||||||||||||||||||||||||||||||||||||||||||||||
orf53ng-1    AIVKMAIPSLMFDAGTVAALIMASCLIILVSGRYRALDRVSKIIIVTLSIATLAAAGIAM
                     40        50        60        70        80        90

180       190       200       210       220       230
orf53-3.pep  SRGMQMQSDFIEPTPWTLAGLGFLIALMGWMPAPIEISAINSLWVTEKQRINPSEYRDGI
             ||||||| || |||||||||||||||||||||||||||||||||||||||||||||||||
orf53ng-1    SRGMQMQPDFIEPTPWTLAGLGFLIALMGWMPAPIEISAINSLWVTEKQRINPSEYRDGI
                    100       110       120       130       140       150

240       250       260       270       280       290
orf53-1.pep  FDFNVGYIASAVLALVFLALGAFVQYGNGEAVQMAGGKYIGQLINMYAVTIGGWSRPLVA
             ||||||||||||||||||||||||||||||||||||||||||||||||||||||||||||
orf53ng-1    FDFNVGYIASAVLALVFLALGAFVQYGNGEAVQMAGGKYIGQLINMYAVTIGGWSRPLVA
                    160       170       180       190       200       210

300       310       320       330       340       350
orf53-1.pep  FIAFACMYGTTITVVDGYARAIAEPVRLLRGKDKTGNAEFFAWNIWVAGSGLAVIFWFDG
             |||||||||||||||||||||||||||||||:|||||||:||||||||||||||||||||
orf53ng-1    FIAFACMYGTTITVVDGYARAIAEPVRLLRGRDKTGNAELFAWNIWVAGSGLAVIFWFDG
                    220       230       240       250       260       270

360       370       380       390       400       410
orf53-1.pep  VMANLLKFAMIAAFVSAPVFAWLNYRLVKGDEKHKLTSGMNALALAGLIYLTGFTVLFLL
             :||:||||||||||||||||||||||||||:::|:||:|||||::||:||:||:||||||
orf53ng-1    AMAELLKFAMIAAFVSAPVFAWLNYRLVKGDKRHRLTAGMNALAIVGLLYLAGFAVLFLL
                    280       290       300       310       320       330 orf53-1.pep  NLAGMFKX
             ||:|::
orf53ng-1    NLTGLLAX
```

Based on this analysis, including the presence of a putative leader sequence (double-underlined) and several putative transmembrane domains (single-underlined) in the gonococcal protein, it is predicted that the proteins from *N.meningitidis* and *N.gonorrhoeae*, and their epitopes, could be useful antigens for vaccines or diagnostics, or for raising antibodies.

Example 58

The following partial DNA sequence was identified in *N.meningitidis* (SEQ ID NO: 487):

```
  1  ..TTGCGGGAAA CGGCATATGT TTTGGATAGT TTTGATCGTT ATTTTGTTGT
 51    TGCGCTTGCC GGCTTGTTTT TTGTCCGCGC ACAATCCGAA CGCGAGTGGA
101    TGCGCGAGGT TTCTGCGTGG CAGGAAAAGA AAGGGGAAAA ACAGGCGGAG
151    CTGCCTGAAA TCAAAGACGG TATGCCCGAT TTTCCCGAAC TTGCCCTGAT
201    GCTTTTCCAC GCCGTCAAAA CGGCAGTGTA TGGGCTGTTT GTCGGTGTCG
251    TCCGTTTCTG CCGAAACTAT CTGGCGCACG AATCCGAACC GGACAGGCCC
301    GTTCCGCCT..
```

This corresponds to the amino acid sequence (SEQ ID NO: 488; ORF58):

```
  1  ..LRETAYVLDS FDRYFVVALA GLFFVRAQSE REWMREVSAW QEKKGEKQAE
 51    LPEIKDGMPD FPELALMLFH AVKTAVYWLF VGVVRFCRNY LAHESEPDRP
101    VPP..
```

Further work revealed the complete nucleotide sequence (SEQ ID NO: 489):

```
   1   ATGTTTTGGA TAGTTTTGAT CGTTATTTTG TTGCTTGCGC TTGCCGGCTT
  51   GTTTTTTGTC CGCGCACAAT CCGAACGCGA GTGGATGCGC GAGGTTTCTG
 101   CGTGGCAGGA AAAGAAAGGG GAAAAACAGG CGGAGCTGCC TGAAATCAAA
 151   GACGGTATGC CCGATTTTCC CGAACTTGCC CTGATGCTTT TCCATGCCGT
 201   CAAAACGGCA GTGTATTGGC TGTTTGTCGG TGTCGTCCGT TTCTGCCGAA
 251   ACTATCTGGC GCACGAATCC GAACCGGACA GGCCCGTTCC GCCTGCTTCT
 301   GCAAACCGTG CGGATGTTCC GACCGCATCC GACGGATATT CAGACAGTGG
 351   AAACGGGACG GAAGAAGCGG AAACGGAAGA AGCAGAAGCT GCGGAGGAAG
 401   AGGCTGCCGA TACGGAAGAC ATTGCAACTG CCGTAATCGA CAACCGCCGC
 451   ATCCCATTCG ACCGGAGTAT TGCTGAAGGG TTGATGCCGT CTGAAAGCGA
 501   AATTTCGCCC GTCCGTCCGG TTTTTAAAGA AATCACTTTG GAAGAAGCAA
 551   CGCGTGCTTT AAACAGCGCG GCTTTAAGGG AAACGAAAAA ACGCTATATC
 601   GATGCATTTG AGAAAAACGA AACAGCGGTC CCCAAAGTCC GCGTGTCCGA
 651   TACCCCGATG GAAGGGCTGC AGATTATCGG TTTGGACGAC CCTGTGCTTC
 701   AACGCACGTA TTCCCATATG TTCGATGCGG ACAAAGAAGC GTTTTCCGAG
 751   TCTGCGGATT ACGGATTTGA GCCGTATTTT GAGAAGCAGC ATCCGTCTGC
 801   CTTTTCTGCA GTCAAAGCCG AAAATGCACG GAATGCGCCG TTCCACCGTC
 851   ATGCAGGGCA GGGGAAAGGG CAGGCGGAGG CAAAATCCCC GGATGTTTCC
 901   CAAGGGCAGT CCGTTTCAGA CGGCACGGCC GTCCGCGATG CCCGCCGCCG
 951   CGTTTCCGTC AATTTGAAAG AACCGAACAA GGCAACGGTT TCTGCGGAGG
1001   CGCGAATTTC TCGCCTGATT CCGGAAAGTC AGACGGTTGT CGGGAAACGG
```

-continued

```
1051  GATGTCGAAA TGCCGTCTGA AACCGAAAAT GTTTTCACGG AAACCGTTTC

1101  GTCTGTGGGA TACGGCGGTC CGGTTTATGA TGAAACTGCC GATATCCATA

1151  TTGAAGAACC TGCCGCGCCC GATGCTTGGG TGGTCGAACC ACCCGAAGTG

1201  CCGAAAGTTC CCATGACCGC AATCGATATT CAGCCGCCGC CTCCCGTATC

1251  GGAAATCTAC AACCGTACCT ATGAACCGCC GTCAGGATTC GAGCAGGTGC

1301  AACGCAGCCG CATTGCCGAG ACCGACCATC TTGCCGATGA TGTTTTGAAT

1351  GGAGGTTGGC AGGAGGAAAC CGCCGCTATT GCGGATGACG GCAGTGAAGG

1401  TGCGGCAGAG CGGTCAAGCG GCAATATCT GTCGGAAACC GAAGCGTTCG

1451  GGCATGACAG TCAGGCGGTT TGTCCGTTTG AAAATGTGCC GTCTGAACGC

1501  CCGTCCTGCC GGGTATCGGA TACGGAAGCG GATGAAGGGG CGTTCCCATC

1551  TGAAGAAACC GGTGCGGTAT CCGAACACCT GCCGACAACC GACCTGCTTC

1601  TGCCTCCGCT GTTCAATCCC GAGGCGACGC AAACCGAAGA AGAACTGTTG

1651  GAAAACAGCA TCACCATCGA AGAAAAATTG GCGGAGTTCA AAGTCAAGGT

1701  CAAGGTTGTC GATTCTTATT CCGGCCCCGT AATTACGCGT TATGAAATCG

1751  AACCCGATGT CGGCGTGCGC GGCAATTCCG TTCTGAATCT GGAAAAAGAT

1801  TTGGCGCGTT CGCTCGGCGT GGCTTCCATC CGCGTTGTCG AAACCATCCC

1851  CGGCAAAACC TGCATGGGTT TGGAACTTCC GAACCCGAAA CGCCAAATGA

1901  TACGCCTGAG CGAAATCTTC AATTCGCCCG AGTTTGCCGA ATCCAAATCC

1951  AAGCTGACGC TCGCGCTCGG TCAGGACATC ACCGGACAGC CCGTCGTAAC

2001  CGACTTGGGA AAAGCACCGC ATTTGTTGGT TGCCGGCACG ACCGGTTCGG

2051  GCAAATCGGT GGGTGTCAAC GCGATGATTC TGTCTATGCT TTTCAAAGCC

2101  GCGCCGGAAG ACGTGCGTAT GATTATGATC GATCCGAAAA TGCTGGAATT

2151  GAGCATTTAC GAAGGCATCC CGCACCTGCT CGCCCCTGTC GTTACCGATA

2201  TGAAGCTGGC GGCAAACGCG CTGAACTGGT GTGTTAACGA AATGGAAAAA

2251  CGCTACCGCC TGATGAGCTT TATGGGCGTG CGTAATCTTG CGGGCTTCAA

2301  TCAAAAAATC GCCGAAGCCG CAGCAAGGGG AGAAAAAATC GGCAATCCGT

2351  TCAGCCTCAC GCCCGACGAT CCCGAACCTT TGGAAAAACT GCCGTTTATC

2401  GTGGTCGTGG TCGATGAGTT TGCCGACCTG ATGATGACGG CAGGCAAGAA

2451  AATCGAAGAA CTGATTGCCC GCCTCGCCCA AAAGCCCGC GCGGCAGGCA

2501  TCCATTTGAT TCTTGCCACA CAACGCCCCA GCGTCGATGT CATCACGGGT

2551  CTGATTAAGG CGAACATCCC GACGCGTATC GCGTTCCAAG TGTCCAGCAA

2601  AATCGACAGC CGCACGATTC TCGACCAAAT GGGCGCGGAA AACCTGCTCG

2651  GTCAGGGCGA TATGCTGTTC CTGCTGCCGG GTACTGCCTA TCCGCAGCGC

2701  GTTCACGGCG CGTTTGCCTC GGATGAAGAG GTGCACCGCG TGGTCGAATA

2751  TTTGAAACAG TTTGGCGAAC CGGACTATGT TGACGATATT TTGAGCGGCG

2801  GCGGCAGCGA AGAGCTGCCC GGCATCGGGC GCAGCGGCGA CGACGAAACC

2851  GATCCGATGT ACGACGAGGC CGTATCCGTT GTCCTGAAAA CGCGCAAAGC

2901  CAGCATTTCG GGCGTACAGC GCGCCTTGCG TATCGGCTAC AACCGCGCCG

2951  CGCGTCTGAT TGACCAGATG GAGGCGGAAG GCATTGTGTC CGCACCGGAA

3001  CACAACGGCA ACCGTACGAT TCTCGTCCCC TTGGACAATG CTTGA
```

This corresponds to the amino acid sequence (SEQ ID NO: 490; ORF58-1):

```
   1 MFWIVLIVIL LLALAGLFFV RAQSEREWMR EVSAWQEKKG EKQAELPEIK

51 DGMPDFPELA LMLFHAVKTA VYWLFVGVVR FCRNYLAHES EPDRPVPPAS

101 ANRADVPTAS DGYSDSGNGT EEAETEEAEA AEEEAADTED IATAVIDNRR

151 IPFDRSIAEG LMPSESEISP VRPVFKEITL EEATRALNSA ALRETKKRYI

201 DAFEKNETAV PKVRVSDTPM EGLQIIGLDD PVLQRTYSHM FDADKEAFSE

251 SADYGFEPYF EKQHPSAFSA VKAENARNAP FHRHAGQGKG QAEAKSPDVS

301 QGQSVSDGTA VRDARRRVSV NLKEPNKATV SAEARISRLI PESQTVVGKR

351 DVEMPSETEN VFTETVSSVG YGGPVYDETA DIHIEEPAAP DAWVVEPPEV

401 PKVPMTAIDI QPPPPVSEIY NRTYEPPSGF EQVQRSRIAE TDHLADDVLN

451 GGWQEETAAI ADDGSEGAAE RSSGQYLSET EAFGHDSQAV CPFENVPSER

501 PSCRVSDTEA DEGAFPSEET GAVSEHLPTT DLLLPPLFNP EATQTEEELL

551 ENSITIEEKL AEFKVKVKVV DSYSGPVITR YEIEPDVGVR GNSVLNLEKD

601 LARSLGVASI RVVETIPGKT CMGLELPNPK RQMIRLSEIF NSPEFAESKS

651 KLTLALGQDI TGQPVVTDLG KAPHLLVAGT TGSGKSVGVN AMILSMLFKA

701 APEDVRMIMI DPKMLELSIY EGIPHLLAPV VTDMKLAANA LNWCVNEMEK

751 RYRLMSFMGV RNLAGFNQKI AEAAARGEKI GNPFSLTPDD PEPLEKLPFI

801 VVVVDEFADL MMTAGKKIEE LIARLAQKAR AAGIHLILAT QRPSVDVITG

851 LIKANIPTRI AFQVSSKIDS RTILDQMGAE NLLGQGDMLF LLPGTAYPQR

901 VHGAFASDEE VHRVVEYLKQ FGEPDYVDDI LSGGGSEELP GIGRSGDDET

951 DPMYDEAVSV VLKTRKASIS GVQRALRIGY NRAARLIDQM EAEGIVSAPE

1001 HNGNRTILVP LDNA*
```

Computer analysis of this amino acid sequence predicts the indicated transmembrane region, and also gave the following results:
Homology with a Predicted ORF from *N.meningitidis* (Strain A)
ORF58 (SEQ ID NO: 488) shows 96.6% identity over a 89aa overlap with an ORF (ORF58a) (SEQ ID NO: 492) from strain A of *N. meningitidis*:

```
                    10         20         30         40         50         60
orf58.pep  LRETAYVLDSFDRYFVVALAGLFFVRAQSEREWMREVSAWQEKKGEKQAELPEIKDGMPD
                       :::|||||||||||||||||||||||||||||||||||||||||||
orf58a           MFWIVLIVILLLALAGLFFVRAQSEREWMREVSAWQEKKGEKQAELPEIKDGMPD
                          10        20        30        40        50

70         80         90        100
orf58.pep  FPELALMLFHAVKTAVYWLFVGVVRFCRNYLAHESEPDRPVPP
           ||||||||||||||||||||||||||||||||||||||||||
orf58a     FPELALMLFHAVKTAVYWLFVGVVRFCRNYLAHESEPDRPVPPASANRADVPTASDGYSD
                 60        70        80        90       100       110
```

The complete length ORF58a nucleotide sequence (SEQ ID NO: 491) is:

```
  1 ATGTTTTGGA TAGTTTTGAT CGTTATTTTG TTGCTTGCGC TTGCCGGCTT

51 GTTTTTTGTC CGCGCACAAT CCGAACGCGA GTGGATGCGC GAGGTTTCTG
```

-continued

```
 101 CGTGGCAGGA AAAGAAAGGG GAAAAACAGG CGGAGCTGCC TGAAATCAAA
 151 GACGGTATGC CCGATTTTCC CGAACTTGCC CTGATGCTTT TCCATGCCGT
 201 CAAAACGGCA GTGTATTGGC TGTTTGTCGG TGTCGTCCGT TTCTGCCGAA
 251 ACTATCTGGC GCACGAATCC GAACCGGACA GGCCCGTTCC GCCTGCTTCT
 301 GCAAATCGTG CGGATGTTCC GACCGCATCC GACGGATATT CAGACAGTGG
 351 AAACGGGACG GAAGAAGCGG AAACGGAAGA AGCAGAAGCT GCGGAGGAAG
 401 AGGCTGCCGA TACGGAAGAC ATTGCAACTG CCGTAATCGA CAACCGCCGC
 451 ATCCCATTCG ACCGGAGTAT TGCTGAAGGG TTGATGCCGT CTGAAAGCGA
 501 AATTTCGCCC GTCCGTCCGG TTTTTAAGGA AATCACTTTG GAAGAAGCAA
 551 CGCGTGCTTT AAACAGCGCG GCTTTAAGGG AAACGAAAAA ACGCTATATC
 601 GATGCATTTG AGAAAAACGA AACAGCGGTC CCCAAAGTCC GCGTGTCCGA
 651 TACCCCGATG GAAGGGCTGC AGATTATCGG TTTGGACGAC CCTGTGCTTC
 701 AACGCACGTA TTCCCGTATG TTCGATGCGG ACAAAGAAGC GTTTTCCGAG
 751 TCTGCGGATT ACGGATTTGA GCCGTATTTT GAGAAGCAGC ATCCGTCTGC
 801 CTTTTCTGCA GTCAAAGCCG AAAATGCACG GAATGCGCCG TTCCGCCGTC
 851 ATGCAGGGCA GGGNAAAGGG CAGGCGGAGG CNAAATCCCC GGATGTTTCC
 901 CAAGGGCAGT CCGTTTCAGA CGGCACAGCC GTCCGCGATG CCNGCCGCCG
 951 CGTTTCCGTC AATTTGAAAG AACCGAACAA GGCAACGGTT TCTGCGGAGG
1001 CGCGGATTTC GCGCCTGATT CCGGAAAGTC GGACGGTTGT CGGGAAACGG
1051 GATGTCGAAA TGCCGTCTGA AACCGAAAAT GTTTTCACGG AAANTGTTTC
1101 GTCTGTGGGA TACGGCGNTC CGGTTTATGA TGAAACTGCC GATATCCATA
1151 TTGAAGAACC TGCCGCGCCC GATGCTTGGG TGGTCGGACC ACCCGAAGTG
1201 CCGAAAGTTC CCATGCCCGC AATNGATATT CCGCCGCCGC CTCCCGTATC
1251 GGAAATCTAC AACCGTACCT ATGAACCGCC GGCAGGATTC GAGCAGGTGC
1301 AACGCAGCCG CATTGCCGAA ACCGATCATC TTGCCGATGA TGTTTTGAAT
1351 GGAGGTTGGC AGGAGGAAAC CGCCGCTATT GCGAATGACG GCAGTGAGGG
1401 TGTGGCAGAG CGGTCAAGCG GCAATATTT GTCGGAAACC GAAGCGTTCG
1451 GGCATGACAG TCAGGCGGTT TGTCCGTTTG AAAATGTGCC GTCTGAACGC
1501 CCGTCCCGCC GGGCATNGGA TACGGAAGCG GATGAAGGGG CGTTCCAATC
1551 TGAAGAAACC GGTGCGGTAT CCGAACACCT GCCGACAACC GACCTGCTTC
1601 TGCCGCCGCT GTTCAATCCC GGGGCGACGC AAACCGAAGA AGANCTGTTG
1651 GANAACAGCA TCACCATCGA AGAAAAATNG GCGGAGTTCA AAGTCAAGGT
1701 CAAGGTTGTC GATTCTTATT CCGGCCCCGT GATTACGCGT TATGAAATCG
1751 AACCCGATGT CGGCGTGCGC GGCAATTCCG TTCTAAATCT GGAAAAAGAN
1801 TTGGCGCGTT CGCTCGGCGT GGCTTCCATC CGCGTTGTCG AAACCATCCT
1851 CGGCAAAACC TGTATGGGTT TGGAACTTCC GAACCCGAAA CGCCAAATGA
1901 TACGCCTGAG CGAAATCTTC AATTCGCCCG AGTTTGCCGA ATCCAAATCC
1951 AAGCTGACGC TCGCGCTCGG TCAGGACATC ACCGGACAGC CCGTCGTAAC
2001 CGACTTGGGC AAAGCACCGC ATTTGTTGGT TGCCGGCACG ACCGGTTCGG
2051 GCAAATCGGT GGGTGTCAAC GCGATGATTC TGTCTATGCT TTTCAAAGCC
```

```
                                           -continued
2101 GCGCCGGAAG ACGTGCGTAT GATTATGATC GATCCGAAAA TGCTGGAATT

2151 GAGCATTTAC GAAGGCATCC CGCACCTGCT CGCCCCTGTC GTTACCGATA

2201 TGAAGCTGGC GGCAAACGCG CTGAACTGGT GTGTTAACGA AATGGAAAAA

2251 CGCTACCGCC TGATGAGCTT TATGGGCGTG CGCAATCTTG CGGGTNTCAA

2301 TCAAAAAATC GCCGAAGCCG CAGCAAGGGG GGAGAAAATC GGCAACCCGT

2351 TCAGCCTCAC GCCCGACAAT CCCGAACCTT TGGANAAATT GCCGTTTATC

2401 GTGGTCGTGG TTGATGAGTT TGCCGACCTG ATGATGACGG CAGGCAAGAA

2451 AATCGAAGAA CTGATTGCCC GCCTCGCCCA AAAAGCCCGC GCGGCAGGCA

2501 TCCATCTTAT CCTTGCCACA CAACGCCCCA GTGTCGATGT CATCACGGGT

2551 CTGATTAAGG CGAACATCCC GACGCGTATC GCGTTCCAAG TGTCCAGCAA

2601 AATCGACAGC CGCACGATTC TTGACCAAAT GGGTGCGGAA AACCTGCTCG

2651 GGCAGGGCGA TATGCTGTTC CTGCCGCCGG GTACGGCCTA TCCGCAGCGC

2701 GTTCACGGCG CGTTTGCCTC GGATGAAGAG GTGCACCGCG TGGTCGAATA

2751 TCTGAAACAG TTTGGCGAAC CGGACTATGT TGACGATATN TTGAGCGGCG

2801 GTATGTCCGA CGATTTGCTG GGAATCAGCC GGAGCGGCGA CGGCGAAACC

2851 GATCCGATGT ACGACGAGGC CGTGTCNGTT GTTTTGAAAA CGCGCAAAGC

2901 CAGCATTTCT GGCGTGCAGC GCGCATTGCG TATCGGCTAT AATCGCGCCG

2951 CGCGTCTGAT TGACCAGATG GAGGCGGAAG GCATTGTGTC CGCACCGGAA

3001 CACAACGGCA ACCGTACGAT TCTCGTCCCC TTNGACAATG CTTGA
```

This encodes a protein having amino acid sequence (SEQ ID NO: 492):

```
  1 MFWIVLIVIL LLALAGLFFV RAQSEREWMR EVSAWQEKKG EKQAELPEIK

51 DGMPDFPELA LMLFHAVKTA VYWLFVGVVR FCRNYLAHES EPDRPVPPAS

101 ANRADVPTAS DGYSDSGNGT EEAETEEAEA AEEEAADTED IATAVIDNRR

151 IPFDRSIAEG LMPSESEISP VRPVFKEITL EEATRALNSA ALRETKKRYI

201 DAFEKNETAV PKVRVSDTPM EGLQIIGLDD PVLQRTYSRM FDADKEAFSE

251 SADYGFEPYF EKQHPSAFSA VKAENARNAP FRRHAGQGKG QAEAKSPDVS

301 QGQSVSDGTA VRDAXRRVSV NLKEPNKATV SAEARISRLI PESRTVVGKR

351 DVEMPSETEN VFTEXVSSVG YGXPVYDETA DIHIEEPAAP wDAWVVEPPEV

401 PKVPMPAXDI PPPPPVSEIY NRTYEPPAGF EQVQRSRIAE TDHLADDVLN

451 GGWQEETAAI ANDGSEGVAE RSSGQYLSET EAFGHDSQAV CPFENVPSER

501 PSRRAXDTEA DEGAFQSEET GAVSEHLPTT DLLLPPLFNP GATQTEEXLL

551 XNSITIEEKX AEFKVKVKVV DSYSGPVITR YEIEPDVGVR GNSVLNLEKX

601 LARSLGVASI RVVETILGKT CMGLELPNPK RQMIRLSEIF NSPEFAESKS

651 KLTLALGQDI TGQPVVTDLG KAPHLLVAGT TGSGKSVGVN AMILSMLFKA

701 APEDVRMIMI DPKMLELSIY EGIPHLLAPV VTDMKLAANA LNWCVNEMEK

751 RYRLMSFMGV RNLAGXNQKI AEAAARGEKI GNPFSLTPDN PEPLXKLPFI

801 VVVVDEFADL MMTAGKKIEE LIARLAQKAR AAGIHLILAT QRPSVDVITG

851 LIKANIPTRI AFQVSSKIDS RTILDQMGAE NLLGQGDMLF LPPGTAYPQR
```

```
 901 VHGAFASDEE VHRVVEYLKQ FGEPDYVDDX LSGGMSDDLL GISRSGDGET

951 DPMYDEAVSV VLKTRKASIS GVQRALRIGY NRAARLIDQM EAEGIVSAPE

1001 HNGNRTILVP XDNA*
```

ORF58a (SEQ ID NO: 492) and ORF58-1 (SEQ ID NO: 490) show 96.6% identity in 1014 aa overlap:

```
                    10         20         30         40         50         60
orf58a.pep  MFWIVLIVILLLALAGLFFVRAQSEREWMREVSAWQEKKGEKQAELPEIKDGMPDFPELA
            ||||||||||||||||||||||||||||||||||||||||||||||||||||||||||||
orf58-1     MFWIVLIVILLLALAGLFFVRAQSEREWMREVSAWQEKKGEKQAELPEIKDGMPDFPELA
                    10         20         30         40         50         60

70         80         90        100        110        120
orf58a.pep  LMLFHAVKTAVYWLFVGVVRFCRNYLAHESEPDRPVPPASANRADVPTASDGYSDSGNGT
            ||||||||||||||||||||||||||||||||||||||||||||||||||||||||||||
orf58-1     LMLFHAVKTAVYWLFVGVVRFCRNYLAHESEPDRPVPPASANRADVPTASDGYSDSGNGT
                    70         80         90        100        110        120

130        140        150        160        170        180
orf58a.pep  EEAETEEAEAAEEEAADTEDIATAVIDNRRIPFDRSIAEGLMPSESEISPVRPVFKEITL
            ||||||||||||||||||||||||||||||||||||||||||||||||||||||||||||
orf58-1     EEAETEEAEAAEEEAADTEDIATAVIDNRRIPFDRSIAEGLMPSESEISPVRPVFKEITL
                   130        140        150        160        170        180

190        200        210        220        230        240
orf58a.pep  EEATRALNSAALRETKKRYIDAFEKNETAVPKVRVSDTPMEGLQIIGLDDPVLQRTYSRM
            |||||||||||||||||||||||||||||||||||||||||||||||||||||||||:|
orf58-1     EEATRALNSAALRETKKRYIDAFEKNETAVPKVRVSDTPMEGLQIIGLDDPVLQRTYSHM
                   190        200        210        220        230        240

250        260        270        280        290        300
orf58a.pep  FDADKEAFSESADYGFEPYFEKQHPSAFSAVKAENARNAPFRRHAGQGKGQAEAKSPDVS
            |||||||||||||||||||||||||||||||||||||||||:||||||||||||||||||
orf58-1     FDADKEAFSESADYGFEPYFEKQHPSAFSAVKAENARNAPFHRHAGQGKGQAEAKSPDVS
                   250        260        270        280        290        300

310        320        330        340        350        360
orf58a.pep  QGQSVSDGTAVRDAXRRVSVNLKEPNKATVSAEARISRLIPESRTVVGKRDVEMPSETEN
            |||||||||||||| |||||||||||||||||||||||||||:|||||||||||||||||
orf58-1     QGQSVSDGTAVRDARRRVSVNLKEPNKATVSAEARISRLIPESQTVVGKRDVEMPSETEN
                   310        320        330        340        350        360

370        380        390        400        410        420
orf58a.pep  VFTEXVSSVGYGXPVYDETADIHIEEPAAPDAWVVEPPEVPKVPMPAXDIPPPPPVSEIY
            ||||:|||||||| ||||||||||||||||||||||||||||||||| || |||||||||
orf58-1     VFTETVSSVGYGGPVYDETADIHIEEPAAPDAWVVEPPEVPKVPMTAIDIQPPPPVSEIY
                   370        380        390        400        410        420

430        440        450        460        470        480
orf58a.pep  NRTYEPPAGFEQVQRSRIAETDHLADDVLNGGWQEETAAIANDGSEGVAERSSGQYLSET
            ||||||:|||||||||||||||||||||||||||||||||:||||:||||||||||||||
orf58-1     NRTYEPPSGFEQVQRSRIAETDHLADDVLNGGWQEETAAIADDGSEGAAERSSGQYLSET
                   430        440        450        460        470        480

490        500        510        520        530        540
orf58a.pep  EAFGHDSQAVCPFENVPSERPSRRAXDTEADEGAFQSEETGAVSEHLPTTDLLLPPLFNP
            |||||||||||||||||||||||| |: ||||||||| ||||||||||||||||||||||
orf58-1     EAFGHDSQAVCPFENVPSERPSCRVSDTEADEGAFPSEETGAVSEHLPTTDLLLPPLFNP
                   490        500        510        520        530        540

550        560        570        580        590        600
orf58a.pep  GATQTEEXLLXNSITIEEKXAEFKVKVKVVDSYSGPVITRYEIEPDVGVRGNSVLNLEKX
            |||||| || |||||||||:|||||||||||||||||||||||||||||||||||||||
orf58-1     EATQTEEELLENSITIEEKLAEFKVKVKVVDSYSGPVITRYEIEPDVGVRGNSVLNLEKD
                   550        560        570        580        590        600

610        620        630        640        650        660
orf58a.pep  LARSLGVASIRVVETILGKTCMGLELPNPKRQMIRLSEIFNSPEFAESKSKLTLALGQDI
            ||||||||||||||||| ||||||||||||||||||||||||||||||||||||||||||
orf58-1     LARSLGVASIRVVETIPGKTCMGLELPNPKRQMIRLSEIFNSPEFAESKSKLTLALGQDI
                   610        620        630        640        650        660
```

-continued

```
                  670        680        690        700        710        720
orf58a.pep  TGQPVVTDLGKAPHLLVAGTTGSGKSVGVNAMILSMLFKAAPEDVRMIMIDPKMLELSIY
            ||||||||||||||||||||||||||||||||||||||||||||||||||||||||||||
orf58-1     TGQPVVTDLGKAPHLLVAGTTGSGKSVGVNAMILSMLFKAAPEDVRMIMIDPKNLELSIY
                  670        680        690        700        710        720

730        740        750        760        770        780
orf58a.pep  EGIPHLLAPVVTDMKLAANALNWCVNEMEKRYRLMSFMGVRNLAGXNQKIAEAAARGEKI
            ||||||||||||||||||||||||||||||||||||||||||||| ||||||||||||||
orf58-1     EGIPHLLAPVVTDMKLAANALNWCVNEMEKRYRLMSFMGVRNLAGFNQKIAEAAARGEKI
                  730        740        750        760        770        780

790        800        810        820        830        840
orf58a.pep  GNPFSLTPDNPEPLXKLPFIVVVVDEFADLMMTAGKKIEELIARLAQKARAAGIHLILAT
            |||||||||:|||| |||||||||||||||||||||||||||||||||||||||||||||
orf58-1     GNPFSLTPDDPEPLEKLPFIVVVVDEFADLMMTAGKKIEELIARLAQKARAAGIHLILAT
                  790        800        810        820        830        840

850        860        870        880        890        900
orf58a.pep  QRPSVDVITGLIKANIPTRIAFQVSSKIDSRTILDQMGAENLLGQGDMLFLPPGTAYPQR
            |||||||||||||||||||||||||||||||||||||||||||||| |||||||||||||
orf58-1     QRPSVDVITGLIKANIPTRIAFQVSSKIDSRTILDQMGAENLLGQGDMLFLLPGTAYPQR
                  850        860        870        880        890        900

910        920        930        940        950        960
orf58a.pep  VHGAFASDEEVHRVVEYLKQFGEPDYVDDXLSGGMSDDLLGISRSGDGETDPMYDEAVSV
            ||||||||||||||||||||||||||||    |::| ||:|||| |||||||||||||||
orf58-1     VHGAFASDEEVHRVVEYLKQFGEPDYVDDILSGGGSEELPGIGRSGDDETDPMYDEAVSV
                  910        920        930        940        950        960

970        980        990        1000       1010
orf58a.pep  VLKTRKASISGVQRALRIGYNRAARLIDQMEAEGIVSAPEHNGNRTILVPXDNAX
            ||||||||||||||||||||||||||||||||||||||||||||||||||| ||||
orf58-1     VLKTRKASISGVQRALRIGYNRAARLIDQMEAEGIVSAPEHNGNRTILVPLDNAX
                  970        980        990        1000       1010
```

Homology with a Predicted ORF from *N.gonorrhoeae*

ORF58 (SEQ ID NO: 488) shows complete identity over a 9aa overlap with a predicted ORF (ORF58ng) (SEQ ID NO: 494) from *N. gonorrhoeae*:

```
orf58.pep  ALMLFHAVKTAVYWLFVGVVRFCRNYLAHESEPDRPVPP                        103
                                          |||||||||
orf58ng                                   SEPDRPVPPASANRADVPTASDGYSDSGNG  30
```

The ORF58ng nucleotide sequence (SEQ ID NO: 493) is predicted to encode a protein having partial amino acid sequence (SEQ ID NO: 494):

```
  1  ..SEPDRPVPPA SANRADVPTA SDGYSDSGNG TEEAETEAAE AAEEEAADTE

51    DIATAVIDNR RIPFDRSIAE GLMQSESKTS PVRPVFKEIT LEEATRALSS

101    AALRETKKRY IDAFEKNGTA VPKVRVSDTP MEGLQIIGLD DPVLQRTYSR

151    MFDADKEAFS ESADYGFEPY FEKQHPSAFS AVKAENARNA PFRRHAGQEK

201    GQAEAKSPDV SQGQSVSDGT AVRDARRRVS VNLKEPNKAT VSAEARISRL

251    IPESRTVVGK RDVEMPSETE NVFTETVSSV GYGGPVYDEA ADIHIEEPAA

301    PDAWVVEPPE VPEVAVPEID ILPPPPVSEI YNRTYEPPAG FEQAQRSRIA

351    ETDHLAADVL NGGWQEETAA IADDGSEGAA ERSSGQYLSE TEAFGHDSQA

401    VCPFEDVPSE RPSCRVSDTE ADEGAFQSEE TGAVSEHLPT TDLLLPPLFN

451    PEATQTEEEL LENSITIEEK LAEFKVKVKV VDSYSGPVIT RYEIEPDVGV

501    RGNSVLNLEK DLARSLGVAS IRVVETIPGK TCMGLELPNP KRQMIRLSEI

551    FNSPEFAESK SKLTLALGQD ITGQPVVTDL GKAPHLLVAG TTGSGKSVGV
```

```
                                        -continued
601    NAMILSMLFK AAPEDVRMIM IDPKMLELSI YEGITHLLAP VVTDMKLAAN

651    ALNWCVNEME KRYRLMSFMG VRNLAGFNQK IAEAAARGEK IGNPFSLTPD

701    DPEPLEKLPF IVVVVDEFAD LMMTAGKKIE ELIARLAQKA RAAGIHLILA

751    TQRPSVDVIT GLIKANIPTR IAFQVSSKID SRTILDQMGA ENLLGQGDML

801    FLPPGTAYPQ RVHGAFASDE EVHRVVEYLK QFGEPDYVDD ILSGGGSEEL

851    PGIGRSGDGE TDPMYDEAVS VVLKTRKASI SGVQRALRIG YNRAARLIDQ

901    MEAEGIVSAP EHNGNRTILV PLDNA*
```

This partial gonococcal sequence contains a predicted transmembrane region and a predicted ATP/GTP-binding site motif A (P-loop; double underlined). Furthermore, it has a domain homologous to the FTSK cell division protein of E. coli. Alignment of ORF58ng (SEQ ID NO: 494) and FtsK (accession number p46889) (SEQ ID NO: 1142) show a 65% amino acid identity in 459 overlap:

```
ORF58ng:    467 IEEKLAEFKVKVKVVDSYSGPVITRYEIEPDVGVRGNSVLNLEKDLARSLGVASIRVVET    526
                +E+ LA+F++K  VV+   GPVITR+E+     GV+   + NL +DLARSL   ++RVVE
FtsK:       868 VEARLADFRIKADVVNYSPGPVITRFELNLAPGVKAARISNLSRDLARSLSTVAVRVVEV    927

ORF58ng:    527 IPGKTCMGLELPNPKRQMIRLSEIFNSPEFAESKSKLTLALGQDITGQPVVTDLGKAPHL    586
                IPGK   +GLELPN KRQ + L E+ ++ +F ++ S LT+ LG+DI G+PVV DL K PHL
FtsK:       928 IPGKPYVGLELPNKKRQTVYLREVLDNAKFRDNPSPLTVVLGKDIAGEPVVADLAKMPHL    987

ORF58ng:    587 LVAGTTGSGKSVGVNAMILSMLFKAAPEDVRMIMIDPKMLELSIYEGITHLLAPVVTDMK    646
                LVAGTTGSGKSVGVNAMILSML+KA PEDVR IMIDPKMLELS+YEGI HLL  VVTDMK
FtsK:       988 LVAGTTGSGKSVGVNAMILSMLYKAQPEDVRFIMIDPKMLELSVYEGIPHLLTEVVTDMK   1047

ORF58ng:    647 LAANALNWCVNEMEKRYRLMSFMGVRNLAGFNQKIAEAAARGEKIGNPFSLTPDDPEP--    704
                 AANAL WCVNEME+RY+LMS +GVRNLAG+N+KIAEA       I +P+    D   +
FtsK:      1048 DAANALRWCVNEMERRYKLMSALGVRNLAGYNEKIAEADRMMRPIPDPYWKPGDSMDAQH   1107

ORF58ng:    705 --LEKLPFIVVVVDEFADLMMTAGKKIEELIARLAQKARAAGIHLILATQRPSVDVITGL    762
                  L+K P+IVV+VDEFADLMMT GKK+EELIARLAQKARAAGIHL+LATQRPSVDVITGL
FtsK       1108 PVLKKEPYIVVLVDEFADLMMTVGKKVEELIARLAQKARAAGIHLVLATQRPSVDVITGL   1167

ORF58ng:    763 IKANIPTRIAFQVSSKIDSRTILDQMGAENLLGQGDMLFLPPGTAYPQRVHGAFASDEEV    822
                IKANIPTRIAF VSSKIDSRTILDQ GAE+LLG GDML+ P + P RVHGAF  D+EV
FtsK:      1168 IKANIPTRIAFTVSSKIDSRTILDQAGAESLLGMGDMLYSGPNSTLPVRVHGAFVRDQEV   1227

ORF58ng:    823 HRVVEYLKQFGEPDYVDDILSGGGSEELPGIGRSGDGETDPMYDEAVSVVLKTRKASISG    882
                H VV+   K  G P YVD I S    SE    G G   E DP++D+AV V + RKASISG
FtsK:      1228 HAVVQDWKARGRPQYVDGITSDSESEGGAG-FDGAEELDPLFDQAVQFVTEKRKASISG   1286

ORF58ng:    883 VQRALRIGYNRAARLIDQMEAEGIVSAPEHNGNRTILVP                       921
                VQR   RIGYNRAAR+I+QMEA+GIVS   HNGNR +LP
FtsK:      1287 VQRQFRIGYNRAARIIEQMEAQGIVSEQGHNGNREVLAP                      1325
```

Further work on ORF58ng revealed the complete gonococcal DNA sequence to be (SEQ ID NO: 495):

```
  1 ATGTTTTGGA TAGTTTTGAT CGTTATtgtg TTGCTTGCGC TTGCCGGCCT

51 GTTTTTTGTC CGCGCACAAT CCGAACGCGA GTGGATGCGC GAGGTTTCTG

101 CGTGGCAGGA AAAGAAAGGG GAAAAACAGG CGGAGCTGCC TGAAATCAAA

151 GACGGTATGC CGATTTTCC CGAGTTTTCC CTGATGCTTT TCCATGCCGT

201 CAAAACGGCA GTGTATTGGC TGTTTGTCGG TGTCGTCCGT TTCTGCCGAA

251 ACTATCTGGC GCACGAATCC GAACCGGACA GGCCCGTTCC GCCTGCTTCT

301 GCAAACCGTG CGGATGTTCC GACCGCATCC GACGGGTATT CAGACAGTGG
```

-continued

```
 351 AAACGGGACG GAAGAAGCGG AAACGGAAGC AGCAGAAGCT GCGGAGGAAG

401 AGGCTGCCgA TACgGAAGAC ATTGCAACTG CCGTAATCGA CAACCGCCGC

451 ATCCcatTCG ACCGGAGTAT TGCTGAAGGG TTGATGCAGT CTGAAAGCAA

501 AACTTCGCCC GTCCGTCCGG TTTTTAAGGA AATCACTTTG GAAGAAGCAA

551 CGCGTGCTTT AAGCAGCGCG GCTTTAAGGG AAACGAAAAA ACGCTATATC

601 GATGCATTTG AGAAAAACGG AACAGCCGTC CCCAAAGTAC GCGTGTCCGA

651 TACCCCGATG GAAGGGCTGC AGATTATCGG TTTGGACGAC CCTGTGCTTC

701 AACGCACGTA TTCCCGTATG TTTGATGCGG ACAAAGAAGC GTTTTCCGAG

751 TCTGCGGATT ACGGATTTGA GCCGTATTTT GAGAAGCAGC ATCCGTCTGC

801 CTTTTCTGCA GTCAAAGCCG AAAATGCACG GAATGCGCCG TTCCGCCGTC

851 ATGCAGGGCA GGAGAAAGGG CAGGCGGAGG CAAAATCCCC GGATGTTTCC

901 CAAGGGCAGT CCGTTTCAGA CGGCACAGCC GTCCGCGATG CCCGCCGCCG

951 CGTTTCCGTC AATTTGAAAG AACCGAACAA GGCAACGGTT TCTGCGGAGG

1001 CGCGGATTTC GCGCCTGATT CCGGAAAGTC GGACGGTTGT CGGGAAACGG

1051 GATGTCGAAA TGCCGTCTGA AACCGAAAAT GTTTTCACGG AAACCGTTTC

1101 GTCTGTGGGA TACGGCGGTC CGCTTTATGA TGAAGCTGCC GATATCCATA

1151 TTGAAGAGCC TGCCGCGCCC GATGCTTGGG TGGTCGAACC ACCCGAAGTG

1201 CCGGAGGTAG CCGTACCCGA AATCGATATT CTGCCGCCGC CTCCCGTATC

1251 GGAAATCTAC AACCGTACCT ATGAGCCGCC GGCAGGATTC GAGCAGGCGC

1301 AACGCAGCCG CATTGCCGAA ACCGACCATC TTGCCGCTGA TGTTTTGAAT

1351 GGAGGTTGGC AGGAGGAAAC CGCCGCTATT GCAGATGACG GCAGTGAGGG

1401 TGCGGCAGAG CGGTCAAGCG GGCAATATCT GTCGAAAACC GAAGCGTTCG

1451 GGCATGACAG TCAGGCGGTT TGTCCGTTTG AAGATGTGCC GTCTGAACGC

1501 CCGTCCTGCC GGGTATCGGA TACGGAAGCG GATGAAGGGG CGTTCCAATC

1551 GGAAGAGACC GGTGCGGTAT CCGAACACCT GCCGACAACC GACCTGCTTC

1601 TGCCTCCGCT GTTCAATCCC GAGGCGACGC AAACCGAAGA AGAACTGTTG

1651 GAAAACAGCA TCACCATCGA AGAAAAATTG GCGGAGTTCA AAGTCAAGGT

1701 CAAGGTTGTC GATTCTTATT CCGGCCCCGT GATTACGCGT TATGAAATCG

1751 AACCCGATGT CGGCGTGCGC GGCAATTCCG TTCTGAATTT GGAAAAAGAC

1801 TTGGCGCGTT CGCTCGGCGT GGCTTCCATC CGCGTTGTCG AAACCATCCC

1851 CGGCAAAACC TGCATGGGTT TGGAACTTCC GAACCCGAAA CGCCAAATGA

1901 TACGCCTGAG CGAAATTTTC AATTCGCCCG AGTTTGCCGA ATCCAAATCC

1951 AAGCTGACGC TCGCGCTCGG TCAGGACATT ACCGGACAGC CCGTCGTAAC

2001 CGACTTGGGC AAAGCACCGC ATTTGCTGGT TGCCGGCACG ACCGGTTCGG

2051 GCAAATCGGT GGGTGTCAAC GCGATGATTC TGTCTATGCT TTTCAAAGCC

2101 GCGCCGGAAG ACGTGCGTAT GATTATGATC GATCCGAAAA TGCTGGAATT

2151 GAGCATTTAC GAAGGCATCA CGCACCTGCT CGCCCCTGTC GTTACCGATA

2201 TGAAGCTGGC GGCAAACGCG CTGAACTGGT GTGTTAACGA AATGGAAAAA

2251 CGCTACCGCC TGATGAGCTT TATGGGCGTG CGCAATCTTG CGGGCTTCAA

2301 CCAAAAAATC GCCGAAGCCG CAGCAAGGGG AGAAAAAATC GGCAATCCGT
```

-continued

```
2351 TCAGCCTCAC GCCCGACGAT CCCGAACCTT TGGAAAAACT GCCGTTTATC

2401 GTGGTCGTGG TCGATGAGTT TGCCGATTTG ATGATGACGG CAGGCAAGAA

2451 AATCGAAGAA CTGATTGCGC GCCTCGCCCA AAAAGCCCGC GCGGCAGGCA

2501 TCCACCTTAT CCTTGCCACA CAACGCCCCA GCGTCGATGT CATCACGGGT

2551 CTGATTAAGG CGAACATCCC GACGCGTATC GCGTTCCAAG TGTCCAGCAA

2601 AATCGACAGC CGCACGATTC TCGACCAAAT GGGCGCGGAA AACCTGCTCG

2651 GTCAGGGCGA TATGCTGTTC CTGCCGCCGG GTACTGCCTA TCCGCAGCGC

2701 GTTCACGGCG CGTTTGCCTC GGATGAAGAG GTGCACCGCG TGGTCGAATA

2751 TCTGAAGCAG TTTGGCGAGC CGGACTATGT TGACGATATT TTGAGCGGCG

2801 GCGGCAGCGA AGAGCTGCCC GGCATCGGGC GCAGCGGCGA CGGCGAAACC

2851 GATCCGATGT ACGACGAGGC CGTATCCGTT GTCCTGAAAA CGCGCAAAGC

2901 CAGCATTTCG GGCGTACAGC GCGCCTTGCG CATCGGCTAC AACCGCGCCG

2951 CGCGTCTGAT TGACCAAATG GAAGCGGAAG GCATTGTGTC CGCACCGGAA

3001 CACAACGGCA ACCGTACGAT TCTCGTCCCC TTGGACAATG CTTGA
```

This corresponds to the amino acid sequence (SEQ ID NO: 496; ORF58ng-1):

```
   1 MFWIVLIVIV LLALAGLFFV RAQSEREWMR EVSAWQEKKG EKQAELPEIK

51 DGMPDFPEFS LMLFHAVKTA VYWLFVGVVR FCRNYLAHES EPDRPVPPAS

101 ANRADVPTAS DGYSDSGNGT EEAETEAAEA AEEEAADTED IATAVIDNRR

151 IPFDRSIAEG LMQSESKTSP VRPVFKEITL EEATRALSSA ALRETKKRYI

201 DAFEKNGTAV PKVRVSDTPM EGLQIIGLDD PVLQRTYSRM FDADKEAFSE

251 SADYGFEPYF EKQHPSAFSA VKAENARNAP FRRHAGQEKG QAEAKSPDVS

301 QGQSVSDGTA VRDARRRVSV NLKEPNKATV SAEARISRLI PESRTVVGKR

351 DVEMPSETEN VFTETVSSVG YGGPVYDEAA DIHIEEPAAP DAWVVEPPEV

401 PEVAVPEIDI LPPPPVSEIY NRTYEPPAGF EQAQRSRIAE TDHLAADVLN

451 GGWQEETAAI ADDGSEGAAE RSSGQYLSET EAFGHDSQAV CPFEDVPSER

501 PSCRVSDTEA DEGAFQSEET GAVSEHLPTT DLLLPPLFNP EATQTEEELL

551 ENSITIEEKL AEFKVKVKVV DSYSGPVITR YEIEPDVGVR GNSVLNLEKD

601 LARSLGVASI RVVETIPGKT CMGLELPNPK RQMIRLSEIF NSPEFAESKS

651 KLTLALGQDI TGQPVTTDLG KAPHLLVAGT TGSGKSVGVN AMILSMLFKA

701 APEDVRMIMI DPKMLELSIY EGITHLLAPV VTDMKLAANA LNWCVNEMEK

751 RYRLMSFMGV RNLAGFNQKI AEAAARGEKI GNPFSLTPDD PEPLEKLPFI

801 VVVVDEFADL MMTAGKKIEE LIARLAQKAR AAGIHLILAT QRPSVDVITG

851 LIKANIPTRI AFQVSSKIDS RTILDQMGAE NLLGQGDMLF LPPGTAYPQR

901 VHGAFASDEE VHRVVEYLKQ FGEPDYVDDI LSGGGSEELP GIGRSGDGET

951 DPMYDEAVSV VLKTRKASIS GVQRALRIGY NRAARLIDQM EAEGIVSAPE

1001 HNGNRTILVP LDNA*
```

ORF58ng-1 (SEQ ID NO: 496) and ORF58-1 (SEQ ID NO: 490) show 97.2% identity in 1014 aa overlap:

```
                    10        20        30        40        50        60
orf58-1.pep MFWIVLIVILLLALAGLFFVRAQSEREWMREVSAWQEKKGEKQAELPEIKDGMPDFPELA
            ||||||||:||||||||||||||||||||||||||||||||||||||||||||||||::
orf58ng-1   MFWIVLIVIVLLALAGLFFVRAQSEREWMREVSAWQEKKGEKQAELPEIKDGMPDFPEFS
                    10        20        30        40        50        60

70        80        90       100       110       120
orf58-1.pep LMLFHAVKTAVYWLFVGVVRFCRNYLAHESEPDRPVPPASANRADVPTASDGYSDSGNGT
            ||||||||||||||||||||||||||||||||||||||||||||||||||||||||||||
orf58ng-1   LMLFHAVKTAVYWLFVGVVRFCRNYLAHESEPDRPVPPASANRADVPTASDGYSDSGNGT
                    70        80        90       100       110       120

130       140       150       160       170       180
orf58-1.pep EEAETEEAEAAEEEAADTEDIATAVIDNRRIPFDRSIAEGLMPSESEISPVRPVFKEITL
            ||||||  ||||||||||||||||||||||||||||||||||||||| |||:||||||||||||||||
orf58ng-1   EEAETEAAEAAEEEAADTEDIATAVIDNRRIPFDRSIAEGLMQSESKTSPVRPVFKEITL
                   130       140       150       160       170       180

190       200       210       220       230       240
orf58-1.pep EEATRALNSAALRETKKRYIDAFEKNETAVPKVRVSDTPMEGLQIIGLDDPVLQRTYSHM
            ||||||:|||||||||||||||||||| ||||||||||||||||||||||||||||||:|
orf58ng-1   EEATRALSSAALRETKKRYIDAFEKNGTAVPKVRVSDTPMEGLQIIGLDDPVLQRTYSRM
                   190       200       210       220       230       240

250       260       270       280       290       300
orf58-1.pep FDADKEAFSESADYGFEPYFEKQHPSAFSAVKAENARNAPFHRHAGQGKGQAEAKSPDVS
            ||||||||||||||||||||||||||||||||||||||||||:||||| |||||||||||
orf58ng-1   FDADKEAFSESADYGFEPYFEKQHPSAFSAVKAENARNAPFRRHAGQEKGQAEAKSPDVS
                   250       260       270       280       290       300

310       320       330       340       350       360
orf58-1.pep QGQSVSDGTAVRDARRRVSVNLKEPNKATVSAEARISRLIPESQTVVGKRDVEMPSETEN
            ||||||||||||||||||||||||||||||||||||||||||||:|||||||||||||||
orf58ng-1   QGQSVSDGTAVRDARRRVSVNLKEPNKATVSAEARISRLIPESRTVVGKRDVEMPSETEN
                   310       320       330       340       350       360

370       380       390       400       410       420
orf58-1.pep VFTETVSSVGYGGPVYDETADIHIEEPAAPDAWVVEPPEVPKVPMTAIDIQPPPPVSEIY
            ||||||||||||||||||:|||||||||||||||||||||||:|  : ||| ||||||||
orf58ng-1   VFTETVSSVGYGGPVYDEAADIHIEEPAAPDAWVVEPPEVPEVAVPEIDILPPPPVSEIY
                   370       380       390       400       410       420

430       440       450       460       470       480
orf58-1.pep NRTYEPPSGFEQVQRSRIAETDHLADDVLNGGWQEETAAIADDGSEGAAERSSGQYLSET
            ||||||:||||:||||||||||||||||||||||||||||||||||||||||||||||||
orf58ng-1   NRTYEPPAGFEQAQRSRIAETDHLAADVLNGGWQEETAAIADDGSEGAAERSSGQYLSET
                   430       440       450       460       470       480

490       500       510       520       530       540
orf58-1.pep EAFGHDSQAVCPFENVPSERPSCRVSDTEADEGAFPSEETGAVSEHLPTTDLLLPPLFNP
            |||||||||||||:||||||||||||||||||||| ||||||||||||||||||||||||
orf58ng-1   EAFGHDSQAVCPFEDVPSERPSCRVSDTEADEGAFQSEETGAVSEHLPTTDLLLPPLFNP
                   490       500       510       520       530       540

550       560       570       580       590       600
orf58-1.pep EATQTEEELLENSITIEEKLAEFKVKVKVVDSYSGPVITRYEIEPDVGVRGNSVLNLEKD
            ||||||||||||||||||||||||||||||||||||||||||||||||||||||||||||
orf58ng-1   EATQTEEELLENSITIEEKLAEFKVKVKVVDSYSGPVITRYEIEPDVGVRGNSVLNLEKD
                   550       560       570       580       590       600

610       620       630       640       650       660
orf58-1.pep LARSLGVASIRVVETIPGKTCMGLELPNPKRQMIRLSEIFNSPEFAESKSKLTLALGQDI
            ||||||||||||||||||||||||||||||||||||||||||||||||||||||||||||
orf58ng-1   LARSLGVASIRVVETIPGKTCMGLELPNPKRQMIRLSEIFNSPEFAESKSKLTLALGQDI
                   610       620       630       640       650       660

670       680       690       700       710       720
orf58-1.pep TGQPVVTDLGKAPHLLVAGTTGSGKSVGVNAMILSMLFKAAPEDVRMIMIDPKMLELSIY
            ||||||||||||||||||||||||||||||||||||||||||||||||||||||||||||
orf58ng-1   TGQPVVTDLGKAPHLLVAGTTGSGKSVGVNAMILSMLFKAAPEDVRMIMIDPKMLELSIY
                   670       680       690       700       710       720

730       740       750       760       770       780
orf58-1.pep EGIPHLLAPVVTDMKLAANALNWCVNEMEKRYRLMSFMGVRNLAGFNQKIAEAAARGEKI
            |||  |||||||||||||||||||||||||||||||||||||||||||||||||||||||
orf58ng-1   EGITHLLAPVVTDMKLAANALNWCVNEMEKRYRLMSFMGVRNLAGFNQKIAEAAARGEKI
                   730       740       750       760       770       780
```

```
                790       800       810       820       830       840
orf58-1.pep  GNPFSLTPDDPEPLEKLPFIVVVVDEFADLMMTAGKKIEELIARLAQKARAAGIHLILAT
             ||||||||||||||||||||||||||||||||||||||||||||||||||||||||||||
orf58ng-1    GNPFSLTPDDPEPLEKLPFIVVVVDEFADLMMTAGKKIEELIARLAQKARAAGIHLILAT
                790       800       810       820       830       840

850       860       870       880       890       900
orf58-1.pep  QRPSVDVITGLIKANIPTRIAFQVSSKIDSRTILDQMGAENLLGQGDMLFLLPGTAYPQR
             |||||||||||||||||||||||||||||||||||||||||||||| |||||||||||||
orf58ng-1    QRPSVDVITGLIKANIPTRIAFQVSSKIDSRTILDQMGAENLLGQGDMLFLPPGTAYPQR
                850       860       870       880       890       900

910       920       930       940       950       960
orf58-1.pep  VHGAFASDEEVHRVVEYLKQFGEPDYVDDILSGGGSEELPGIGRSGDDETDPMYDEAVSV
             ||||||||||||||||||||||||||||||||||||||||||||||| ||||||||||||
orf58ng-1    VHGAFASDEEVHRVVEYLKQFGEPDYVDDILSGGGSEELPGIGRSGDGETDPMYDEAVSV
                910       920       930       940       950       960

970       980       990      1000      1010
orf58-1.pep  VLKTRKASISGVQRALRIGYNRAARLIDQMEAEGIVSAPEHNGNRTILVPLDNAX
             ||||||||||||||||||||||||||||||||||||||||||||||||||||||
orf58ng-1    VLKTRKASISGVQRALRIGYNRAARLIDQMEAEGIVSAPEHNGNRTILVPLDNAX
                970       980       990      1000      1010
```

Furthermore, ORF58ng-1 (SEQ ID NO: 496) shows significant homology to the *E.coli* protein FtsK (SEQ ID NO: 1142):

```
sp|P46889|FTSK_ECOLI CELL DIVISION PROTEIN FTSK )gi|1651412|gn1|PID|d1015290 (D1
division protein FtsK [Escherichia coli] )gi|1651418|gn1|PID|d1015296 (D90727) Cell
division protein FtsK [Escherichia coli] )gi|1787117 (AE000191) cell division
protein FtsK [Escherichia coli] Length = 1329
  Score = 576 bits (1469), Expect = e-163
  Identities = 301/459 (65%), Positives = 353/459 (76%), Gaps = 5/459 (1%)

Query:   556  IEEKLAEFKVKVKVVDSYSGPVITRYEIEPDVGVRGNSVLNLEKDLARSLGVASIRVVET    615
              +E +LA+F++K  VV+    GPVITR+E+     GV+   + NL +DLARSL   ++RVVE
Sbjct:   868  VEARLADFRIKADVVNYSPGPVITRFELNLAPGVKAARISNLSRDLARSLSTVAVRVVEV    927

Query:   616  IPGKTCMGLELPNPKRQMIRLSEIFNSPEFAESKSKLTLALGQDITGQPVVTDLGKAPHL    675
              IPGK  +GLELPN KRQ + L E+ ++ +F ++  S LT+ LG+DI G+PVV DL K PHL
Sbjct:   928  IPGKPYVGLELPNKKRQTVYLREVLDNAKFRDNPSPLTVVLGKDIAGEPVVADLAKMPHL    987

Query:   676  LVAGTTGSGKSVGVNAMILSMLFKAAPEDVRMIMIDPKMLELSIYEGITHLLAPVVTDMK    735
              LVAGTTGSGKSVGVNAMILSML+KA PEDVR IMIDPKMLELS+YEGI HLL  VVTDMK
Sbjct:   988  LVAGTTGSGKSVGVNAMILSMLYKAQPEDVRFIMIDPKMLELSVYEGIPHLLTEVVTDMK   1047

Query:   736  LAANALNWCVNEMEKRYRLMSFMGVRNLAGFNQKIAEAAARGEKIGNPFSLTPDDPEP--    793
              AANAL WCVNEME+RY+LMS +GVRNLAG+N+KIAEA      I +P+     D  +
Sbjct:  1048  DAANALRWCVNEMERRYKLMSALGVRNLAGYNEKIAEADRMMRPIPDPYWKPGDSMDAQH   1107

Query:   794  --LEKLPFIVVVVDEFADLMMTAGKKIEELIARLAQKARAAGIHLILATQRPSVDVITGL    851
                L+K P+IVV+VDEFADLMMT GKK+EELIARLAQKARAAGIHL+LATQRPSVDVITGL
Sbjct:  1108  PVLKKEPYIVVLVDEFADLMMTVGKKVEELIARLAQKARAAGIHLVLATQRPSVDVITGL   1167

Query    852  IKANIPTRIAFQVSSKIDSRTILDQMGAENLLGQGDMLFLPPGTAYPQRVHGAFASDEEV    911
              IKANIPTRIAF VSSKIDSRTILDQ GAE+LLG GDML+  P +  P RVHGAF  D+EV
Sbjct:  1168  IKANIPTRIAFTVSSKIDSRTILDQAGAESLLGMGDMLYSGPNSTLPVRVHGAFVRDQEV   1227

Query:   912  HRVVEYLKQFGEPDYVDDILSGGGSEELPGIGRSGDETDPMYDEAVSVVLKTRKASISG     971
              H VV+  K  G P YVD I S     SE   G  G   E DP++D+AV  V  +RKASISG
Sbjct:  1228  HAVVQDWKARGRPQYVDGITSDSESEGGAG-GFDGAEEELDPLFDQAVQFVTEKRKASISG   1286

Query:   972  VQRALRIGYNRAARLIDQMEAEGIVSAPEHNGNRTILVP                      1010
              VQR  RIGYNRAAR+I+QMEA+GIVS    HNGNR +L P
Sbjct:  1287  VQRQFRIGYNRAARIIEQMEAQGIVSEQGHNGNREVLAP                      1325
```

Based on this analysis, it is predicted that the proteins from *N.meningitidis* and *N.gonorrhoeae*, and their epitopes, could be useful antigens for vaccines or diagnostics, or for raising antibodies.

Example 59

The following partial DNA sequence was identified in *N.meningitidis* (SEQ ID NO: 497):

```
   1  ATGATTTATC AAAGAAACCT CATCAAAGAA CTCTCTTTTA CCGCCGTCGG
  51  CATTTTCGTC GTCCTCTTGG CGGTATTGGT CTCCACGCAG GCAATCAACC
 101  TGCTCGGCCG TGCCGCCGAC GGGC..GTGA TCGCCATCGA TGCCGTGTTG
 151  GCATTGGTCG GCTTCTGGGT C......... .......... ..........
                                 //
 901  .........A TTGCCATCGG TTTGTTTTTA ATTTACCAAA ACGGGCTGAC
 951  CCTGCTTTTT GAAGCCGTGG AAGACGGCAA AATCCATTTT TGGCTCGGAC
1001  TGCTGCCTAT GCACATTATC ATGTTTGTCC TTGCACTCAT CCTGTTGCGC
1051  GTCCGCAGTA TGCCCAGCCA GCCCTTCTGG CAGGCGGTTG GCAAAAGTCT
1101  GACATTGAAA GGCGGAAAAT GA
```

This corresponds to the amino acid sequence (SEQ ID NO: 498; ORF101):

```
  1  MIYQRNLIKE LSFTAVGIFV VLLAVLVSTQ AINLLGRAAD GXVIAIDAVL
 51  ALVGFWV... .......... .......... .......... ..........
                              //
301  ...IAIGLFL IYQNGLTLLF EAVEDGKIHF WLGLLPMHII MFVLALILLR
351  VRSMPSQPFW QAVGKSLTLK GGK*
```

Further work revealed the complete nucleotide sequence (SEQ ID NO: 499):

```
  1  ATGATTTATC AAAGAAACCT CATCAAAGAA CTCTCTTTTA CCGCCGTCGG
 51  CATTTTCGTC GTCCTCTTGG CGGTATTGGT CTCCACGCAG GCAATCAACC
101  TGCTCGGCCG TGCCGCCGAC GGGCGTGTCG CCATCGATGC CGTGTTGGCA
151  TTGGTCGGCT TCTGGGTCAT CGGTATGACG CCGCTTTTGC TGGTGTTGAC
201  CGCATTTATC AGTACGTTGA CCGTGTTGAC CCGCTACTGG CGCGACAGCG
251  AAATGTCGGT CTGGCTATCC TGCGGATTGG CATTGAAACA ATGGATACGC
301  CCGGTGATGC AGTTTGCCGT GCCGTTTGCC GTTTTGGTTG CCGTCATGCA
351  GCTTTGGGTG ATACCGTGGG CAGAGCTACG CAGCCGCGAA TACGCTGAAA
401  TCCTGAAGCA GAAGCAGGAA TTGTCTTTGG TGGAGGCAGG CGAGTTCAAC
451  AGTTTGGGCA AGCGCAACGG CAGGGTTTAT TTTGTCGAAA CCTTCGATAC
501  CGAATCCGGC ATCATGAAAA ACCTGTTCCT GCGCGAACAG GACAAAAACG
551  GCGGCGACAA CATCATCTTC GCCAAAGAAG GTAACTTCTC GCTGAACGAC
601  AACAAACGCA CGCTCGAATT GCGCCACGGC TACCGTTACA GCGGCACGCC
651  CGGACGCGCC GACTACAATC AGGTTTCCTT CCAAAAACTC AACCTGATTA
701  TCAGCACCAC GCCCAAACTC ATCGACCCCG TTTCCCACCG CCGTACCATT
```

```
-continued
 751   CCGACCGCCC AACTGATTGG CAGCAGCAAC CCGCAACATC AGGCGGAATT

801   GATGTGGCGC ATCTCGCTGA CCGTCAGCGT CCTCCTACTC TGCCTGCTTG

851   CCGTGCCGCT TTCCTATTTC AACCCGCGCA GCGGACATAC CTACAATATC

901   TTGATTGCCA TCGGTTTGTT TTTAATTTAC CAAAACGGGC TGACCCTGCT

951   TTTTGAAGCC GTGGAAGACG GCAAAATCCA TTTTTGGCTC GGACTGCTGC

1001   CTATGCACAT TATCATGTTT GCCGTTGCAC TCATCCTGTT GCGCGTCCGC

1051   AGTATGCCCA GCCAGCCCTT CTGGCAGGCG GTTGGCAAAA GTCTGACATT

1101   GAAAGGCGGA AAATGA
```

This corresponds to the amino acid sequence (SEQ D NO: 500; ORF101-1):

```
  1   MIYQRNLIKE LSFTAVGIFV VLLAVLVSTQ AINLLGRAAD GRVAIDAVLA

51   LVGFWVIGMT PLLLVLTAFI STLTVLTRYW RDSEMSVWLS CGLALKQWIR

101   PVMQFAVPFA VLVAVMQLWV IPWAELRSRE YAEILKQKQE LSLVEAGEFN

151   SLGKRNGRVY FVETFDTESG IMKNLFLREQ DKNGGDNIIF AKEGNFSLND

201   NKRTLELRHG YRYSGTPGRA DYNQVSFQKL NLIISTTPKL IDPVSHRRTI

251   PTAQLIGSSN PQHQAELMWR ISLTVSVLLL CLLAVPLSYF NPRSGHTYNI

301   LIAIGLFLIY QNGLTLLFEA VEDGKIHFWL GLLPMHIIMF AVALILLRVR

351   SMPSQPFWQA VGKSLTLKGG K*
```

Computer analysis of this amino acid sequence gave the following results:
Homology with a Predicted ORF from *N.meningitidis* (Strain A)

ORF101 (SEQ ID NO: 498) shows 91.2% identity over a 57aa overlap and 95.7% identity over a 69aa overlap with an ORF (ORF101a) (SEQ ID NO: 502) from strain A of *N. meningitidis*:

```
                        10         20         30         40         50
orf101.pep  MIYQRNLIKELSFTAVGIFVVLLAVLVSTQAINLLGRAADGXVIAIDAVLALVGFWVX
            |||||||||||||||||||||||||||||||||||| |||   ||||||||||||||
orf101a     MIYQRNLIKELSFTAVGIFVVLLAVLVSTQAINLLGXAADXRX-AIDAVLALVGFWVXXM
                        10         20         30         40         50

//

90        100       110
orf101.pep  ............................IAIGLFLIYQNGLTLLFEAVEDGKIHFWLGL
                                        ||||||||||||||||||||||||||||||
orf101a     LTVSVLLLCLLAVPLSYFNPRSGHTYNILXAIGLFLIYQNGLTLLFEAVEDGKIHFWLGL
                       280       290       300       310       320       330

120       130       140       150
orf101.pep  LPMHIIMFVLALILLRVRSMPSQPFWQAVGKSLTLKGGKX
            |||||||||:|::|||||||||||||||||||||||||||
orf101a     LPMHIIMFVIAIVLLRVRSMPSQPFWQAVGKSLTLKGGKX
                     340       350       360       370
```

The complete length ORF101a nucleotide sequence (SEQ ID NO: 501) is:

```
  1   ATGATTTATC AAAGAAACCT CATCAAAGAA CTCTCTTTTA CCGCCGTCGG

51   CATTTTCGTC GTCCTCTTGG CGGTATTGGT CTCCACGCAG GCAATCAACC

101   TGCTCGGCCN TGCCGCCGAC NGGCGTNTCG CCATCGATGC CGTGTTGGCA
```

-continued

```
 151    TTGGTCGGCT TCTGGGTCNN NNGNATGACG CCGCTTTTGC TNGTGTTGAC
 201    CGCATTTATC AGTACGTTGA CCGTGTTGAC CCGCTACTGG CGNGACAGCG
 251    AAATGTCGGT CTGGNTATCC TGCGGATTGG CATTGAAACA ATGGATACGC
 301    CCGGTGATGC AGTTTGCCGT GCCGTTTGCC GTTTTGGTTG CCGTCATGCA
 351    GCTTTGGGTG ATACCGTGGG CAGAGCTACG CAGCCGCGAA TACGCTGAAA
 401    TCCTGAAGCA GAAGCAGGAA TTGTCTTTGG TGGAGGCAGG CGGGTTCAAC
 451    AGTTTGGGCA AGCGCAACGG CAGGGTTTAT TTTGTCGAAA CCTTCGATAC
 501    CGAATCCGGC ATCATGAAAA ACCTGTTCCT GCGCGAACAG GACAAAAACG
 551    GCGGCGACAA CATCATCTTC NCCAAAGAAA GTAACTTCTC GCTGAACGAC
 601    AACAAACGCA CGCTCGAATT GCGCCACGGC TACCGTTACA GCGGCACGCC
 651    CGGACGCGCC GACTACAATC AGGTTTCCTT CNAAAACTC AACCTGATTA
 701    TCAGCACCAC GCCCAAACTC ATCGACCCCG TTTCCCACCG CCGTACNATN
 751    CCNACNGCCC AACTGATTGG CAGCAGCAAC CCGCAACATC ANGCGGAATT
 801    GATGTGGCGC ATCTCGCTGA CCGTCAGCGT CCTCCTACTC TGCCTGCTTG
 851    CCGTGCCGCT TTCCTATTTC AACCCGCGCA GCGGACATAC CTACAATATC
 901    TTGANTGCCA TCGGTTTGTT TTTAATTTAC CAAAACGGGC TGACCCTGCT
 951    TTTTGAAGCC GTGGAAGACG GCAAAATCCA TTTTTGGCTC GGACTGCTGC
1001    CTATGCACAT CATCATGTTC GTCATCGCAA TCGTACTTCT GCGCGTCCGC
1051    AGCATGCCCA GCCAGCCCTT CTGGCAGGCG GTTGGCAAAA GTCTGACATT
1101    GAAAGGCGGA AAATGA
```

This encodes a protein having amino acid sequence (SEQ ID NO: 502):

```
  1    MIYQRNLIKE LSFTAVGIFV VLLAVLVSTQ AINLLGXAAD XRXAIDAVLA
 51    LVGFWVXXMT PLLLVLTAFI STLTVLTRYW RDSEMSVWXS CGLALKQWIR
101    PVMQFAVPFA VLVAVMQLWV IPWAELRSRE YAEILKQKQE LSLVEAGGFN
151    SLGKRNGRVY FVETFDTESG IMKNLFLREQ DKNGGDNIIF XKESNFSLND
201    NKRTLELRHG YRYSGTPGRA DYNQVSFXKL NLIISTTPKL IDPVSHRRTX
251    PTAQLIGSSN PQHXAELMWR ISLTVSVLLL CLLAVPLSYF NPRSGHTYNI
301    LXAIGLFLIY QNGLTLLLFEA VEDGKIHFWL GLLPMHIIMF VIAIVLLRVR
351    SMPSQPFWQA VGKSLTLKGG K*
```

ORF101a (SEQ ID NO: 502) and ORF101-1 (SEQ ID NO: 500) show 95.4% identity in 371 aa overlap:

```
orf101a.pep MIYQRNLIKELSFTAVGIFVVLLAVLVSTQAINLLGXAADXRXAIDAVLALVGFWVXXMT   60
            |||||||||||||||||||||||||||||||||||| ||| | |||||||||||||  ||
orf101-1    MIYQRNLIKELSFTAVGIFVVLLAVLVSTQAINLLGRAADGRVAIDAVLALVGFWVIGMT   60 orf101a.pep PLLLVLTAFISTLTVLTRYWRDSEMSVWXSCGLALKQWIRPVMQFAVPFAVLVAVMQLWV  120
            |||||||||||||||||||||||||||| ||||||||||||||||||||||||||||||
orf101-1    PLLLVLTAFISTLTVLTRYWRDSEMSVWLSCGLALKQWIRPVMQFAVPFAVLVAVMQLWV  120 orf101a.pep IPWAELRSREYAEILKQKQELSLVEAGGFNSLGKRNGRVYFVETFDTESGIMKNLFLREQ  180
            |||||||||||||||||||||||||||| |||||||||||||||||||||||||||||||
orf101-1    IPWAELRSREYAEILKQKQELSLVEAGEFNSLGKRNGRVYFVETFDTESGIMKNLFLREQ  180
```

-continued
```
orf101a.pep  DKNGGDNIIFXKESNFSLNDNKRTLELRHGYRYSGTPGRADYNQVSFXKLNLIISTTPKL  240
             ||||||||||  ||:|||||||||||||||||||||||||||||||  ||||||||||||
orf101-1     DKNGGDNIIFAKEGNFSLNDNKRTLELRHGYRYSGTPGRADYNQVSFQKLNLIISTTPKL  240 orf101a.pep  IDPVSHRRTXPTAQLIGSSNPQHXAELMWRISLTVSVLLLCLLAVPLSYFNPRSGHTYNI  300
             ||||||||||  |||||||||||  |||||||||||||||||||||||||||||||||||
orf101-1     IDPVSHRRTIPTAQLIGSSNPQHQAELMWRISLTVSVLLLCLLAVPLSYFNPRSGHTYNI  300 orf101a.pep  LXAIGLFLIYQNGLTLLFEAVEDGKIHFWLGLLPMHIIMFVIAIVLLRVRSMPSQPFWQA  360
             | ||||||||||||||||||||||||||||||||||||||::|::||||||||||||||
orf101-1     LIAIGLFLIYQNGLTLLFEAVEDGKIHFWLGLLPMHIIMFAVALILLRVRSMPSQPFWQA  360 orf101a.pep  VGKSLTLKGGK                                                  371
             |||||||||||
orf101-1     VGKSLTLKGGK                                                  371
```

Homology with a Predicted ORF from *N.gonorrhoeae*

ORF101 (SEQ ID NO: 498) shows 96.5% identity in 57aa overlap at the N-terminal domain and 95.1% identity in 61aa overlap at the C-terminal domain, respectively, with a predicted ORF (ORF101ng) (SEQ ID NO: 504) from *N. gonorrhoeae*:

```
orf101.pep  MIYQRNLIKELSFTAVGIFVVLLAVLVSTQAINLLGRAADGXVIAIDAVLALVGFWV      57
            |||||||||||||||||||||||||||||||||||||||||| | ||||||||||||||
orf101ng    MIYQRNLIKELSFTAVGIFVVLLAVLVSTQAINLLGRAADGRV-AIDAVLALVGFWVIGM  59
```
//
```
orf101.pep                                      IAIGLFLIYQNGLTLLFEAVEDGKIHFWLG  333
                                                |||||||||||||||||||||||||||||
orf101ng    SLTVSVLLLCLLAVPLSYFNPRSGHTYNILIAIGLFLIYQNGLTLLFEAVEDGKIHFWLG  331 orf101.pep  LLPMHIIMFVLALILLRVRSMPSQPFWQAVGKSLTLKGGK                      373
            |||||||||||:|::||||||||||||||||
orf101ng    LLPMHIIMFVIAIVLLRVRSMPSQPFWQAVG                               362
```

The ORF101ng nucleotide sequence (SEQ ID NO: 503) is predicted to encode a protein having partial amino acid sequence (SEQ ID NO: 504):

```
  1  MIYQRNLIKE LSFTAVGIFV VLLAVLVSTQ AINLLGRAAD GRVAIDAVLA
 51  LVGFWVIGMT PLLLVLTAFI STLTVLTRYW RDSEMSVWLS CGLALKQWIR
101  PVMQFAVPFA ILIAVMQLWV IPWAELRSRE YAEILKQKQE LSLVEAGEFN
151  NLGKRNGRVY FVETFDTESG IMKNLFLREQ DKNGGDNIIF AKEGNFSLKD
201  NKRTLELRHG YRYSGTPGRA DYNQVSFQKL NLIISTTPKL IDPVSHRRTI
251  STAQLIGSSN PQHQAELMWR ISLTVSVLLL CLLAVPLSYF NPRSGHTYNI
301  LIAIGLFLIY QNGLTLLFEA VEDGKIHFWL GLLPMHIIMF VIAIVLLRVR
351  SMPSQPFWQA VG...
```

Further work revealed the complete nucleotide sequence (SEQ ID NO: 505):

```
  1  ATGATTTATC AAAGAAACCT CATCAAAGAA CTCTCTTTTA CCGCCGTCGG
 51  CATTTTCGTC GTCCTCTTGG CGGTGTTGGT GTCCACGCAG GCGATCAACC
101  TGCTTGGCCG CGCAGCTGAC GGGCGTGTCG CCATCGATGC CGTGTTGGCC
151  TTAGTCGGCT TCTGGGTCAT CGGTATGACC CCGCTTTTGC TGGTGTTGAC
201  CGCATTCATC AGCACGCTGA CCGTATTGAC CCGCTACTGG CGCGACAGCG
251  AAATGTCGGT CTGGCTATCC TGCGGATTGG CGTTGAAACA GTGGATACGC
```

-continued

```
 301  CCCGTCATGC AGTTTGCCGT GCCGTTTGCC ATCCTGATTG CCGTCATGCA
 351  GCTTTGGGTG ATACCGTGGG CAGAGCTGCG CAGCCGCGAA TATGCCGAAA
 401  TTTTGAAGCA GAAGCAGGAA TTGTCTTTGG TGGAAGCCGG CGAGTTCAAT
 451  AACTTGGGCA AGCGCAACGG CAgggtttaT TtcgtcgaaA CCTTTGACAC
 501  CGaatccgGC ATCATGAAAA ACCTGTtcct GcGCGAACAG GACAAAAACG
 551  gcggcgacaA CATCATCTTC GCcaaaGAag gtaactTctc gctgaaggaC
 601  AACAAAcgca cgctcgaATT GCGCCACGGC TACCGTTACA GCGGcacgcC
 651  CGGacGCGCc gactaCAATC AGGTTtcctt cCAAAAacTc aacctgATta
 701  TCAGCACCAC GCCCAAacTT ATCGaccCCG TTTCCCACCG CCGCACCATT
 751  tcgacCGCCC AAcTGATTGG CAGCAGCAAT CCGCAACATC AGGCAGAATT
 801  GATGTGGCGC ATCTCGCTGA CCGTCAGCGT CCTCCTGCTC TGCCTACTCG
 851  CCGTGCCGCT TTCCTATTTC AACCCGCGCA GCGGACATAC CTACAATATC
 901  TTGATTGCCA TCGGTTTGTT TTTAATTTAC CAAAACGGGC TGACCCTGCT
 951  TTTTGAAGCC GTGGAAGACG GCAAAATCCA TTTTTGGCTC GGACTGCTGC
1001  CTATGCACAT CATCATGTTC GTCATCGCAA TCGTACTTCT GCGCGTCCGC
1051  AGTATGCCCA GCCAGCCCTT CTGGCAGGCG GTTGGCAAAA GTCTGACATT
1101  GAAAGgcgGA AAATGA
```

This corresponds to the amino acid sequence (SEQ ID NO: 506; ORF101ng-1):

```
  1  MIYQRNLIKE LSFTAVGIFV VLLAVLVSTQ AINLLGRAAD GRVAIDAVLA
 51  LVGFWVIGMT PLLLVLTAFI STLTVLTRYW RDSEMSVWLS CGLALKQWIR
101  PVMQFAVPFA ILIAVMQLWV IPWAELRSRE YAEILKQKQE LSLVEAGEFN
151  NLGKRNGRVY FVETFDTESG IMKNLFLREQ DKNGGDNIIF AKEGNFSLKD
201  NKRTLELRHG YRYSGTPGRA DYNQVSFQKL NLIISTTPKL IDPVSHRRTI
251  STAQLIGSSN PQHQAELMWR ISLTVSVLLL CLLAVPLSYF NPRSGHTYNI
301  LIAIGLFLIY QNGLTLLFEA VEDGKIHFWL GLLPMHIIMF VIAIVLLRVR
351  SMPSQPFWQA VGKSLTLKGG K*
```

ORF101ng-1 (SEQ ID NO: 506) and ORF101-1 (SEQ ID NO: 500) show 97.6% identity in 371 aa overlap:

```
                  10         20         30         40         50         60
orf101-1.pep  MIYQRNLIKELSFTAVGIFVVLLAVLVSTQAINLLGRAADGRVAIDAVLALVGFWVIGMT
              ||||||||||||||||||||||||||||||||||||||||||||||||||||||||||||
orf101ng-1    MIYQRNLIKELSFTAVGIFVVLLAVLVSTQAINLLGRAADGRVAIDAVLALVGFWVIGMT
                  10         20         30         40         5060

70         80         90        100        110        120
orf101-1.pep  PLLLVLTAFISTLTVLTRYWRDSEMSVWLSCGLALKQWIRPVMQFAVPFAVLVAVMQLWV
              |||||||||||||||||||||||||||||||||||||||||||||||||:|:||||||||
orf101ng-1    PLLLVLTAFISTLTVLTRYWRDSEMSVWLSCGLALKQWIRPVMQFAVPFAILIAVMQLWV
                  70         80         90        100        110        120

130        140        150        160        170        180
orf101-1.pep  IPWAELRSREYAEILKQKQELSLVEAGEFNSLGKRNGRVYFVETFDTESGIMKNLFLREQ
              |||||||||||||||||||||||||||||||:||||||||||||||||||||||||||||
orf101ng-1    IPWAELRSREYAEILKQKQELSLVEAGEFNNLGKRNGRVYFVETFDTESGIMKNLFLREQ
                 130        140        150        160        170        180
```

```
                    190        200       210       220       230       240
orf101-1.pep  DKNGGDNIIFAKEGNFSLNDNKRTLELRHGYRYSGTPGRADYNQVSFQKLNLIISTTPKL
              |||||||||||||||||:||||||||||||||||||||||||||||||||||||||||
orf101ng-1    DKNGGDNIIFAKEGNFSLKDNKRTLELRHGYRYSGTPGRADYNQVSFQKLNLIISTTPKL
                    190        200       210       220       230       240

250        260       270       280       290       300
orf101-1.pep  IDPVSHRRTIPTAQLIGSSNPQHQAELMWRISLTVSVLLLCLLAVPLSYFNPRSGHTYNI
              ||||||||||  ||||||||||||||||||||||||||||||||||||||||||||||
orf101ng-1    IDPVSHRRTISTAQLIGSSNPQHQAELMWRISLTVSVLLLCLLAVPLSYFNPRSGHTYNI
                    250        260       270       280       290       300

310        320       330       340       350       360
orf101-1.pep  LIAIGLFLIYQNGLTLLFEAVEDGKIHFWLGLLPMHIIMFAVALILLRVRSMPSQPFWQA
              |||||||||||||||||||||||||||||||||||||||::|::|||||||||||||||
orf101ng-1    LIAIGLFLIYQNGLTLLFEAVEDGKIHFWLGLLPMHIIMFVIAIVLLRVRSMPSQPFWQA
                    310        320       330       340       350       360

370
orf101-1.pep  VGKSLTLKGGKX
              ||||||||||||
orf101ng-1    VGKSLTLKGGKX
                    370
```

Based on this analysis, including the presence of a putative leader sequence (double-underlined) and several putative transmembrane domains (single-underlined) in the gonococcal protein, it is predicted that the proteins from *N.meningitidis* and *N.gonorrhoeae*, and their epitopes, could be useful antigens for vaccines or diagnostics, or for raising antibodies.

Example 60

The following partial DNA sequence was identified in *N.meningitidis* (SEQ ID NO: 507):

```
  1  ..GGTGGTGGTT TTATCAATGC TTCCTGTGCC ACTTTGACGA CAGCCAAACC

51    GCAATATCAA GCAGGAGACC TTAGCGCTTT TAAGATAAGG CAAGGCAATG

101    TTGTAATCGC CGGACACGGT TTGGATGCAC GTGATACCGA TTACACACGT

151    ATTCTCAGTT ATCATTCCAA AATCGATGCA CCCGTATGGG GACAAGATGT

201    TCGTGTCGTC GCGGGACAAA ACGATGTGGC CGCAACAGGT GATGCACATT

251    CGCCTATTCT CAATAATGCT GCTGCCAATA CGTCAAACAA TACAGCCAAC

301    AACGGCACAC ATATCCCTTT ATTTGCGATT GATACAGGCA AATTAGGAGG

351    TAT.GTATGC CAACAAAATC ACCTTGATCA GTACGGTCGA GCAAGCAGGC

401    ATTCGTAA
```

This corresponds to the amino acid sequence (SEQ ID NO: 508; ORF113):

```
  1  ..GGGFINASCA TLTTAKPQYQ AGDLSAFKIR QGNVVIAGHG LDARDTDYTR

51    ILSYHSKIDA PVWGQDVRVV AGQNDVAATG DAHSPILNNA AANTSNNTAN

101    NGTHIPLFAI DTGKLGGXVC QQNHLDQYGR ASRHS*
```

Computer analysis of this amino acid sequence gave the following results:
Homology with with pspA Putative Secreted Protein (SEQ ID NO: 1143) of *N.meningitidis* (Accession AF030941)

ORF (SEQ ID NO: 508) and pspA (SEQ ID NO: 1143) show 44% aa identity in 179aa overlap:

```
orf113 GGGFINASCATLTTAKPQYQAGDLSAFKIRQGNVVIAGHGLDARDTDYTRILSYHSKIDA    60
       GGG INA+  TLT+  P    G+L+ F +  G VVI G GLD  D DYTRILS  ++I+A
pspa   GGGLINAASVTLTSGVPVLNNGNLTGFDVSSGKVVIGGKGLDTSDADYTRILSRAAEINA   256 orf113 PVWGQDVRVVAGQNDVAATGDAHSPILXXXXXXXXXXXXXXGTHIPLFAIDTGKLGGMYA   120
        VWG+DV+VV+G+N +    G                      +  P  AIDT  LGGMYA
pspa   GVWGKDVKVVSGKNKLDFDG---------SLAKTASAPSSSDSVTPTVAIDTATLGGMYA   307 orf113 NKITLISTVEQAGIRNQGQWFASAGNVAVNAEGKLVNTGMIAATGENHAVSLHARNVHN    179
       +KITLIST   A IRN+G+ FA+ G V ++A+GKL N+G I A      +++ A+ V N
pspa   DKITLISTDNGAVIRNKGRIFAATGGVTLSADGKLSNSGSIDAA----EITISAQTVDN    362
```

Homology with a Predicted ORF from *N.gonorrhoeae*

ORF113 (SEQ ID NO: 508) shows 86.5% identity in 52aa overlap at the N-terminal part and 94.1% identity in 17aa overlap at the C-terminal part with a predicted ORF (ORF13ng) (SEQ ID NO: 510) from *N. gonorrhoeae*:

```
orf113                                   GGGFINASCATLTTAKPQYQAGDLSAFKIR    30
                                         |||||||| |||||::|||||||:|:||||
orf113ng  SHPSQLNGYIEVGGRRAEVVIANPAGIAVNGGGFINASRATLTTGQPQYQAGDFSGFKIR   224 orf113    QGNVVIAGHGLDARDTDYTRILSYHSKIDAPVWGQDVRVVAGQNDVAATGDAHSPILNNA    90
          |||:||||||||||||||:||||
orf113ng  QGNAVIAGHGLDARDTDFTRILVCQQNHLDQYGRTSRHS                         263 orf113                        IDTGKLGGXVCQQNHLDQYGRASRHS                   135
                                         ||||||||||||:||||
orf113ng  DFSGFKIRQGNAVIAGHGLDARDTDFTRILVCQQNHLDQYGRTSRHS                  263
```

The complete length ORF113ng nucleotide sequence (SEQ ID NO: 509) is predicted to encode a protein having amino acid sequence (SEQ ID NO: 510):

```
  1 MNKTLYRVIF NRKRGAVVAV AETTKREGKS CADSGSGSVY VKSVSFIPTH
 51 SKAFCFSALG FSLCLALGTV NIAFADGIIT DKAAPKTQQA TILQTGNGIP
101 QVNIQTPTSA GVSVNQYAQF DVGNRGAILN NSRSNTQTQL GGWIQGNPWL
151 TRGEARVVVN QINSSHPSQL NGYIEVGGRR AEVVIANPAG IAVNGGGFIN
201 ASRATLTTGQ PQYQAGDFSG FKIRQGNAVI AGHGLDARDT DFTRILVCQQ
251 NMLDQYGRTS RHS*
```

Based on this analysis, it is predicted that these proteins from *N.meningitidis* and *N.gonorrhoeae*, and their epitopes, could be useful antigens for vaccines or diagnostics, or for raising antibodies.

Example 61

The following partial DNA sequence was identified in *N.meningitidis* (SEQ ID NO: 511):

```
  1 ..TCAACGGCAC ATAGCGAACA AAATTACACT TTGCCGCGAG AAATCACACG
 51   CAACATTTCA CTGGGTTCAT TTGCCTATGA ATCGCATCGC AAAGCATTAA
101   GCCATCATGC GCCCAGCCAA GGCACTGAGT TGCCGCAAAG CAACGGTATT
151   TCGCTACCCT ATACGTCCAA TTCTTTTACC CCATTACCCA GCAGCAGCTT
```

-continued

```
201    ATACATTATC AATCCTGTCA ATAAAGGCTA TCTTGTTGAA ACCGATCCAC

251    GCTTTGCCAA CTACCGTCAA TGGTTGGGTA GTGACTATAT GCtGGACAGC

301    CTCAAACTAG ACCCAAACAA TTTACATAAA CGTTTGGGTG ATGGTTATTA

351    CGAGCAACGT TTAATCAATG AACAAATCGC AGAGCTGACA GGGCATCGTC

401    GTTTAGAcGG TTATCAAAAC GACGAAGAAC AATTTAAAGC CTTAATGGAT

451    AATGGCGCGA CTGCGGCACG TTcGATGAAT CTCAGCGTTG GCATTGCATT

501    AAGTGCCGAG CAAGTAGCGC AACTGACCAG CGATATTGTT TGGTTGGTAC

551    AAAAAGAAGT TAAGCTTCCT GATGGCGGCA CACAAACCGT ATTGGTGCCA

601    CAGGTTTATG TACGCGTTAA AAATGGCGAC ATAGACGGTA AAGGTGCATT

651    GTTGTCAGGC AGCAATACAC AAATCAATGT TTCAGGCAGC CTGAAAAACT

701    CAGGCACGAT TGCAGGcCGC AATGCGCTTA TTATCAATAC CGATACGCTA

751    GACAATATCG GTGGGCGTAT TCATGCGCAA AAATCAGCGG TTACGGCCAC

801    ACAAGACATC AATAATATTG GCGGCATGCT TTCTGCCGAA CAGACATTAT

851    TGCTCAACGC AGGCAACAAC ATCAACAGCC AAAGCACCAC CGCCAGCAGT

901    CAAAATACAC AAGGCAGCAG CACCTACCTA GACCGAATGG CAGGTATTTA

951    TATCACAGGC AAAGAAAAAG GTGTTT..
```

This corresponds to the amino acid sequence (SEQ ID NO: 512; ORF115):

```
  1    ..STGHSEQNYT LPREITRNIS LGSFAYESHR KALSHHAPSQ GTELPQSNGI

51    SLPYTSNSFT PLPSSSLYII NPVNKGYLVE TDPRFANYRQ WLGSDYMLDS

101    LKLDPNNLHK RLGDGYYEQR LINEQIAELT GHRRLDGYQN DEEQFKALMD

151    NGATAARSMN LSVGIALSAE QVAQLTSDIV WLVQKEVKLP DGGTQTVLVP

201    QVYVRVKNGD IDGKGALLSG SNTQINVSGS LKNSGTIAGR NALIINTDTL

251    DNIGGRIHAQ KSAVTATQDI NNIGGMLSAE QTLLLNAGNN INSQSTTASS

301    QNTQGSSTYL DRMAGIYITG KEKGV..
```

Computer analysis of this amino acid sequence gave the following results:
Homology with the pspA Putative Secreted Protein (SEQ ID NO: 1143) of *N.meningitidis* (Accession Number AF030941)
ORF115 (SEQ ID NO: 512) and pspA protein (SEQ ID NO: 1143) show 50% aa identity in 325aa overlap:

```
Orf115:    1 STGHSEQNYTLPREITRNISLGSFAYESHRKALSHHAPSQGTELPQSNGISLPYTSNSFT    60
             STG+S    Y     E++ +I +G  AY+ +     +P    +   NGI    +T
pspA:    778 STGYSRSPYEPAPEVS-SIRMGISAYKGYAPQQSDIPGTVVPVVAENGIHPTFT-----   831

Orf115:   61 PLPSSSLYIINPVNKGYLVETDPRFANYRQWLGSDYMLDSLKLDPNNLHKRLGDGYYEQR   120
             LP+SSL+  I P NKGYL+ETDP F +YR+WLGS YML +L+ DPN++HKRLGDGYYEQ+
pspA:    832 -LPNSSLFAIAPNNKGYLIETDPAFTDYRKWLGSGYMLAALQQDPNHIHKRLGDGYYEQK   890

Orf115:  121 LINEQIAELTGHRRLDGYQNDEEQFKALMDNGATAARSMNLSVGIALSAEQVAQLTSDIV   180
             L+NEQIA+LTG+RRLDGY NDEEQFKALMDNG T A+ +  L+ GIALSAEQVA+LTSDIV
pspA:    891 LVNEQIAKLTGYRRLDGYTNDEEQFKALMDNGITIAKELQLTPGIALSAEQVARLTSDIV   950
```

```
                        -continued
Orf115:   181 WLVQKEVKLPDGGTQTVLVPQVYVRVKNGDIDGKGALLSGSNTQINVSGSLKN-SGTIAG    239
              WL + V LPDG TQTVL P+VYVR +  D++G+GALLSGS    I  SG+++N  G IAG
pspA:     951 WLENETVTLPDGTTQTVLKPKVYVRARPKDMNGQGALLSGSVVDIG-SGAIENRGGLIAG  1009

Orf115:   240 RNALIINTDTLDNIGGRIHAQKSAVTATQDINNIGGMLSAEQTLLLNAGXXXXXXXXXXX   299
              R ALI+N   + N+ G +  +     A DI N G  + AE  LLL A
pspA:    1010 REALILNAQNIKNLQGDLQGKNIFAAAGSDITNTGS-IGAENALLLKASNNIESRSETRS  1068

Orf115:   300 XXXXXXXXXXYLDRMAGIYITGKEKG                                    324
                        + R+AGIY+TG++ G
pspA:    1069 NQNEQGSVRNIGRVAGIYLTGRQNG                                    1093
```

Homology with a Predicted ORF from N.gonorrhoeae

ORF115 (SEQ ID NO: 512) shows 91.9% identity over a 334aa overlap with a predicted ORF (ORF115ng) (SEQ ID NO: 514) from N.gonorrhoeae:

```
orf115.pep                         STGHSEQNYTLPREITRNISLGSFAYESHRK   31
                                   ||| |||||||:||||:||||||||||||| |
orf115ng    NEQTFGEKKVFSENGKLHNYWRARRKGHDETGHREQNYTLPEEITRDISLGSFAYESHSK   71 orf115.pep  ALSHHAPSQGTELPQSN----------GISLPYTSNSFTPLPSSSLYIINPVNKGYLVET   81
            |||:||||||||||||||          |||||||| |||||||:||||||||:||||||
orf115ng    ALSRHAPSQGTELPQSNRDNIRTAKSNGISLPYTPNSFTPLPGSSLYIINPANKGYLVET  131 orf115.pep  DPRFANYRQWLGSDYMLDSLKLDPNNLHKRLGDGYYEQRLINEQIAELTGHRRLDGYQND  141
            |||||||||||||||||| |||||||||||||||||||||||||||||||||||||||||
orf115ng    DPRFANYRQWLGSDYMLGSLKLDPNNLHKRLGDGYYEQRLINEQIAELTGHRRLDGYQND  191 orf115.pep  EEQFKALMDNGATAARSMNLSVGIALSAEQVAQLTSDIVWLVQKEVKLPDGGTQTVLVPQ  201
            ||||||||||||||||||||||||||||||:|||||||||||||||||||||||||:||
orf115ng    EEQFKALMDNGATAARSMNLSVGIALSAEQAAQLTSDIVWLVQKEVKLPDGGTQTVLMPQ  251 orf115.pep  VYVRVKNGDIDGKGALLSGSNTQINVSGSLKNSGILAGRNALIINTDTLDNIGGRIHAQK  261
            ||||||||  ||||||||||||||||||||||||  |||||||||||||||||||||||
orf115ng    VYVRVKNGGIDGKGALLSGSNTQINVSGSLKNSGTIAGRNALIINTDTLDNIGGRIHAQK  311 orf115.pep  SAVTATQDINNIGGMLSAEQTLLLNAGNNINSQSTTASSQNTQGSSTYLDRMAGIYITGK  321
            |||||||||||||||:||||||||||||||:|||: ||||:|||||||||||||||||||
orf115ng    SAVTATQDINNIGGILSAEQTLLLNAGNNINNQSTAKSSQNAQGSSTYLDRMAGIYITGK  371 orf115.pep  EKGV                                                           325
            ||||
orf115ng    EKGVLAAQAGKDINIIAGQISNQSDQGQTRLQAGRDINLDTVQTGKYQEIHFDADNHTIR  431
```

An ORF115ng nucleotide sequence (SEQ ID NO: 513) was predicted to encode a protein having amino acid sequence (SEQ ID NO: 514):

```
  1  MLVQTEKDGL HNEQTFGEKK VFSENGKLHN YWRARRKGHD ETGHREQNYT

51  LPEEITRDIS LGSFAYESHS KALSRHAPSQ GTELPQSNRD NIRTAKSNGI

101  SLPYTPNSFT PLPGSSLYII NPANKGYLVE TDPRFANYRQ WLGSDYMLGS

151  LKLDPNNLHK RLGDGYYEQR LINEQIAELT GHRRLDGYQN DEEQFKALMD

201  NGATAARSMN LSVGIALSAE QAAQLTSDIV WLVQKEVKLP DGGTQTVLMP

251  QVYVRVKNGG IDGKGALLSG SNTQINVSGS LKNSGTIAGR NALIINTDTL

301  DNIGGRIHAQ KSAVTATQDI NNIGGILSAE QTLLLNAGNN INNQSTAKSS

351  QNAQGSSTYL DRMAGIYITG KEKGVLAAQA GKDINIIAGQ ISNQSDQGQT

401  RLQAGRDINL DTVQTGKYQE IHFDADNHTI RGSTNEVGSS IQTKGDVTLL

451  SGNNLNAKAA EVGSAKGTLA VYAKNDITIS SGIHAGQVDD ASKHTGRSGG

501  GNKLVITDKA QSHHETAQSS TFEGKQVVLQ AGNDANILGS NVISDNGTRI

551  QAGNHVRIGT TQTQSQSETY HQTQKSGLMS AGIGFTIGSK TNTQENQSQS
```

-continued
```
601 NEHTGSTVGS LKGDTTIVAS KHYEQTGSNV SSPEGNNLIS TQSMDIGAAQ

651 NQLNSKTTQT YEQKGLTVAF SSPVTDLAQQ AIAVAHKAAK QFDKAKTTAL

701 MPWRLPMQVG RLFKQAKAPK K*
```

Further work revealed the following partial gonococcal DNA sequence (SEQ ID NO: 515):

```
   1 TTGCTTGTGC AAACAGAAAA AGACGGTTTG CATAACGAGC AAACCTTTGG

51 CGAGAAGAAA GTCTTCAGCG AAAATGGTAA GTTGCACAAC TACTGGCGTG

101 CGCGTCGTAA AGGACATGAT GAAACAGGGC ATCGTGAACA AAATTATACT

151 TTGCCGGAGG AAATCACACG CGACATTTCA CTGGGTTCAT TTGCCTATGA

201 ATCGCATAGC AAAGCATTAA GCCGTCATGC GCCCAGCCAA GGCACTGAGT

251 TGCCACAAAG TAACCGGGAT AATATCCGTA CTGCGAAAAG CAACGGTATT

301 TCGCTACCCT ATACGCCCAA TTCTTTTACC CCATTACCCG GCAGCAGCTT

351 ATACATTATC AATCCTGCCA ATAAAGGCTA TCTTGTTGAA ACCGATCCAC

401 GCTTTGCCAA CTACCGTCAA TGGTTGGGTA GTGACTATAT GCTGGGCAGC

451 CTCAAACTAG ACCCAAACAA TTTACATAAA CGTTTGGGTG ATGGTTATTA

501 CGAGCAACGT TTAATCAATG AACAAATCGC AGAGCTGACA GGGCATCGTC

551 GTTTAGACGG TTATCAAAAC GACGAAGAAC AATTTAAAGC CTTAATGGAT

601 AATGGCGCGA CTGCGGCACG TTCGATGGAT CTCAGCGTTG GCATTGCATT

651 AAGTGCCGAG CAAGCAGCGC AACTGACCAG CGATATTGTT TGGTTGGTAC

701 AAAAAGAAGT TAAACTTCCT GATGGCGGCA CACAAACCGT ATTGATGCCA

751 CAGGTTTATG TACGCGTTAA AAATGGCGGC ATAGACGGTA AAGGTGCATT

801 GTTGTCAGGC AGCAATACAC AAATCAATGT TTCAGGCAGC CTGAAAAACT

851 CAGGCACGAT TGCAGGGCGC AATGCGCTTA TTATCAATAC CGATACGCTA

901 GACAATATCG GTGGGCGTAT TCATGCGCAA AAATCAGCGG TTACGCCCAC

951 ACAAGACATC AATAATATTG GCGGCATTCT TTCTGCCGAA CAGACATTAT

1001 TGCTCAATGC GGGTAACAAC ATCAACAACC AAAGCACGGC CAAGAGCAGT

1051 CAAAATGCAC AAGGTAGCAG CACCTACCTA GACCGAATGG CAGGTATTTA

1101 TATCACAGGC AAAGAAAAAG GTGTTTTAGC AGCGCAGGCA GGCAAAGACA

1151 TCAACATCAT TGCCGGTCAA ATCAGCAATC AATCAGATCA AGGGCAAACC

1201 CGGCTGCAGG CAGGACGCGA CATTAACCTG GATACGGTAC AAACCGGCAA

1251 ATATCAAGAA ATCCATTTTG ATGCCGATAA CCATACCATC CGAGGTTCAA

1301 CGAACGAAGT CGGCAGCAGC ATTCAAACAA AAGGCGATGT TACCCtatTG

1351 TCAGGGAATA ATCTCAATGC CAAAGCTGCC GAAGTCGGCA GCGCAAAAGG

1401 CACACTTGCC GTGTATGCTA AAAATGACAT TACTATCAGC TCAGGCATCC

1451 ATGCCGGCCA AGTTGATGAT GCGTCCAAAC ATACAGGCAG AAGCGGCGGC

1501 GGTAATAAAT TAGTCATTAC CGATAAAGCC CAAAGTCATC ACGAAACTGC

1551 TCAAAGCAGC ACCTTTGAAG GCAAGCAAGT TGTATTGCAG GCAGGAAACG

1601 ATGCCAACAT CCTTGGCAGT AATGTTATTT CCGATAATGG CACCCGGATT

1651 CAAGCAGGCA ATCATGTTCG CATTGGTACA ACCCAAACTC AAAGCCAAAG
```

-continued

```
1701    CGAAACCTAT CATCAAACCC AAAAATCAGG ATTGATGAGT GCAGGTATCG
1751    GCTTCACTAT TGGCAGCAAG ACAAACACAC AAGAAAACCA ATCCCAAAGC
1801    AACGAACATA CAGGCAGTAC CGTAGGCAGC CTGAAAGGCG ATACCACCAT
1851    TGTTGCAAGC AAACACTACG AACAAACCGG CAGCAACGTT TCCAGCCCTG
1901    AGGGCAACAA CCTTATCAGC ACGCAAAGTA TGGATATTGG CGCAGCACAA
1951    AACCAATTAA ACAGCAAAAC CACCCAAACC TACGAACAAA AAGGCTTAAC
2001    GGTGGCATTC AGTTCGCCCG TTACCGATTT GGCACAACAA GCGATTGCCG
2051    TAGCACACAA AGCAGCAAAC AAGTCGGACA AGCAAAAAC GACCGCGTTA
2101    ATGCCATGGC GGCTGCCAAT GCAGGTTGGC AGGCCTATCA AACAGGCAAA
2151    GGCGCACAAA ACTTAG
```

This corresponds to the amino acid sequence (SEQ ID NO: 516; ORF115ng-1):

```
  1    LLVQTEKDGL HNEQTFGEKK VFSENGKLHN YWRARRKGHD ETGHREQNYT
 51    LPEEITRDIS LGSFAYESHS KALSRHAPSQ GTELPQSNRD NIRTAKSNGI
101    SLPYTPNSFT PLPGSSLYII NPANKGYLVE TDPRFANYRQ WLGSDYMLGS
151    LKLDPNNLHK RLGDGYYEQR LINEQIAELT GHRRLDGYQN DEEQFKALMD
201    NGATAARSMN LSVGIALSAE QAAQLTSDIV WLVQKEVKLP DGGTQTVLMP
251    QVYVRVKNGG IDGKGALLSG SNTQINVSGS LKNSGTIAGR NALIINTDTL
301    DNIGGRIHAQ KSAVTATQDI NNIGGILSAE QTLLLNAGNN INNQSTAKSS
351    QNAQGSSTYL DRMAGIYITG KEKGVLAAQA GKDINIIAGQ ISNQSDQGQT
401    RLQAGRDINL DTVQTGKYQE IHFDADNHTI RGSTNEVGSS IQTKGDVTLL
451    SGNNLNAKAA EVGSAKGTLA VYAKNDITIS SGIHAGQVDD ASKHTGRSGG
501    GNKLVITDKA QSHHETAQSS TFEGKQVVLQ AGNDANILGS NVISDNGTRI
551    QAGNHVRIGT TQTQSQSETY HQTQKSGLMS AGIGFTIGSK TNTQENQSQS
601    NEHTGSTVGS LKGDTTIVAS KHYEQTGSNV SSPEGNNLIS TQSMDIGAAQ
651    NQLNSKTTQT YEQKGLTVAF SSPVTDLAQQ AIAVAHKAAN KSDKAKTTAL
701    MPWRLPMQVG RPIKQAKAHK T*
```

This gonococcal protein (ORF115ng-1) (SEQ ID NO: 516) shows 91.9% identity with ORF115 (SEQ ID NO: 512) over 334aa:

```
                    20         30         40         50         60         70
orf115ng-1.p  NEQTFGEKKVFSENGKLHNYWRARRKGHDETGHREQNYTLPEEITRDISLGSFAYESHSK
                         ||| ||||||||:||||:|||||||||| |
orf115                   STGHSEQNYTLPREITRNISLGSFAYESHRK
                                         10         20         30

80         90        100        110        120        130
orf115ng-1.p  ALSRHAPSQGTELPQSNRDNIRTAKSNGISLPYTPNSFTPLPGSSLYIINPANKGYLVET
                 |||:|||||||||||                |||||||| ||||||:|||||||:|||||||
orf115        ALSHHAPSQGTELPQSN--------------GISLPYTSNSFTPLPSSSLYIINPVNKGYLVET
                    40                          50         60         70         80
```

-continued
```
                   140       150       160       170       180       190
orf115ng-1.p  DPRFANYRQWLGSDYMLGSLKLDPNNLHKRLGDYYEQRLINEQIAELTGHRRLDGYQND
              ||||||||||||||| ||||||||||||||||||||||||||||||||||||||||||
orf115        DPRFANYRQWLGSDYMLDSLKLDPNNLHKRLGDYYEQRLINEQIAELTGHRRLDGYQND
                    90        100       110       120       130       140

200       210       220       230       240       250
orf115ng-1.p  EEQFKALMDNGATAARSMNLSVGIALSAEQAAQLTSDIVWLVQKEVKLPDGGTQTVLMPQ
              |||||||||||||||||||||||||||||:|||||||||||||||||||||||||||:||
orf115        EEQFKALMDNGATAARSMNLSVGIALSAEQVAQLTSDIVWLVQKEVKLPDGGTQTVLVPQ
                    150       160       170       180       190       200

260       270       280       290       300       310
orf115ng-1.p  VYVRVKNGGIDGKGALLSGSNTQINVSGSLKNSGTIAGRNALIINTDTLDNIGGRIHAQK
              ||||||||| ||||||||||||||||||||||||||||||||||||||||||||||||||
orf115        VYVRVKNGDIDGKGALLSGSNTQINVSGSLKNSGTIAGRNALIINTDTLDNIGGRIHAQK
                    210       220       230       240       250       260

320       330       340       350       360       370
orf115ng-1.p  SAVTATQDINNIGGILSAEQTLLLNAGNNINNQSTAKSSQNAQGSSTYLDRMAGIYITGK
              ||||||||||||:|||||||||||||||||:|||:
              ||||:|||||||||||||||||||||||||:|||:
orf115        SAVTATQDINNIGGMLSAEQTLLLNAGNNINSQSTTASSQNTQGSSTYLDRMAGIYITGK
                    270       280       290       300       310       320

380       390       400       410       420       430
orf115ng-1.p  EKGVLAAQAGKDINIIAGQISNQSDQGQTRLQAGRDINLDTVQTGKYQEIHFDADNHTIR
              ||||
orf115        EKGV
```

In addition, it shows homology with a secreted *N.meningitidis* protein (SEQ ID NO: 1143) in the database:

```
gi|2623258 (AF030941) putative secreted protein {Neisseria meningitidis} Length = 2273
 Score = 604 bits (1541), Expect = e-172
 Identities = 325/678 (47%), Positives = 449/678 (65%), Gaps = 22/678 (3%)

Query:     1   LLVQTEKDGLHNEQTFGEKKVFSENGKLHNYWRARRKGHDETGHREQNYTLPEEITRDIS    60
               L+V T +   L N++T G K + ++ G LH Y R  +KG D TG+     Y   E++  I
Sbjct:   739   LIVGTPESALDNDETLGTKTI-TDKGDLHRYHRHHKKGRDSTGYSRSPYEPAPEVS-SIR   796

Query:    61   LGSFAYESHSKALSRHAPSQGTELPQSNRDNIRTAKSNGISLPYTPNSFTPLPGSSLYII   120
               +G  AY+ +       AP Q +++P +    +   NGI   +T     LP SSL+ I
Sbjct:   797   MGISAYKGY-------APQQASDIPGTV---VPVVAENGIHPTFT------LPNSSLFAI   840

Query:   121   NPANKGYLVETDPRFANYRQWLGSDYMLGSLKLDPNNLHKRLGDYYEQRLINEQIAELT    180
                P NKGYL+ETDP F +YR+WLGS YML +L+ DPN++HKRLGDYYEQ+L+NEQIA+LT
Sbjct:   841   APNNKGYLIETDPAFTDYRKWLGSGYMLAALQQDPNHIHKRLGDYYEQKLVNEQIAKLT   900

Query:   181   GHRRLDGYQNDEEQFKALMDNGATAARSMNLSVGIALSAEQAAQLTSDIVWLVQKEVKLP   240
               G+RRLDGY NDEEQFKALMDNG  T A+ + L+ GIALSAEQ A+LTSDIVWL  + V LP
Sbjct:   901   GYRRLDGYTNDEEQFKALMDNGITIAKELQLTPGIALSAEQVARLTSDIVWLENETVTLP   960

Query:   241   DGGTQTVLMPQVYVRVKNGGIDGKGALLSGSNTQINVSGSLKN-SGTIAGRNALIINTDT   299
               DG TQTVL P+VYVR +  ++G+GALLSGS   I  SG+++N   G  IAGR ALI+N
Sbjct:   961   DGTTQTVLKPKVYRARPKDMNGQGALLSGSVVDIG-SGAIENRGGLIAGREALILNAQN   1019

Query:   300   LDNIGGRIHAQKSAVTATQDINNIGGILSAEQTLLLNAGNNINNQSTAKSSQNAQGSSTY   359
               + N+ G + +    A  DI N G I  AE  LLL A  NNI ++S +S+QN QGS
Sbjct:  1020   IKNLQGDLQGKNIFAAAGSDITNTGSI-GAENALLLKASNNIESRSETRSNQNEQGSVRN  1078

Query:   360   LDRMAGIYITGKEKGVLAAQAGKDINIIAGQISNQSDQGQTRLQAGRDINLDTVQTGKYQ   419
               + R+AGIY+TG++ G      AG +I + A +++NQS+ GQT L AG DI   DT   + Q
Sbjct:  1079   IGRVAGIYLTGRQNGSVLLDAGNNIVLTASELTNQSEDGQTVLNAGGDIRSDTTGISRNQ  1138

Query:   420   EIHFDADNHTIRGSTNEVGSSIQTKGDVTLLSGNNLNAKAAEVGSAKGTLAVYAKNDITI   479
                  FD+DN+ IR    NEVGS+I+T+G+++L +    ++   +AAEVGS +G L + A DI +
Sbjct:  1139   NTIFDSDNYVIRKEQNEVGSTIRTRGNLSLNAKGDIRIRAAEVGSEQGRLKLAAGRDIKV  1198

Query:   480   SSGIHAGQVDDASKHTGRSGGGNKLVITDKAQSHHETAQSSTFEGKQVVLQAGNDANILG   539
               +G     + +DA K+TGRSGGG K +T    ++ +    A S T +GK+++L +G D  + G
Sbjct:  1199   EAGKAHTETEDALKYTGRSGGGIKQKMTRHLKNQNGQAVSGTLDGKEIILVSGRDITVTG  1258
```

```
gi|2623258 (AF030941) putative secreted protein {Neisseria meningitidis} Length = 2273
 Score = 604 bits (1541), Expect = e-172
 Identities = 325/678 (47%), Positives = 449/678 (65%), Gaps = 22/678 (3%)

Query:   540   SNVISDNGTRIQAGNHVRIGTTQTQSQSETYHQTQKSGLM-SAGIGFTIGSKTNTQENQS      598
               SN+I+DN T + A N++ +    +T+S+S      ++ +KSGLM S GIGFT GSK +TQ N+S
Sbjct:  1259   SNIIADNHTILSAKNNIVLKAAETRSRSAEMNKKEKSGLMGSGGIGFTAGSKKDTQTNRS     1318

Query:   599   QSNEHTGSTVGSLKGDTTIVASKHYEQTGSNVSSPEGNNLISTQSMDIGAAQNQLNSKTT      658
               ++  HT S VGSL G+T I A KHY QTGS  +SSP+G+   IS+   + I AAQN+ + ++
Sbjct:  1319   ETVSHTESVVGSLNGNTLISAGKHYTQTGSTISSPQGDVGISSGKISIDAAQNRYSQESK     1378

Query:   659   QTYEQKGLTVAFSSPVTD                                               676
               Q YEQKG+TVA S PV +
Sbjct:  1379   QVYEQKGVTVAISVPVVN                                              1396
```

Based on this analysis, it is predicted that the proteins from N.meningitidis and N.,gonorrhoeae, and their epitopes, could be useful antigens for vaccines or diagnostics, or for raising antibodies.

Example 62

The following partial DNA sequence was identified in N.meningitidis (SEQ ID NO: 517):

```
  1    ..TCAGGAATA ACCTCAATGC CAAAGCTGCC GAAGTCAGCA GCGCAAACGG
 51      TACACTCGCT GTGTCTGCCA ATAATGACAT CAACATCAGC GCAGGCATCA
101      ACACGACCCA TGTTGATGAT GCGTCCAAAC ACACAGGCAG AAGCGGTGGT
151      GGCAATAAAT TAGTCATTAC CGATAAAGCC CAAAGTCATC ACGAAACCGC
201      CCAAAGCAGC ACCTTTGAAG GCAAGCAAGT TGTATTGCAG GCAGGAAACG
251      ATGCCAACAT CCTTGGCAGC AATGTTATTT CCGATAATGG CACCCAGATT
301      CAAGCAGGCA ATCATGTTCG CATTGGTACA ACCCAAACTC AAAGCCAAAG
351      CGAAACCTAT CATCAAACCC AGAAATCAGG ATTGATGAGT GCAGGTATCG
401      GCTTCACTAT TGGCAGCAAG ACAAACACAC AAGAAAACCA ATCCCAAAGC
451      AACGAACATA CAGGCAGTAC CGTAGGCAGC TTGAAAGGCG ATACCACCAT
501      TGTTGCAGGC AAACACTACG AACAAATCGG CAGTACCGTT TCCAGCCCGG
551      AAGGCAACAA TACCATCTAT GCCCAAAGCA TAGACATTCA AGCGGCACAC
601      AACAAATTAA ACAGTAATAC CACCCAAACC TATGAACAAA AAGG.CTAAC
651      GGTGGCATTC AGTTCGCCCG TTACCGATTT GGCACAACAA ...
```

This corresponds to the amino acid sequence (SEQ ID NO: 518; ORF117):

```
  1    ..SGNNLNAKAA EVSSANGTLA VSANNDINIS AGINTTHVDD ASKHTGRSGG
 51      GNKLVITDKA QSHHETAQSS TFEGKQVVLQ AGNDANILGS NVISDNGTQI
101      QAGNHVRIGT TQTQSQSETY HQTQKSGLMS AGIGFTIGSK TNTQENQSQS
151      NEHTGSTVGS LKGDTTIVAG KHYEQIGSTV SSPEGNNTIY AQSIDIQAAH
201      NKLNSNTTQT YEQKXLTVAF SSPVTDLAQQ ...
```

Computer analysis of this amino acid sequence gave the following results:

Homology with the pspA Putative Secreted Protein (SEQ ID NO: 1143) of *N.meningitidis* (Accession Number AF030941)

ORF117 (SEQ ID NO: 518) and pspA protein (SEQ ID NO: 1143) show 45% aa identity in 224aa overlap:

```
Orf117:    4 NLNAKAAEVSSANGTLAVSANNDINISAGINTTHVDDASKHTGRSGGGNKLVITDKAQSH   63
             ++ +AAEV S  G L ++A  DI + AG    T  +DA K+TGRSGGG K    +T   ++
pspA:   1173 DIRIRAAEVGSEQGRLKLAAGRDIKVEAGKAHTETEDALKYTGRSGGGIKQKMTRHLKNQ 1232

Orf117:   64 HETAQSSTFEGKQVVLQAGNDANILGSNVISDNGTQIQAGNHVRIGTTQTQSQSETYHQT  123
             +  A S T +GK+++L +G D  +  GSN+I+DN T + A N++ +    +T+S+S   ++
pspA:   1233 NGQAVSGTLDGKEIILVSGRDITVTGSNIIADNHTILSAKNNIVLKAAETRSRSAEMNKK 1292

Orf117:  124 QKSGLM-SAGIGFTIGSKTNTQENQSQSNEHTGSTVGSLKGDTTIVAGKHYEQIGSTVSS  182
             +KSGLM S GIGFT GSK +TQ N+S++  HT S VGSL G+T  I AGKHY Q GST+SS
pspA:   1293 EKSGLMGSGGIGFTAGSKKDTQTNRSETVSHTESVVGSLNGNTLISAGKHYTQTGSTISS 1352

Orf117:  183 PEGNNTIYAQSIDIQAAHNKLNSNTTQTYEQKXLTVAFSSPVTD                 226
             P+G+  I +  I I AA N+ +  + Q  YEQK   +TVA S PV +
pspA:   1353 PQGDVGISSGKISIDAAQNRYSQESKQVYEQKGVTVAISVPVVN                1396
```

Homology with a Predicted ORF from *N.gonorrhoeae*

ORF117 (SEQ ID NO: 518) shows 90% identity over a 230aa overlap with a predicted ORF (ORF117ng) (SEQ ID NO: 520) from *N.gonorrhoeae*:

```
orf117.pep                             SGNNLNAKAAEVSSANGTLAVSANNDINIS   30
                                       ||||||||||||:||:|||| |:|||:||
orf117ng   IHFDADNHTIRGSTNEVGSSIQTKGDVTLLSGNNLNAKAAEVGSAKGTLAVYAKMDITIS  480 orf117.pep AGINTTHVDDASKHTGRSGGGNKLVITDKAQSHHETAQSSTFEGKQVVLQAGNDANILGS   90
           :||::  :||||||||||||||||||||||||||||||||||||||||||||||||||||
orf117ng   SGIHAGQVDDASKHTGRSGGGNKLVITDKAQSHHETAQSSTFEGKQVVLQAGNDANILGS  540 orf117.pep NVISDNGTQIQAGNHVRIGTTQTQSQSETYHQTQKSGLMSAGIGFTIGSKTNTQENQSQS  150
           ||||||||:|||||||||||||||||||||||||||||||||||||||||||||||||||
orf117ng   NVISDNGTRIQAGNHVRIGTTQTQSQSETYHQTQKSGLMSAGIGFTIGSKTNTQENQSQS  600 orf117.pep NEHTGSTVGSLKGDTTIVAGKHYEQIGSTVSSPEGNNTIYAQSIDIQAAHNKLNSNTTQT  210
           ||||||||||||||||||:||||| ||:|||||||| | :||:|| ||:|||:||||
orf117ng   NEHTGSTVGSLKGDTTIVASKHYEQTGSNVSSPEGNNLISTQSMDIGAAQNQLNSKTTQT  660 orf117.pep YEQKXLTVAFSSPVTDLAQQ                                         230
           |||| ||||||||||||||||
orf117ng   YEQKGLTVAFSSPVTDLAQQAIAVAHKAAKQFDKAKTTALMPWRLPMQVGRLFKQAKAPK  720
```

An ORF117ng nucleotide sequence (SEQ ID NO: 519) was predicted to encode a protein having amino acid sequence (SEQ ID NO: 520):

```
  1  ..LLVQTEKDGL HNEQTFGEKK VFSENGKLHN YWRARRKGHD ETGHREQNYT

51    LPEEITRDIS LGSFAYESHS KALSRHAPSQ GTELPQSNRD NIRTAKSNGI

101    SLPYTPNSFT PLPGSSLYII NPANKGYLVE TDPRFANYRQ WLGSDYMLGS

151    LKLDPNNLHK RLGDGYYEQR LINEQIAELT GHRRLDGYQN DEEQFKALMD

201    NGATAARSMN LSVGIALSAE QAAQLTSDIV WLVQKEVKLP DGGTQTVLMP

251    QVYVRVKNGG IDGKGALLSG SNTQINVSGS LKNSGTIAGR NALIINTDTL

301    DNIGGRIHAQ KSAVTATQDI NNIGGILSAE QTLLLNAGNN INNQSTAKSS

351    QNAQGSSTYL DRMAGIYITG KEKGVLAAQA GKDINIIAGQ ISNQSDQGQT

401    RLQAGRDINL DTVQTGKYQE IHFDADNHTI RGSTNEVGSS IQTKGDVTLL
```

```
                          -continued
451     SGNNLNAKAA EVGSAKGTLA VYAKNDITIS SGIHAGQVDD ASKHTGRSGG

501     GNKLVITDKA QSRHETAQSS TFEGKQVVLQ AGNDANILGS NVISDNGTRI

551     QAGNHVRIGT TQTQSQSETY HQTQKSGLMS AGIGFTIGSK TNTQENQSQS

601     NEHTGSTVGS LKGDTTIVAS KHYEQTGSNV SSPEGNNLIS TQSMDIGAAQ

651     NQLNSKTTQT YEQKGLTVAF SSPVTDLAQQ AIAVAHKAAK QFDKAKTTAL

701     MPWRLPNQVG RLFKQAKAPK K*
```

Further work revealed the following gonococcal partial DNA sequence (SEQ ID NO: 521):

```
   1    TTGCTTGTGC AAACAGAAAA AGACGGTTTG CATAACGAGC AAACCTTTGG

51    CGAGAAGAAA GTCTTCAGCG AAAATGGTAA GTTGCACAAC TACTGGCGTG

101    CGCGTCGTAA AGGACATGAT GAAACAGGGC ATCGTGAACA AAATTATACT

151    TTGCCGGAGG AAATCACACG CGACATTTCA CTGGGTTCAT TTGCCTATGA

201    ATCGCATAGC AAAGCATTAA GCCGTCATGC GCCCAGCCAA GGCACTGAGT

251    TGCCACAAAG TAACCGGGAT AATATCCGTA CTGCCAAAAG CAACGGTATT

301    TCGCTACCCT ATACGCCCAA TTCTTTTACC CCATTACCCG GCAGCAGCTT

351    ATACATTATC AATCCTGCCA ATAAAGGCTA TCTTGTTGAA ACCGATCCAC

401    GCTTTGCCAA CTACCGTCAA TGGTTGGGTA GTGACTATAT GCTGGGCAGC

451    CTCAAACTAG ACCCAAACAA TTTACATAAA CGTTTGGGTG ATGGTTATTA

501    CGAGCAACGT TTAATCAATG AACAAATCGC AGAGCTGACA GGGCATCGTC

551    GTTTAGACGG TTATCAAAAC GACGAAGAAC AATTTAAAGC CTTAATGGAT

601    AATGGCGCGA CTGCGGCACG TTCGATGAAT CTCAGCGTTG GCATTGCATT

651    AAGTGCCGAG CAAGCAGCGC AACTGACCAG CGATATTGTT TGGTTGGTAC

701    AAAAAGAAGT TAAACTTCCT GATGGCGGCA CACAAACCGT ATTGATGCCA

751    CAGGTTTATG TACGCGTTAA AAATGGCGGC ATAGACGGTA AAGGTGCATT

801    GTTGTCAGGC AGCAATACAC AAATCAATGT TTCAGGCAGC CTGAAAAACT

851    CAGGCACGAT TGCAGGGCGC AATGCGCTTA TTATCAATAC CGATACGCTA

901    GACAATATCG GTGGGCGTAT TCATGCGCAA AAATCAGCGG TTACGGCCAC

951    ACAAGACATC AATAATATTG GCGGCATTCT TTCTGCCGAA CAGACATTAT

1001    TGCTCAATGC GGGTAACAAC ATCAACAACC AAAGCACGGC CAAGAGCAGT

1051    CAAAATGCAC AAGGTAGCAG CACCTACCTA GACCGAATGG CAGGTATTTA

1101    TATCACAGGC AAAGAAAAAG GTGTTTTAGC AGCGCAGGCA GGCAAAGACA

1151    TCAACATCAT TGCCGGTCAA ATCAGCAATC AATCAGATCA AGGGCAAACC

1201    CGGCTGCAGG CAGGACGCGA CATTAACCTG GATACGGTAC AAACCGGCAA

1251    ATATCAAGAA ATCCATTTTG ATGCCGATAA CCATACCATC CGAGGTTCAA

1301    CGAACGAAGT CGGCAGCAGC ATTCAAACAA AAGGCGATGT TACCCtatTG

1351    TCAGGGAATA ATCTCAATGC CAAAGCTGCC GAAGTCGGCA GCGCAAAAGG

1401    CACACTTGCC GTGTATGCTA AAAATGACAT TACTATCAGC TCAGGCATCC

1451    ATGCCGGCCA AGTTGATGAT GCGTCCAAAC ATACAGGCAG AAGCGGCGGC

1501    GGTAATAAAT TAGTCATTAC CGATAAAGCC CAAAGTCATC ACGAAACTGC
```

```
-continued
1551  TCAAAGCAGC ACCTTTGAAG GCAAGCAAGT TGTATTGCAG GCAGGAAACG

1601  ATGCCAACAT CCTTGGCAGT AATGTTATTT CCGATAATGG CACCCGGATT

1651  CAAGCAGGCA ATCATGTTCG CATTGGTACA ACCCAAACTC AAAGCCAAAG

1701  CGAAACCTAT CATCAAACCC AAAAATCAGG ATTGATGAGT GCAGGTATCG

1751  GCTTCACTAT TGGCAGCAAG ACAAACACAC AAGAAAACCA ATCCCAAAGC

1801  AACGAACATA CAGGCAGTAC CGTAGGCAGC CTGAAAGGCG ATACCACCAT

1851  TGTTGCAAGC AAACACTACG AACAAACCGG CAGCAACGTT TCCAGCCCTG

1901  AGGGCAACAA CCTTATCAGC ACGCAAAGTA TGGATATTGG CGCAGCACAA

1951  AACCAATTAA ACAGCAAAAC CACCCAAACC TACGAACAAA AAGGCTTAAC

2001  GGTGGCATTC AGTTCGCCCG TTACCGATTT GGCACAACAA GCGATTGCCG

2051  TAGCACACAA AGCAGCAAAC AAGTCGGACA AAGCAAAAAC GACCGCGTTA

2101  ATGCCATGGC GGCTGCCAAT GCAGGTTGGC AGGCCTATCA AACAGGCAAA

2151  GGCGCACAAA ACTTAG
```

This corresponds to the amino acid sequence (SEQ ID NO: 522; ORF117ng-1):

```
  1  LLVQTEKDGL HNEQTFGEKK VFSENGKLHN YWRARRKGHD ETGHREQNYT
 51  LPEEITRDIS LGSFAYESHS KALSRHAPSQ GTELPQSNRD NIRTAKSNGI
101  SLPYTPNSFT PLPGSSLYII NPANKGYLVE TDPRFANYRQ WLGSDYMLGS
151  LKLDPNNLHK RLGDGYYEQR LINEQIAELT GHRRLDGYQN DEEQFKALMD
201  NGATAARSMN LSVGIALSAE QAAQLTSDIV WLVQKEVKLP DGGTQTVLMP
251  QVYVRVKNGG IDGKGALLSG SNTQINVSGS LKNSGTIAGR NALIINTDTL
301  DNTGGRIHAQ KSAVTATQDI NNIGGILSAE QTLLLNAGNN INNQSTAKSS
351  QNAQGSSTYL DRMAGIYITG KEKGVLAAQA GKDINIIAGQ ISNQSDQGQT
401  RLQAGRDINL DTVQTGKYQE IHFDADNHTI RGSTNEVGSS IQTKGDVTLL
451  SGNNLNAKAA EVGSAKGTLA VYAKNDITIS SGIHAGQVDD ASKHTGRSGG
501  GNKLVITDKA QSHHETAQSS TEEGKQVVLQ AGNDANILGS NVISDNGTRI
551  QAGNHVRIGT TQTQSQSETY HQTQKSGLMS AGIGFTIGSK TNTQENQSQS
601  NEHTGSTVGS LKGDTTIVAS KHYEQTGSNV SSPEGNNLIS TQSMDIGAAQ
651  NQLNSKTTQT YEQKGLTVAF SSPVTDLAQQ AIAVAHKAAN KSDKAKTTAL
701  MPWRLPMQVG RPIKQAKAHK T*
```

ORF117ng-1 (SEQ ID NO: 522) shows the same 90% identity over a 230aa overlap with ORF117 (SEQ ID NO: 518). In addition, it shows homology with a secreted *N.meningitidis* protein (SEQ ID NO: 1143) in the database:

```
gi|2623258 (AF030941) putative secreted protein [Neisseria meningitidis]Length = 2273
Score = 604 bits (1541), Expect = e-172
Identities = 325/678 (47%), Positives = 449/678 (65%), Gaps = 22/678 (3%)

Query:    1  LLVQTEKDGLHNEQTFGEKKVFSENGKLHNYWRARRKGHDETGHREQNYTLPEEITRDIS    60
             L+V T +  L N++T G K + ++ G LH Y R  +KG D TG+     Y    E++  I
Sbjct:  739  LIVGTPESALDNDETLGTKTI-TDKGDLHRYHRHHKKGRDSTGYDRDPYEPAPEVS-SIR   796

Query:   61  LGSFAYESHSKALSRHAPSQGTELPQSNRDNIRTAKSNGISLPYTPNSFTPLPGSSLYII   120
             +G  AY+ +           AP Q +++P +    +   NGI  +T      LP SSL+ I
Sbjct:  797  MGISAYKGY-------APQQASDIPGTV---VPVVAENGIHPTFT------LPNSSLFAI   840
```

```
-continued gi|2623258 (AF030941) putative secreted protein [Neisseria meningitidis]Length = 2273
Score = 604 bits (1541), Expect = e-172
Identities = 325/678 (47%), Positives = 449/678 (65%), Gaps = 22/678 (3%)

Query:    121  NPANKGYLVETDPRFANYRQWLGSDYMLGSLKLDPNNLHKRLGDYYEQRLINEQIAELT       180
               P NKGYL+ETDP F +YR+WLGS YML L+ DPN++HKRLFDGYYEQ+L+NEQIA+LT
Sbjct:    841  APNNKGYLIETDPAFTDYRKWLGSGYMLAALQQDPNHIHKRLGDYYEQKLVNEQIAKLT       900

Query:    181  GHRRLDGYQNDEEQFKALMDNGATAARSMNLSVGIALSAEQAAQLTSDIVWLVQKEVKLP       240
               G+RRLDGY NDEEQFKALMDNG T A+ + L+ GIALSAEQ A+LTSDIVWL + V LP
Sbjct:    901  GYRRLDGYTNDEEQFKALMDNGITIAKELQLTPGIALSAEQVARLTSDIVWLENETVTLP       960

Query:    241  DGGTQTVLMPQVYVRVKNGGIDGKGALLSGSNTQINVSGSLKN-SGTIAGRNALIINTDT       299
               DG TQTVL P+VYVR + ++G+GALLSGS  I  SG+++N G IAGR ALI+N
Sbjct:    961  DGTTQTVLKPKVYVRARPKDMNGQGALLSGSVVDIG-SGAIENRGGLIAGREALILNAQN      1019

Query:    300  LDNIGGRIHAQKSAVTATQDINNIGGILSAEQTLLLNAGNNINNQSTAKSSQNAQGSSTY       359
               + N+ G + +    A DI N G I AE LLL A NNI ++S +S+QN QGS
Sbjct:   1020  IKNLQGDLQGKNIFAAAGSDITNTGSI-GAENALLLKASNNIESRSETRSNQNEQGSVRN      1078

Query:    360  LDRMAGIYITGKEKGVLAAQAGKDINIIAGQISNQSDQGQTRLQAGRDINLDTVQTGKYQ       419
               + R+AGIY+TG++ G +   AG +I + A +++NQS+ GQT L AG DI    DT    + Q
Sbjct:   1079  IGRVAGIYLTGRQNGSVLLDAGNNIVLTASELTNQSEDGQTVLNAGGDIRSDTTGISRNQ      1138

Query:    420  EIHFDADNHTIRGSTNEVGSSIQTKGDVTLLSGNNLNAKAAEVGSAKGTLAVYAKNDITI       479
                   FD+DN+ IR      NEVGS+I+T+G+++L +   ++ +AAEVGS +G L + A  DI +
Sbjct:   1139  NTIFDSDNYVIRKEQNEVGSTIRTRGNLSLNAKGDIRIRAAEVGSEQGRLKLAAGRDIKV      1198

Query:    480  SSGIHAGQVDDASKHTGRSGGGNKLVITDKAQSHHETAQSSTFEGKQVVLQAGNDANILG       539
               +G   + +DA K+TGRSGGG K +T ++ + A S T +GK+++L +G D   + G
Sbjct:   1199  EAGKAHTETEDALKYTGRSGGGIKQKMTRHLKNQNGQAVSGTLDGKEIILVSGRDITVTG      1258

Query:    540  SNVISDNGTRIQAGNHVRIGTTQTQSQSETYHQTQKSGLM-SAGIGFTIGSKTNTQENQS       598
               SN+I+DN T + A N++ +   +T+S+S     ++ +KSGLM S GIGFT GSK +TQ N+S
Sbjct:   1259  SNIIADNHTILSAKNNIVLKAAETRSRSAEMNKKEKSGLMGSGGIGFTAGSKKDTQTNRS      1318

Query:    599  QSNEHTGSTVGSLKGDTTIVASKHYEQTGSNVSSPEGNNLISTQSMDIGAAQNQLNSKTT       658
               ++  HT S VGSL G+T I A KHY QTGS +SSP+G+  IS+ + I AAQN+ + ++
Sbjct:   1319  ETVSHTESVVGSLNGNTLISAGKHYTQTGSTISSPQGDVGISSGKISIDAAQNRTSQESK      1378

Query:    659  QTYEQKGLTVAFSSPVTD                                              676
               Q YEQKG+TVA S PV +
Sbjct:   1379  QVYEQKGVTVAISVPVVN                                             1396
```

Based on this analysis, it is predicted that the proteins from *N.meningitidis* and *N.gonorrhoeae*, and their epitopes, could be useful antigens for vaccines or diagnostics, or for raising antibodies.

Example 63

The following partial DNA sequence was identified in *N.meningitidis* (SEQ ID NO: 523):

```
  1  ATGATTTACA TCGTACTGTT TCTAGCTGTC GTCCTCGCCG TTGTCGCCTA
 51  CAACATGTAT CAGGAAAACC AATACCGCAA AAAAGTGCGC GACCAGTTCG
101  GACACTCCGA CAAAGATGCC CTGCTCAACA GCAwAACCAG CCATGTCCGC
151  GACGGCAAAC CGTCCGGCGG GTCAGTCATG ATGCCGAAAC CCCAACCGGC
201  GGTCAAAAAA ACGGCAAAAC CCCAAGACCC CGyCATGCGC AACCTGCAAG
251  AACAGGATGC CGTCTACATC GCCAAGCAGA AACAGGCAAA AGCCTCCCCG
301  TTCAAAACCG AAATCGAAAC CGCCTTGGAA GAAAGCGGCA TTATCGGCAA
351  CTCCGCCCAC ACCGTTTCCG AACCCCAAAC CGGACATTCC GCAACGAAAC
401  CTGCCGACGC GTCGGCAAAA CCTGCACCCG TTCCGCAAAC ACCTGCAAAA
451  CCGCTGATTA CGCTCAAAGA ACTGTCAAAA GTCGAATTAT CCTGGTTTGA
501  CGTGCGCATC GACTTCATCT CCTAT...
```

This corresponds to the amino acid sequence (SEQ ID NO: 524; ORF119):

```
  1 MIYIVLFLAV VLAVVAYNMY QENQYRKKVR DQFGHSDKDA LLNSXTSHVR
 51 DGKPSGGSVM MPKPQPAVKK TAKPQDPXMR NLQEQDAVYI AKQKQAKASP
101 FKTEIETALE ESGIIGNSAH TVSEPQTGHS ATKPADASAK PAPVPQTPAK
151 PLITLKELSK VELSWFDVRI DFISY...
```

Further work revealed the complete nucleotide sequence (SEQ ID NO: 525):

```
   1 ATGATTTACA TCGTACTGTT TCTAGCTGTC GTCCTCGCCG TTGTCGCCTA
  51 CAACATGTAT CAGGAAAACC AATACCGCAA AAAAGTGCGC GACCAGTTCG
 101 GACACTCCGA CAAAGATGCC CTGCTCAACA GCAAAACCAG CCATGTCCGC
 151 GACGGCAAAC CGTCCGGCGG GTCAGTCATG ATGCCGAAAC CCAACCGGC
 201 GGTCAAAAAA ACGGCAAAAC CCCAAGACCC CGCCATGCGC AACCTGCAAG
 251 AACAGGATGC CGTCTACATC GCCAAGCAGA AACAGGCAAA AGCCTCCCCG
 301 TTCAAAACCG AAATCGAAAC CGCCTTGGAA GAAAGCGGCA TTATCGGCAA
 351 CTCCGCCCAC ACCGTTTCCG AACCCCAAAC CGGACATTCC GCACCGAAAC
 401 CTGCCGACGC GCCGGCAAAA CCTGCACCCG TTCCGCAAAC ACCTGCAAAA
 451 CCGCTGATTA CGCTCAAAGA ACTGTCAAAA GTCGAATTAC CTGGTTTGA
 501 CGTGCGCTTC GACTTCATCT CCTATATCGC GCTGACCGAA GCCAAAGAAC
 551 TGCACGCACT GCCGCGCCTT TCCAACCGCT GCCGCTACCA GATTGTCGGC
 601 TGCACCATGG ACGACCATTT CCAGATTGCC GAACCCATCC CGGGCATCCG
 651 CTATCAGGCA TTTATCGTGG GTATTCAGGC AGTCAGCCGC AACGGACTTG
 701 CCTCGCAGGA AGAACTCTCC GCATTCAACC GCCAGGTGGA CGCATTCGCA
 751 CAAAGCATGG GCGGTCAGAC GCTGCACACC GACCTTGCCG CCTTTATCGA
 801 AGTGGCTTCC GCACTGGACG CATTCTGCGC GCGCGTCGAC CAGACCATCG
 851 CCATCCATTT GGTTTCCCCG ACCAGCATCA GCGGCGTAGA ACTGCGTTCC
 901 GCCGTAACGG GCGTGGGTTT CGTTTTGGAA GACGACGGCG CGTTCCACTA
 951 TACCGACACG TCGGGCTCGA CCATGTTCTC CATCTGCTCG CTCAACAACG
1001 AGCCGTTTAC CAACGCCCTT TTGGACAACC AGTCCTACAA AGGCTTCAGT
1051 ATGCTGCTCG ACATCCCGCA CTCTCCGGCA GGCGAAAAAA CCTTCGACGA
1101 TTTGTTTATG GATTTGGCGG TACGCCTGTC CGGCCAGTTG AACCTGAATC
1151 TGGTCAACGA CAAAATGGAA GAAGTTTCGA CCCAATGGCT CAAAGACGTG
1201 CGCACTTATG TATTGGCGCG TCAGTCCGAG ATGCTCAAAG TCGGTATCGA
1251 ACCGGGCGGC AAAACCGCAT TGCGCCTGTT CTCCTAA
```

This corresponds to the amino acid sequence (SEQ ID NO: 526; ORF119-1):

```
  1 MIYIVLFLAV VLAVVAYNMY QENQYRKKVR DQFGHSDKDA LLNSKTSHVR
 51 DGKPSGGSVM MPKPQPAVKK TAKPQDPAMR NLQEQDAVYI AKQKQAKASP
```

```
101  FKTEIETALE  ESGIIGNSAH  TVSEPQTGHS  APKPADAPAK  PAPVPQTPAK

151  PLITLKELSK  VELPWFDVRF  DFISYIALTE  AKELHALPRL  SNRCRYQIVG

201  CTMDDHFQIA  EPIPGIRYQA  FIVGIQAVSR  NGLASQEELS  AFNRQVDAFA

251  QSMGGQTLHT  DLAAFIEVAS  ALDAFCARVD  QTIAIHLVSP  TSISGVELRS

301  AVTGVGFVLE  DDGAFHYTDT  SGSTMFSICS  LNNEPFTNAL  LDNQSYKGFS

351  MLLDIPHSPA  GEKTFDDLFM  DLAVRLSGQL  NLNLVNDKME  EVSTQWLKDV

401  RTYVLARQSE  MLKVGIEPGG  KTALRLFS*
```

Computer analysis of this amino acid sequence gave the following results:
Homology with a Predicted ORF from *N.meningitidis* (Strain A ORF119 (SEQ ID NO: 524) shows 93.7% identity over a 175aa overlap with an ORF (ORF119a) (SEQ ID NO: 528) from strain A of *N. meningitidis*:

```
                    10         20         30         40         50         60
orf119.pep  MIYIVLFLAVVLAVVAYNMYQENQYRKKVRDQFGHSDKDALLNSXTSHVRDGKPSGGSVM
            ||||||||| :|||||||||||||||||||||||||||||||| ||||||||||||| ||
orf119a     MIYIVLFLAAVLAVVAYNMYQENQYRKKVRDQFGHSDKDALLNSKTSHVRDGKPSGGPVM
                    10         20         30         40         50         60

70         80         90        100        110        120
orf119.pep  MPKPQPAVKKTAKPQDPXMRNLQEQDAVYIAKQKQAKASPFKTEIETALEESGIIGNSAH
            ||||||||||||| ||| ||||||||||||||||||||||||||||||||||||||||||
orf119a     MPKPQPAVKKTAKSQDPAMRNLQEQDAVYIAKQKQAKASPFKTEIETALEESGIIGNSAH
                    70         80         90        100        110        120

130        140        150        160        170
orf119.pep  TVSEPQTGHSATKPADASAKPAPVPQTPAKPLITLKELSKVELSWFDVRIDFISY
            || ||||||||| ||||| :||||||||||||||||||||||| |||||| ||||
orf119a     TVPEPQTGHSAPKPADAPAKPVPVPQTPAKPLITLKELSKVELPWFDVRFDFISYIALTE
                   130        140        150        160        170        180 orf119a     AKELHALPRLSNRCRYQIVGCTMDDHFQIAEPIPGIRYQAFIVGIQAVSRNGLASQEELS
                   190        200        210        220        230        240
```

The complete length ORF119a nucleotide sequence (SEQ ID NO: 527) is:

```
  1  ATGATTTACA  TCGTACTGTT  CCTCGCCGCC  GTCCTCGCCG  TTGTCGCCTA

51  CAATATGTAT  CAGGAAAACC  AATACCGCAA  AAAAGTGCGC  GACCAGTTCG

101  GGCACTCCGA  CAAAGATGCC  CTGCTCAACA  GCAAAACCAG  CCATGTCCGC

151  GACGGCAAAC  CGTCCGGCGG  GCCAGTCATG  ATGCCGAAAC  CCCAACCGGC

201  GGTCAAAAAA  ACGGCAAAAT  CCCAAGACCC  CGCCATGCGC  AACCTGCAAG

251  AGCAGGATGC  CGTCTACATC  GCCAAGCAGA  AACAGGCAAA  AGCCTCCCCG

301  TTCAAAACCG  AAATCGAAAC  CGCCTTGGAA  GAAAGCGGCA  TTATCGGCAA

351  CTCCGCCCAC  ACCGTTCCCG  AACCCCAAAC  CGGACATTCC  GCACCAAAAC

401  CTGCCGACGC  GCCGGCAAAA  CCTGTTCCCG  TTCCGCAAAC  GCCGGCAAAA

451  CCGCTGATTA  CGCTCAAAGA  GCTGTCGAAG  GTCGAGCTGC  CCTGGTTTGA

501  CGTGCGCTTC  GACTTCATCT  CTTATATCGC  GCTGACCGAA  GCCAAAGAAC

551  TGCACGCACT  GCCGCGCCTT  TCCAACCGCT  GCCGCTACCA  GATTGTCGGC

601  TGCACCATGG  ACGACCATTT  CCAGATTGCC  GAACCCATCC  CGGGCATCCG

651  CTATCAGGCA  TTTATCGTGG  GTATTCAGGC  AGTCAGCCGC  AACGGACTTG
```

-continued

```
 701   CCTCGCAGGA AGAACTCTCC GCATTCAACC GCCAGGTGGA TGCATTCGCA
 751   CACAGCATGG GCGGTCAGAC GCTGCACACC GACCTTGCCG CCTTTATCGA
 801   AGTGGCTTCC GCACTGGACG CATTCTGCGC GCGCGTCGAC CAGACTATCG
 851   CCATCCATTT GGTTTCCCCG ACCAGCATCA GCGGCGTAGA ACTGCGTTCC
 901   GCCGTAACGG GCGTGGGTTT CGTTTTGGAA GACGACGGCG CGTTCCACTA
 951   TACCGACACG TCGGGCTCGA CCATGTTCTC CATCTGCTCG CTCAACAACG
1001   AGCCGTTTAC CAATGCCCTT TTGGACAACC AGTCCTATAA AGGCTTCAGT
1051   ATGCTGCTCG ACATCCCGCA CTCTCCGGCA GGCGAAAAAA CCTTCGACGA
1101   TTTGTTTATG GATTTGGCGG TACGCCTGTC CGGCCAGTTG AACCTGAATC
1151   TGGTCAACGA CAAAATGGAA GAAGTTTCGA CCCAATGGCT CAAAGACGTG
1201   CGCACTTATG TATTGGCTCG TCAGTCCGAG ATGCTCAAAG TCGGTATCGA
1251   ACCGGGCGGC AAAACCGCAT TGCGCCTGTT CTCCTAA
```

This encodes a protein having amino acid sequence (SEQ ID NO: 528):

```
  1  MIYIVLFLAA VLAVVAYNMY QENQYRKKVR DQFGHSDKDA LLNSKTSHVR
 51  DGKPSGGPVM MPKPQPAVKK TAKSQDPAMR NLQEQDAVYI AKQKQAKASP
101  FKTEIETALE ESGIIGNSAH TVPEPQTGHS APKPADAPAK PVPVPQTPAK
151  PLITLKELSK VELPWFDVRF DFISYIALTE AKELHALPRL SNRCRYQIVG
201  CTMDDHFQIA EPIPGIRYQA FIVGIQAVSR NGLASQEELS AFNRQVDAFA
251  HSMGGQTLHT DLAAFIEVAS ALDAFCARVD QTIAIHLVSP TSISGVELRS
301  AVTGVGFVLE DDGAFHYTDT SGSTMFSICS LNNEPFTNAL LDNQSYKGFS
351  MLLDIPHSPA GEKTFDDLFM DLAVRLSGQL NLNLVNDKME EVSTQWLKDV
401  RTYVLARQSE MLKVGIEPGG KTALRLFS*
```

ORF119a (SEQ ID NO: 528) and ORF119-1 (SEQ ID NO: 526) show 98.6% identity in 428 aa overlap:

```
                    10         20         30         40         50         60
orf119a.pep MIYIVLFLAAVLAVVAYNMYQENQYRKKVRDQFGHSDKDALLNSKTSHVRDGKPSGGPVM
            ||||||||:||||||||||||||||||||||||||||||||||||||||||||||| ||
orf119-1    MIYIVLFLAVVLAVVAYNMYQENQYRKKVRDQFGHSDKDALLNSKTSHVRDGKPSGGSVM
                    10         20         30         40         50         60

70         80         90        100        110        120
orf119a.pep MPKPQPAVKKTAKSQDPAMRNLQEQDAVYIAKQKQAKASPFKTEIETALEESGIIGNSAH
            ||||||||||||| |||||||||||||||||||||||||||||||||||||||||||||
orf119-1    MPKPQPAVKKTAKPQDPAMRNLQEQDAVYIAKQKQAKASPFKTEIETALEESGIIGNSAH
                    70         80         90        100        110        120

130        140        150        160        170        180
orf119a.pep TVPEPQTGHSAPKPADAPAKPVPVPQTPAKPLITLKELSKVELPWFDVRFDFISYIALTE
            || ||||||||||||||||||:||||||||||||||||||||||||||||||||||||||
orf119-1    TVSEPQTGHSAPKPADAPAKPAPVPQTPAKPLITLKELSKVELPWFDVRFDFISYIALTE
                   130        140        150        160        170        180

190        200        210        220        230        240
orf119a.pep AKELHALPRLSNRCRYQIVGCTMDDHFQIAEPIPGIRYQAFIVGIQAVSRNGLASQEELS
            ||||||||||||||||||||||||||||||||||||||||||||||||||||||||||||
orf119-1    AKELHALPRLSNRCRYQIVGCTMDDHFQIAEPIPGIRYQAFIVGIQAVSRNGLASQEELS
                   190        200        210        220        230        240
```

```
                       250        260        270        280        290        300
orf119a.pep   AFNRQVDAFAHSMGGQTLHTDLAAFIEVASALDAFCARVDQTIAIHLVSPTSISGVELRS
              |||||||||:||||||||||||||||||||||||||||||||||||||||||||||||
orf119-1      AFNRQVDAFAQSMGGQTLHTDLAAFIEVASALDAFCARVDQTIAIHLVSPTSISGVELRS
                       250        260        270        280        290        300

310        320        330        340        350        360
orf119a.pep   AVTGVGFVLEDDGAFHYTDTSGSTMFSICSLNNEPFTNALLDNQSYKGFSMLLDIPHSPA
              ||||||||||||||||||||||||||||||||||||||||||||||||||||||||||||
orf119-1      AVTGVGFVLEDDGAFHYTDTSGSTMFSICSLNNEPFTNALLDNQSYKGFSMLLDIPHSPA
                       310        320        330        340        350        360

370        380        390        400        410        420
orf119a.pep   GEKTFDDLFMDLAVRLSGQLNLNLVNDKMEEVSTQWLKDVRTYVLARQSEMLKVGIEPGG
              ||||||||||||||||||||||||||||||||||||||||||||||||||||||||||||
orf119-1      GEKTFDDLFMDLAVRLSGQLNLNLVNDKMEEVSTQWLKDVRTYVLARQSEMLKVGIEPGG
                       370        380        390        400        410        420

429
orf119a.pep   KTALRLFSX
              |||||||||
crf119-1      KTALRLFSX
```

Homology with a Predicted ORF from *N.gonorrhoeae*
ORF119 (SEQ ID NO: 524) shows 93.1% identity over a 175aa overlap with a predicted ORF (ORF119ng) (SEQ ID NO: 530) from *N.gonorrhoeae*:

```
orf119.pep   MIYIVLFLAVVLAVVAYNMYQENQYRKKVRDQFGHSDKDALLNSXTSHVRDGKPSGGSVM   60
             ||||||||:|||||||||||||||||||||||||||||||||||| ||||||||||| ||
orf119ng     MIYIVLFLAAVLAVVAYNMYQENQYRKKVRDQFGHSDKDALLNSKTSHVRDGKPSGGPVM   60 orf119.pep   MPKPQPAVKKTAKPQDPXMRNLQEQDAVYIAKQKQAKASPFKTEIETALEESGIIGNSAH  120
             |||||||||| ||||| ||||||||||||||||||||||||||||||||||| ||||||
orf119ng     MPKPQPAVKKPAKPQDSAMRNLQEQDAVYIAKQKQAKASPFKTEIETALEEIGIIGNSAH  120 orf119.pep   TVSEPQTGHSATKPADASAKPAPVPQTPAKPLITLKELSKVELSWFDVRIDFISY       175
             |||||||||| ||||| |||:||||||||||||||||||||||| |||||:||||
orf119ng     TVSEPQTGHSAPKPADAPAKPVPVPQTPAKPLITLKELSKVELPWFDVRFDFISYIALTE  180
```

The complete length ORF119ng nucleotide sequence (SEQ ID NO: 529) is:

```
  1   ATGATTTACA TCGTACTGTT CCTCGCCGCC GTCCTCGCCG TTGTCGCCTA

51   CAATATGTAT CAGGAAAACC AATACCGCAA AAAAGTGCGC GACCAGTTCG

101   GACACTCCGA CAAAGATGCC CTGCTCAACA GCAAAACCAG CCATGTCCGC

151   GACGGCAAAC CGTCCGGCGG GCCAGTCATG ATGCCGAAAC CCAACCGGC

201   GGTCAAAAAA CCGGCCAAAC CCAAGACTC CGCCATGCGC AACCTGCAAG

251   AACAGGATGC CGTCTACATC GCCAAGCAGA AACAGGCAAA AGCCTCCCCG

301   TTCAAAACCG AAATCGAAAC CGCCTTGGAA GAAATCGGCA TTATCGGCAA

351   CTCCGCCCAC ACCGTTTCCG AACCCCAAAC CGGACATTCC GCACCGAAAC

401   CTGCCGACGC GCCGGCAAAA CCCGTTCCCG TTCCGCAAAC GCCGGCAAAA

451   CCGCTGATTA CGCTCAAAGA GCTGTCGAAG GTCGAGCTGC CCTGGTTTGA

501   CGTGCGCTtc gACTTCATCT CCTATATCGC GCTGACCGAA GCCAAAGAAC

551   TGCACGCACT GCCGCGCCTT tccAACCGCT GCCGCTACCA GATTGTCGGC

601   TGCACCATGG ACGACCATTT CCAGATTGCC GAACCCATCC CGGGCATCCG

651   CTATCAGGCA TTTATCGTGG GTATCCAGGC AGTCAGCCGC AACGGACTTG

701   CCTCGCAGGA AGAACTCTCC GCATTCAACC GCCAGGCGGA CGCATTCGCA
```

-continued

```
 751  CAAAGCATGG GCGGTCAGAC GCTGCACACC GACCTTGCCG CCTTTATCGA

801  AGTGGCTTCC GCACTGGACG CATTCTGCGC GCGCGTCGAC CAGACCATCG

851  CCATCCATTT GGTTTCGCCG ACCAGCATCA GCGGCGTAGA ACTGCGTTCC

901  GCCGTAACGG GCGTGGGTTT CGTTTTGGAA GACGACGGCG CGTTCCACTA

951  TACCGACACG TCGGGCTCGA CCATGTTCTC CATCTGCTCG CTCAACAACG

1001  AGCCGTTTAC CAATGCCCTT TTGGACAACC AGTCCTACAA AGGCTTCAGT

1051  ATGCTGCTCG ACATCCCGCA CTCTCCGGCA GGCGAAAAAA CCTTCGACGA

1101  TTTGTTTATG GATTTGGCGG TACGCCTGTC CGGTCAGTTG AACCTGAATC

1151  TGGTCAACGA CAAAATGGAA GAAGTTTCGA CCCAATGGCT CAAAGACGTA

1201  CGCACTTATG TATTGGCGCG TCAGTCCGAG ATGCTCAAAG TCGGTATCGA

1251  ACCGGGCGGC AAAACCGCCC TGCGCCTGTT TTCATAA
```

This encodes a protein having amino acid sequence (SEQ ID NO: 530):

```
  1  MIYIVLFLAA VLAVVAYNMY QENQYRKKVR DQFGHSDKDA LLNSKTSHVR

51  DGKPSGGPVM MPKPQPAVKK PAKPQDSAMR NLQEQDAVYI AKQKQAKASP

101  FKTEIETALE EIGIIGNSAH TVSEPQTGHS APKPADAPAK PVPVPQTPAK

151  PLITLKELSK VELPWFDVRF DFISYIALTE AKELHALPRL SNRCRYQIVG

201  CTMDDHFQIA EPIPGIRYQA FIVGIQAVSR NGLASQEELS AFNRQADAFA

251  QSMGGQTLHT DLAAFIEVAS ALDAFCARVD QTIAIHLVSP TSISGVELRS

301  AVTGVGFVLE DDGAFHYTDT SGSTMFSICS LNNEPFTNAL LDNQSYKGFS

351  MLLDIPHSPA GEKTFDDLFM DLAVRLSGQL NLNLVNDKME EVSTQWLKDV

401  RTYVLARQSE MLKVGIEPGG KTALRLFS*
```

ORF119ng (SEQ ID NO: 530) and ORF119-1 (SEQ ID NO: 526) show 98.4% identity over 428 aa overlap:

```
                 10         20         30         40         50         60
orf119ng MIYIVLFLAAVLAVVAYNMYQENQYRKKVRDQFGHSDKDALLNSKTSHVRDGKPSGGPVM
         ||||||||:|||||||||||||||||||||||||||:|||||||||||||||||||| ||
orf119-1 MIYIVLFLAVVLAVVAYNMYQENQYRKKVRDQFGHSKKDALLNSKTSHVRDGKPSGGSVM
                 10         20         30         40         50         60

70         80         90        100        110        120
orf119ng MPKPQPAVKKPAKPQDSAMRNLQEQDAVYIAKQKQAKASPFKTEIETALEEIGIIGNSAH
         |||||||||| ||||| |||||||||||||||||||||||||||||||||  ||||||||
orf119-1 MPKPQPAVKKTAKPQDPAMRNLQEQDAVYIAKQKQAKASPFKTEIETALEESGIIGNSAH
                 70         80         90        100        110        120

130        140        150        160        170        180
orf119ng TVSEPQTGHSAPKPADAPAKPVPVPQTPAKPLITLKELSKVELPWFDVRFDFISYIALTE
         |||||||||||||||||||||:||||||||||||||||||||||||||||||||||||||
orf119-1 TVSEPQTGHSAPKPADAPAKPAPVPQTPAKPLITLKELSKVELPWFDVRFDFISYIALTE
                130        140        150        160        170        180

190        200        210        220        230        240
orf119ng AKELHALPRLSNRCRYQIVGCTMDDHFQIAEPIPGIRYQAFIVGIQAVSRNGLASQEELS
         ||||||||||||||||||||||||||||||||||||||||||||||||||||||||||||
orf119-1 AKELHALPRLSNRCRYQIVGCTMDDHFQIAEPIPGIRYQAFIVGIQAVSRNGLASQEELS
                190        200        210        220        230        240

250        260        270        280        290        300
orf119ng AFNRQADAFAQSMGGQTLHTDLAAFIEVASALDAFCARVDQTIAIHLVSPTSISGVELRS
         |||||:||||||||||||||||||||||||||||||||||||||||||||||||||||||
orf119-1 AFNRQVDAFAQSMGGQTLHTDLAAFIEVASALDAFCARVDQTIAIHLVSPTSISGVELRS
                250        260        270        280        290        300
```

```
                  -continued
             310       320       330       340       350       360
orf119ng AVTGVGFVLEDDGAFHYTDTSGSTMFSICSLNNEPFTNALLDNQSYKGFSMLLDIPHSPA
         ||||||||||||||||||||||||||||||||||||||||||||||||||||||||||
orf119-1 AVTGVGFVLEDDGAFHYTDTSGSTMFSICSLNNEPFTNALLDNQSYKGFSMLLDIPHSPA
             310       320       330       340       350       360

370       380       390       400       410       420
orf119ng GEKTFDDLFMDLAVRLSGQLNLNLVNDKMEEVSTQWLKDVRTYVLARQSEMLKVGIEPGG
         ||||||||||||||||||||||||||||||||||||||||||||||||||||||||||
orf119-1 GEKTFDDLFMDLAVRLSGQLNLNLVNDKMEEVSTQWLKDVRTYVLARQSEMLKVGIEPGG
             370       380       390       400       410       420

429
orf119ng KTALRLFSX
         |||||||||
orf119-1 KTALRLFSX
```

Based on this analysis, including the presence of a putative leader sequence in the gonococcal protein, it is predicted that the proteins from *N.meningitidis* and *N.gonorrhoeae*, and their epitopes, could be useful antigens for vaccines or diagnostics, or for raising antibodies.

Example 64

The following partial DNA sequence was identified in *N.meningitidis* (SEQ ID NO: 531)

```
  1  ..GCGCGGCACG GCACGGAAGA TTTCTTCATG AACAACAGCG ACAC.ATCAG
 51    GCAGATAGTC GAAAGCACCA CCGGTACGAT GAAGCTGCTG ATTTCCTCCA
101    TCGCCCTGAT TTCATTGGTA GTCGGCGGCA TCGGCGTGAT GAACATCATG
151    CTGGTGTCCG TTACCGAGCG CACCAAAGAA ATCGGCATAC GGATGGCAAT
201    CGGCGCGCGG CGCGGCAATA TTTyGCAGCA GTTTTTGATT GAGGCGGTGT
251    TAATCTGCGT CATCGGCGGT TTGGTCGGCG TGGGTTTGTC CGCCGCCGTC
301    AGCCTCGTGT TCAATCATTT TGTAACCGAC TTCCCGATGG ACATTTCCGC
351    CATGTCCGTC ATCGGCGCGG TCGCCTGTTC GACCGGAATC GGCATCGCGT
401    TCGGCTTTAT GCCTGCCAAT AAAGCAGCCA AACTCAATCC GATAGACGCA
451    TTGGCACAGG ATTGA
```

This corresponds to the amino acid sequence (SEQ ID NO: 532; ORF134):

```
  1  ..ARHGTEDFFM NNSDXIRQIV ESTTGTMKLL ISSIALISLV VGGIGVMNIM
 51    LVSVTERTKE IGIRMAIGAR RGNIXQQFLI EAVLICVIGG LVGVGLSAAV
101    SLVFNHFVTD FPMDISAMSV IGAVACSTGI GIAFGFMPAN KAAKLNPIDA
151    LAQD*
```

Further work revealed the complete nucleotide sequence (SEQ ID NO: 533):

```
  1    ATGTCGGTGC AAGCAGTATT GGCGCACAAA ATGCGTTCGC TTCTGACGAT
 51    GCTCGGCATC ATCATCGGTA TCGCGTCGGT GGTTTCCGTC GTCGCATTGG
101    GGAATGGTTC GCAGAAAAAA ATCCTTGAAG ACATCAGTTC GATAGGGACG
151    AACACCATCA GCATCTTCCC GGGGCGCGGC TTCGGCGACA GGCGCAGCGG
201    CAGGATTAAA ACCCTGACCA TAGACGACGC AAAAATCATC GCCAAACAAA
251    GCTACGTTGC TTCCGCCACG CCCATGACTT CGAGCGGCGG CACGCTGACT
```

-continued

```
 301   TACCGCAACA CCGACCTGAC CGCCTCGCTT TACGGCGTGG GCGAACAATA
 351   TTTCGACGTG CGCGGACTGA AGCTGGAAAC GGGGCGGCTG TTTGACGAAA
 401   ACGATGTGAA AGAAGACGCG CAGGTCGTCG TCATCGACCA AAATGTCAAA
 451   GACAAACTCT TTGCGGACTC GGATCCGTTG GGTAAAACCA TTTTGTTCAG
 501   GAAACGCCCC TTGACCGTCA TCGGCGTGAT GAAAAAAGAC GAAAACGCTT
 551   TCGGCAATTC CGACGTGCTG ATGCTTTGGT CGCCCTATAC GACGGTGATG
 601   CACCAAATCA CAGGCGAGAG CCACACCAAC TCCATCACCG TCAAAATCAA
 651   AGACAATGCC AATACCCAGG TTGCCGAAAA AGGGCTGACC GATCTGCTCA
 701   AAGCGCGGCA CGGCACGGAA GATTTCTTCA TGAACAACAG CGACAGCATC
 751   AGGCAGATAG TCGAAAGCAC CACCGGTACG ATGAAGCTGC TGATTTCCTC
 801   CATCGCCCTG ATTTCATTGG TAGTCGGCGG CATCGGCGTG ATGAACATCA
 851   TGCTGGTGTC CGTTACCGAG CGCACCAAAG AAATCGGCAT ACGGATGGCA
 901   ATCGGCGCGC GGCGCGGCAA TATTTTGCAG CAGTTTTTGA TTGAGGCGGT
 951   GTTAATCTGC GTCATCGGCG GTTTGGTCGG CGTGGGTTTG TCCGCCGCCG
1001   TCAGCCTCGT GTTCAATCAT TTTGTAACCG ACTTCCCGAT GGACATTTCC
1051   GCCATGTCCG TCATCGGCGC GGTCGCCTGT TCGACCGGAA TCGGCATCGC
1101   GTTCGGCTTT ATGCCTGCCA ATAAAGCAGC CAAACTCAAT CCGATAGACG
1151   CATTGGCACA GGATTGA
```

This corresponds to the amino acid sequence (SEQ ID NO: 534; ORF134-1):

```
  1   MSVQAVLAHK MRSLLTMLGI IIGIASVVSV VALGNGSQKK ILEDISSIGT
 51   NTISIFPGRG FGDRRSGRIK TLTIDDAKII AKQSYVASAT PMTSSGGTLT
101   YRNTDLTASL YGVGEQYFDV RGLKLETGRL FDENDVKEDA QVVVIDQNVK
151   DKLFADSDPL GKTILFRKRP LTVIGVMKKD ENAFGNSDVL MLWSPYTTVM
201   HQITGESHTN SITVKIKDNA NTQVAEKGLT DLLKARHGTE DFFMNNSDSI
251   RQIVESTTGT MKLLISSIAL ISLVVGGIGV MNIMLVSVTE RTKEIGIRMA
301   IGARRGNILQ QFLIEAVLIC VIGGLVGVGL SAAVSLVFNH FVTDFPMDIS
351   AMSVIGAVAC STGIGIAFGF MPANKAAKLN PIDALAQD*
```

Computer analysis of this amino acid sequence gave the following results:
Homology with the Hypothetical Protein o648 (SEQ ID NO: 1144) of *E.coli* (Accession Number AE000189)
ORF134 (SEQ ID NO: 532) and o648 protein (SEQ ID NO: 1144) show 45% aa identity in 153aa overlap:

```
Orf134:    2 RHGTEDFFMNNSDXIRQIVESTTGTMKXXXXXXXXXXXXVVGGIGVMNIMLVSVTERTKEI   61
             RHG +DFF   N D + + VE TT T++           VVGGIGVMNIMLVSVTERT+EI
o648:    496 RHGKKDFFTWNMDGVLKTVEKTTRTLQLFLTLVAVISLVVGGIGVMNIMLVSVTERTREI  555

Orf134:   62 GIRMAIGARRGNIXQQFLIEAXXXXXXXXXXXXXXXXXXXXXXXFNHFVTDFPMDISAMSVI  121
             GIRMA+GAR  ++ QQFLIEA                       F+  +  + S ++++
o648:    556 GIRMAVGARASDVLQQFLIEAVLVCLVGGALGITLSLLIAFTLQLFLPGWEIGFSPLALL  615

Orf134:  122 GAVACSTGIGIAFGFMPANKAAKLNPIDALAQD                              154
              A   CST  GI FG++PA  AA+L+P+DALA++
o648:    616 LAFLCSTVTGILFGWLPARNAARLDPVDALARE                              648
```

Homology with a Predicted ORF from *N.meningitidis* (Strain A)

ORF134 (SEQ ID NO: 532) shows 98.7% identity over a 154aa overlap with an ORF (ORF134a) (SEQ ID NO: 536) from strain A of *N. meningitidis*:

```
                                       10         20         30
orf134.pep                         ARHGTEDFFMNNSDXIRQIVESTTGTMKLL
                                   |||||||||||||| ||||||||||||||
orf134a    GESHTNSITVKIKDNANTQVAEKGLTDLLKARHGTEDFFMNNSDSIRQTVESTTGTMKLL
              210       220       230       240       250       260

40         50         60         70         80         90
orf134.pep  ISSIALISLVVGGIGVMNIMLVSVTERTKEIGIRMAIGARRGNIXQQFLIEAVLICVIGG
            |||||||||||||||||||||||||||||||||||||||||||| |||||||||||||||
orf134a     ISSIALISLVVGGIGVMNIMLVSVTERTKEIGIRMAIGARRGNILQQFLIEAVLICVIGG
              270       280       290       300       310       320

100        110        120        130        140        150
orf134.pep  LVGVGLSAAVSLVFNHFVTDFPMDISAMSVIGAVACSTGIGIAFGFMPANKAAKLNPIDA
            ||||||||||||||||||||||||||||||||||||||||||||||||||||||||||||
orf134a     LVGVGLSAAVSLVFNHFVTDFPMDISAMSVIGAVACSTGIGIAFGFMPANKAAKLNPIDA
              330       340       350       360       370       380 orf134.pep  LAQDX
            |||||
orfl34a     LAQDX
```

The complete length ORF134a nucleotide sequence (SEQ ID NO: 535) is:

```
   1    ATGTCGGTGC AAGCAGTATT GGCGCACAAA ATGCGTTCGC TTCTGACGAT
  51    GCTCGGCATC ATCATCGGTA TCGCTTCGGT TGTCTCCGTC GTCGCATTGG
 101    GCAACGGTTC GCAGAAAAAA ATCCTTGAAG ACATCAGTTC GATAGGGACG
 151    AACACCATCA GCATCTTCCC AGGGCGCGGC TTCGGCGACA GGCGCAGCGG
 201    CAGGATTAAA ACCCTGACCA TAGACGACGC AAAAATCATC GCCAAACAAA
 251    GCTACGTTGC TTCCGCCACG CCCATGACTT CGAGCGGCGG CACGCTGACT
 301    TACCGCAATA CCGACCTGAC CGCTTCTTTG TACGGTGTGG GCGAACAATA
 351    TTTCGACGTG CGCGGGCTGA AGCTGGAAAC GGGGCGGCTG TTTGACGAAA
 401    ACGATGTGAA AGAAGACGCG CAGGTCGTCG TCATCGACCA AAATGTCAAA
 451    GACAAACTCT TGCGGACTC GGATCCGTTG GGTAAAACCA TTTTGTTCAG
 501    GAAACGCCCC TTGACCGTCA TCGGCGTGAT GAAAAAAGAC GAAAACGCTT
 551    TCGGCAATTC CGACGTGCTG ATGCTTTGGT CGCCCTATAC GACGGTGATG
 601    CACCAAATCA CAGGCGAGAG CCACACCAAC TCCATCACCG TCAAAATCAA
 651    AGACAATGCC AATACCCAGG TTGCCGAAAA AGGGCTGACC GATCTGCTCA
 701    AAGCGCGGCA CGGCACGGAA GATTTCTTCA TGAACAACAG CGACAGCATC
 751    AGGCAGATAG TCGAAAGCAC CACCGGTACG ATGAAGCTGC TGATTTCCTC
 801    CATCGCCCTG ATTTCATTGG TAGTCGGCGG CATCGGCGTG ATGAACATCA
 851    TGCTGGTGTC CGTTACCGAG CGCACCAAAG AAATCGGCAT ACGGATGGCA
 901    ATCGGCGCGC GGCGCGGCAA TATTTTGCAG CAGTTTTTGA TTGAGGCGGT
 951    GTTAATCTGC GTCATCGGCG GTTTGGTCGG CGTGGGTTTG TCCGCCGCCG
1001    TCAGCCTCGT GTTCAATCAT TTTGTAACCG ACTTCCCGAT GGACATTTCC
1051    GCCATGTCCG TCATCGGCGC GGTCGCCTGT TCGACCGGAA TCGGCATCGC
```

```
-continued
1101    GTTCGGCTTT ATGCCTGCCA ATAAAGCAGC CAAACTCAAT CCGATAGATG

1151    CATTGGCGCA GGATTGA
```

This encodes a protein having amino acid sequence (SEQ ID NO: 536):

```
  1   MSVQAVLAHK MRSLLTMLGI IIGIASVVSV VALGNGSQKK ILEDISSIGT

51   NTISIFPGRG FGDRRSGRIK TLTIDDAKII AKQSYVASAT PMTSSGGTLT

101   YRNTDLTASL YGVGEQYFDV RGLKLETGRL FDENDVKEDA QVVVIDQNVK

151   DKLFADSDPL GKTILFRKRP LTVIGVMKKD ENAFGNSDVL MLWSPYTTVM

201   HQITGESHTN SITVKIKDNA NTQVAEKGLT DLLKARHGTE DFFMNNSDSI

251   RQIVESTTGT MKLLISSIAL ISLVVGGIGV MNIMLVSVTE RTKEIGIRMA

301   IGARRGNILQ QFLIEAVLIC VIGGLVGVGL SAAVSLVFNH FVTDFPMDIS

351   AMSVIGAVAC STGIGIAFGF MPANKAAKLN PIDALAQD*
```

ORF134a (SEQ ID NO: 536) and ORF134-1 (SEQ ID NO: 534) show 100.0% identity in 388 aa overlap:

```
orf134a.pep  MSVQAVLAHKMRSLLTMLGIIIGIASVVSVVALGNGSQKKILEDISSIGTNTISIFPGRG
             ||||||||||||||||||||||||||||||||||||||||||||||||||||||||||||
orf134-1     MSVQAVLAHKMRSLLTMLGIIIGIASVVSVVALGNGSQKKILEDISSIGTNTISIFPGRG orf134a.pep  FGDRRSGRIKTLTIDDAKIIAKQSYVASATPMTSSGGTLTYRNTDLTASLYGVGEQYFDV
             ||||||||||||||||||||||||||||||||||||||||||||||||||||||||||||
orf134-1     FGDRRSGRIKTLTIDDAKIIAKQSYVASATPMTSSGGTLTYRNTDLTASLYGVGEQYFDV orf134a.pep  RGLKLETGRLFDENDVKEDAQVVVIDQNVKDKLFADSDPLGXTILFRKRPLTVIGVMKKD
             ||||||||||||||||||||||||||||||||||||||||| ||||||||||||||||||
orf134-1     RGLKLETGRLFDENDVKEDAQVVVIDQNVKDKLFADSDPLGKTILFRKRPLTVIGVMKKD orf134a.pep  ENAFGNSDVLMLWSPYTTVMHQITGESHTNSITVKIKDNANTQVAEKGLTDLLKARHGTE
             ||||||||||||||||||||||||||||||||||||||||||||||||||||||||||||
orf134-1     ENAFGNSDVLMLWSPYTTVMHQITGESHTNSITVKIKDNANTQVAEKGLTDLLKARHGTE orf134a.pep  DFFMNNSDSIRQIVESTTGTMKLLISSIALISLVVGGIGVMNIMLVSVTERTKEIGIRMA
             ||||||||||||||||||||||||||||||||||||||||||||||||||||||||||||
orf134-1     DFFMNNSDSIRQIVESTTGTMKLLISSIALISLVVGGIGVMNIMLVSVTERTKEIGIRMA orf134a.pep  IGARRGNILQQFLIEAVLICVIGGLVGVGLSAAVSLVFNHFVTDFPMDISAMSVIGAVAC
             ||||||||||||||||||||||||||||||||||||||||||||||||||||||||||||
orf134-1     IGARRGNILQQFLIEAVLICVIGGLVGVGLSAAVSLVFNHFVTDFPMDISAMSVIGAVAC orf134a.pep  STGIGIAFGFMPANKAAKLNPIDALAQDX
             |||||||||||||||||||||||||||||
orf134-1     STGIGIAFGFMPANKAAKLNPIDALAQDX
```

Homology with a Predicted ORF from *N.gonorrhoeae*

ORF134 (SEQ ID NO: 532) shows 96.8% identity over a 154aa overlap with a predicted ORF (ORF134.ng) (SEQ ID NO: 538) from *N. gonorrhoeae*:

```
orf134.pep                         ARHGTEDFFMNNSDXIRQIVESTTGTMKLL   30
                                   ||||||||||||||| ||||||||||||||
orf134ng     GESHTNSITVKIKDNANTRVAEKGLAELLKARHGTEDFFMNNSDSIRQMVESTTGTMKLL  264 orf134.pep   ISSIALISLVVGGIGVMNIMLVSVTERTKEIGIRMAIGARRGNIXQQFLIEAVLICVIGG   90
             |||||||||||||||||||||||||||||||||||||||||||| |||||||||||| ||
orf134ng     ISSIALISLVVGGIGVMNIMLVSVTERTKEIGIRMAIGARRGNILQQFLIEAVLICIIGG  324
```

```
                              -continued
orf134.pep  LVGVGLSAAVSLVFNHFVTDFPMDISAMSVIGAVACSTGIGIAFGFMPANKAAKLNPIDA  150
           ||||||||||||||||||||||||||||||| ||||||||||||||||||||||||||||
orf134ng   LVGVGLSAAVSLVFNHFVTDFPMDISAASVIGAVACSTGIGIAFGFMPANKAAKLNPIDA  364 orf134.pep  LAQD                                                         154
            ||||
orf134ng    LAQD                                                         388
```

The complete length ORF134ng nucleotide sequence (SEQ ID NO: 537) is:

```
   1  ATGTCGGTGC AAGCAGTATT GGCGCACAAA ATGCGTTCGC TTCTGACCAT
  51  GCTCGGCATC ATCATCGGTA TCGCTTCGGT TGTCTCCGTC GTCGCGCTGG
 101  GCAACGGTTC GCAGAAAAAA ATCCTCGAAG ACATCAGTTC GATGGGGACG
 151  AACACCATCA GCATCTTCCC CGGGCGCGGC TTCGGCGACA GGCGCAGCGG
 201  CAAAATCAAA ACCCTGACCA TAGACGACGC AAAAATCATC GCCAAACAAA
 251  GCTACGTTGC CTCCGCCACG CCCATGACTT CGAGCGGCGG CACGCTGACC
 301  TACCGCAATA CCGACCTGAC CGCTTCTTTG TACGGTGTGG GCGAACAATA
 351  TTTCGACGTG CGCGGGCTGA AGCTGGAAAC GGGGCGGCTG TTTGATGAGA
 401  ACGATGTGAA AGAAGACGCG CAAGTCGTCG TCATCGACCA AAATGTCAAA
 451  GACAAACTCT TTGCGGACTC GGATCCGTTG GGTAAAACCA TTTTGTTCAG
 501  GAAACGCCCC TTGACCGTCA TCGGCGTGAT GAAAAAGAC  GAAAACGCTT
 551  TCGGCAATTC CGACGTGCTG ATGCTTTGGT CGCCCTATAC GACGGTGATG
 601  CACCAAATCA CAGGCGAGAG CCACACCAAC TCCATCACCG TCAAAATCAA
 651  AGACAATGCC AATACCCGGG TTGCCGAAAA AGGGCTGGCC GAGCTGCTCA
 701  AAGCACGGCA CGGCACGGAA GACTTCTTTA TGAACAACAG CGACAGCATC
 751  AGGCAGATGG TCGAAAGCAC CACCGGTACG ATGAAGCTGC TGATTTCCTC
 801  CATCGCCCTG ATTTCATTGG TAGTCGGCGG CATCGGTGTG ATGAACATTA
 951  TGCTGGTGTC CGTTACCGAG CGCACCAAAG AAATCGGCAT ACGGATGGCA
 901  ATCGGCGCGC GGCGCGGCAA TATTTTGCAG CAGTTTTTGA TTGAGGCGGT
 851  GTTAATCTGC ATCATCGGAG GCTTGGTCGG CGTAGGTTTG TCCGCCGCCG
1001  TCAGCCTCGT GTTCAATCAT TTTGTAACCG ATTTCCCGAT GGACATTTCG
1051  GCGGCATCCG TTATCGGGGC GGTCGCCTGT TCGACCGGAA TCGGCATCGC
1101  GTTCGGCTTT ATGCCTGCCA ATAAGGCAGC CAAACTCAAT CCGATAGATG
1151  CATTGGCGCA GGATTGA
```

This encodes a protein having amino acid sequence (SEQ ID NO: 538):

```
   1  MSVQAVLAHK MRSLLTMLGI IIGIASVVSV VALGNGSQKK ILEDISSMGT
  51  NTISIFPGRG FGDRRSGKIK TLTIDDAKII AKQSYVASAT PMTSSGGTLT
 101  YRNTDLTASL YGVGEQYFDV RGLKLETGRL FDENDVKEDA QVVVIDQNVK
 151  DKLFADSDPL GKTILFRKRP LTVIGVMKKD ENAFGNSDVL MLWSPYTTVM
 201  HQITGESHTN SITVKIKDNA NTRVAEKGLA ELLKARHGTE DFFMNNSDSI
 251  RQMVESTTGT MKLLISSIAL ISLVVGGIGV MNIMLVSVTE RTKEIGIRMA
```

-continued
```
301 IGARRGNILQ QFLIEAVLIC IIGGLVGVGL SAAVSLVCNH FVTDFPMDIS

351 AASVIGAVAC STGIGIAFGF MPANKAAKLN PIDALAQD*
```

ORF134ng (SEQ ID NO: 538) and ORF134-1 (SEQ ID NO: 534) show 97.9% identity in 388 aa overlap:

```
orf134ng  MSVQAVLAHKMRSLLTMLGIIIGIASVVSVVALGNGSQKKILEDISSMGTNTISIFPGRG
          |||||||||||||||||||||||||||||||||||||||||||:||||||||||||||
orf134-1  MSVQAVLAHKMRSLLTMLGIIIGIASVVSVVALGNGSQKKILEDISSIGTNTISIFPGRG orf134ng  FGDRRSGKIKTLTIDDAKIIAKQSYVASATPMTSSGGTLTYRNTDLTASLYGVGEQYFDV
          |||||||:||||||||||||||||||||||||||||||||||||||||||||||||||
orf134-1  FGDRRSGRIKTLTIDDAKIIAKQSYVASATPMTSSGGTLTYRNTDLTASLYGVGEQYFDV orf134ng  RGLKLETGRLFDENDVKEDAQVVVIDQNVKDKLFADSDPLGKTILFRKRPLTVIGVMKKD
          ||||||||||||||||||||||||||||||||||||||||||||||||||||||||||
orf134-1  RGLKLETGRLFDENDVKEDAQVVVIDQNVKDKLFADSDPLGKTILFRKRPLTVIGVMKKD orf134ng  ENAFGNSDVLMLWSPYTTVMHQITGESHTNSITVKIKDNANTRVAEKGLAELLKARHGTE
          |||||||||||||||||||||||||||||||||||||||:||||||::||||||||||
orf134-1  ENAFGNSDVLMLWSPYTTVMHQITGESHTNSITVKIKDNANTQVAEKGLTDLLKARHGTE orf134ng  DFFMNNSDSIRQMVESTTGTMKLLISSIALISLVVGGIGVMNIMLVSVTERTKEIGIRMA
          |||||||||||:||||||||||||||||||||||||||||||||||||||||||||||
orf134-1  DFFMNNSDSIRQIVESTTGTMKLLISSIALISLVVGGIGVMNIMLVSVTERTKEIGIRMA orf134ng  IGARRGNILQQFLIEAVLICIIGGLVGVGLSAAVSLVFNHFVTDFPMDISAASVIGAVAC
          |||||||||||||||||||||:||||||||||||||||||||||||||||| ||||||
orf134-1  IGARRGNILQQFLIEAVLICVIGGLVGVGLSAAVSLVFNHFVTDFPMDISAMSVIGAVAC orf134ng  STGIGIAFGFMPANKAAKLNPIDALAQDX
          ||||||||||||| ||||||||||||||
orf134-1  STGIGIAFGFMPAMKAAKLNPIDALAQDX
```

ORF134ng (SEQ ID NO: 538) also shows homology to an *E.coli* ABC transporter (SEQ ID NO: 1145):

```
sp|P75831|YBJZ_ECOLI HYPOTHETICAL ABC TRANSPORTER ATP-BINDING PROTEIN YBJZ)gi5
(AE000189) o648; similar to YBBA_HAEIN SW: P45247 [Escherichia coli]
Length = 648  Score = 297 bits (753), Expect = 6e-80
Identities = 162/389 (41%), Positives = 230/389 (58%), Gaps = 1/389 (0%)

Query:   1   MSVQAVLAHKMRSLLTMLXXXXXXXXXXXXXXXLGNGSQKKILEDISSMGTNTISIFPGRG    60
             M+  +A+ A+KMR+LLTML               +G+ +++  +L DI S+GTNTI ++PG+
Sbjct: 260   MAWRALAANKMRTLLTMLGIIIGIASVVSIVVVGDAAKQMVLADIRSIGTNTIDVYPGKD   319

Query:  61   FGDRRSGKIKTLTIDDAKIIAKQSYVASATPMTSSGGTLTYRNTDLTASLYGVGEQYFDV   120
             FGD    + L  DD    I KQ +VASATP S     L Y N D+ AS  GV   YF+V
Sbjct: 320   FGDDDPQYQQALKYDDLIAIQKQPWVASATPAVSQNLRLRYNNVDVAASANGVSGDYFNV   379

Query: 121   RGLKLETGRLFDENDVKEDAQVVVIDQNVKDKLFAD-SDPLGKTILFRKRPLTVIGVMKK   179
                G+    G  F++  +    AQVVV+D N ++ +LF   +D +G+ IL     P  VIGV ++
Sbjct: 380   YGMTFSEGNTFNQEQLNGRAQVVVLDSNTRRQLFPHKADVVGEVILVGNMPARVIGVAEE   439

Query: 180   DENAFGNSDVLMLWSPYTTVMHQITGESHTNSITVKIKDNANTRVAEKGLAELLKARHGT   239
             ++  FG+S VL +W PY+T+  ++  G+S  NSITV++K+   ++  AE+  L  LL   RHG
Sbjct: 440   KQSMFGSSKVLRVWLPYSTMSGRVMGQSWLNSITVRVKEGFDSAEAEQQLTRLLSLRHGK   499

Query: 240   EDFFMNNSDSIRQMVESTTGTMKXXXXXXXXXXXXXVVGGIGVMNIMLVSVTERTKEIGIRM   299
             +DFF  N D + +  VE TT T++                VVGGIGVMNIMLVSVTERT+EIGIRM
Sbjct: 500   KDFFTWNMDGVLKTVEKTTRTLQLFLTLVAVISLVVGGIGVMNIMLVSVTERTREIGIRM   559

Query: 300   AIGARRGNILQQFLIEXXXXXXXXXXXXXXXXXXXXXXXXXFNHFVTDFPMDISAASVIGAVA   359
             A+GAR  ++LQQFLIE                         F+   +  S  +++ A
Sbjct: 560   AVGARASDVLQQFLIEAVLVCLVGGALGITLSLLIAFTLQLFLPGWEIGFSPLALLLAFL   619

Query: 360   CSTGIGIAFGFMPANKAAKLNPIDALAQD                                388
             CST GI FG++PA  AA+L+P+DALA++
Sbjct: 620   CSTVTGILFGWLPARNAARLDPVDALARE                                648
```

Based on this analysis, including the presence of the leader peptide and transmembrane regions in the gonococcal protein, it is prediceted that these proteins from *N.meningitidis* and *N.gonorrhoeae*, and their epitopes, could be useful antigens for vaccines or diagnostics, or for raising antibodies.

Example 65

The following partial DNA sequence was identified in *N.meningitidis* (SEQ ID NO: 539):

```
  1  ..GGGACGGGAG CGATGCTGCT GCTGTTTTAC GCGGTAACGA T.CTGCCTTT
 51    GGCCACTGGC GTTACCCTGA GTTACACCTC GTCGATTTTT TTGGCGGTAT
101    TTTCCTTCCT GATTTTGAAA GAACGGATTT CCGTTTACAC GCAGGCGGTG
151    CTGCTCCTTG GTTTTGCCGG CGTGGTATTG CTGCTTAATC CCTCGTTCCG
201    CAGCGGTCAG GAAACGGCGG CACTCGCCGG GCTGGCGGGC GGCGCGATGT
251    CCGGCTGGGC GTATTTGAAA GTGCGCGAAC TGTCTTTGGC GGGCGAACCC
301    GGCTGGCGCG TCGTGTTTTA CCTTTCCGTG ACAGGTGTGG CGATGTCGTC
351    GGTTTGGGCG ACGCTGACCG GCTGGCACAC CCTGTCCTTT CCATCGGCAG
401    TTTATCTGTC GTGCATCGGC GTGTCCGCGC TGATTGCCCA ACTGTCGATG
451    ACGCGCGCCT ACAAAGTCGG CGACAAATTC ACGGTTGCCT CGCTTTCCTA
501    TATGACCGTC GTTTTTTCCG CTCTGTCTGC CGCATTTTTT CTGGGCGAAG
551    AGCTTTTCTG GCAGGAAATA CTCGGTATGT GCATCATCAT CCTCAGCGGT
601    ATTTTGA
```

This corresponds to the amino acid sequence (SEQ ID NO: 540; ORF135):

```
  1  ..GTGAMLLLFY AVTILPLATG VTLSYTSSIF LAVFSFLILK ERISVYTQAV
 51    LLLGFAGVVL LLNPSFRSGQ ETAALAGLAG GAMSGWAYLK VRELSLAGEP
101    GWRVVFYLSV TGVAMSSVWA TLTGWHTLSF PSAVYLSCIG VSALIAQLSM
151    TRAYKVGDKF TVASLSYMTV VFSALSAAFF LGEELFWQEI LGMCIIISAV
201    F*
```

Further work revealed the complete nucleotide sequence (SEQ ID NO: 541):

```
  1  ATGGATACCG CAAAAAAAGA CATTTTAGGA TCGGGCTGGA TGCTGGTGGC
 51  GGCGGCCTGC TTTACCATTA TGAACGTATT GATTAAAGAG GCATCGGCAA
101  AATTTGCCCT CGGCAGCGGC GAATTGGTCT TTTGGCGCAT GCTGTTTTCA
151  ACCGTTGCGC TCGGGGCTGC CGCCGTATTG CGTCGGGACA mCTTCCGCAC
201  GCCCCATTGG AAAAACCACT TAAACCGCAG TATGGTCGGG ACGGGGCGA
251  TGCTGCTGCT GTTTTACGCG GTAACGCATC TGCCTTTGGC CACTGGCGTT
301  ACCCTGAGTT ACACCTCGTC GATTTTTTTG GCGGTATTTT CCTTCCTGAT
351  TTTGAAAGAA CGGATTTCCG TTTACACGCA GGCGGTGCTG CTCCTTGGTT
401  TTGCCGGCGT GGTATTGCTG CTTAATCCCT CGTTCCGCAG CGGTCAGGAA
451  ACGGCGGCAC TCGCCGGGCT GGCGGGCGGC GCGATGTCCG GCTGGGCGTA
501  TTTGAAAGTG CGCGAACTGT CTTTGGCGGG CGAACCCGGC TGGCGCGTCG
```

```
-continued
551  TGTTTTACCT TTCCGTGACA GGTGTGGCGA TGTCGTCGGT TTGGGCGACG

601  CTGACCGGCT GGCACACCCT GTCCTTTCCA TCGGCAGTTT ATCTGTCGTG

651  CATCGGCGTG TCCGCGCTGA TTGCCCAACT GTCGATGACG CGCGCCTACA

701  AAGTCGGCGA CAAATTCACG GTTGCCTCGC TTTCCTATAT GACCGTCGTT

751  TTTTCCGCTC TGTCTGCCGC ATTTTTTCTG GGCGAAGAGC TTTTCTGGCA

801  GGAAATACTC GGTATGTGCA TCATCATCCT CAGCGGTATT TGAGCAGCA

851  TCCGCCCCAC TGCCTTCAAA CAGCGGCTGC AATCCCTGTT CCGCCAAAGA

901  TAA
```

This corresponds to the amino acid sequence (SEQ ID NO: 542; ORF135-1):

```
  1  MDTAKKDILG SGWMLVAAAC FTIMNVLIKE ASAKFALGSG ELVFWRNLFS

51  TVALGAAAVL RRDXFRTPHW KNHLNRSMVG TGAMLLLFYA VTHLPLATGV

101  TLSYTSSIFL AVFSFLILKE RISVYTQAVL LLGFAGVVLL LNPSFRSGQE

151  TAALAGLAGG AMSGWAYLKV RELSLAGEPG WRVVFYLSVT GVAMSSVWAT

201  LTGWHTLSFP SAVYLSCIGV SALIAQLSMT RAYKVGDKFT VASLSYMTVV

251  FSALSAAFFL GEELFWQEIL GMCIIILSGI LSSIRPTAFK QRLQSLFRQR

301  *
```

Computer analysis of this amino acid sequence gave the following results:
Homology with a Predicted ORF from *N.meningitidis* (Strain A)
ORF135 (SEQ ID NO: 540) shows 99.0% identity over a 197aa overlap with an ORF (ORF135a) (SEQ ID NO: 544) from strain A of *N. meningitidis*:

```
                                    10        20        30
orf135.pep                          GTGAMLLLFYAVTILPLATGVTLSYTSSIF
                                    |||||||||||| ||||||||||||||||
orf135a     STVALGAAAVLRRDTFRTPHWKNHLNRSMVGTGAMLLLFYAVTHLPLATGVTLSYTSSIF
            50        60        70        80        90        100

40        50        60        70        80        90
orf135.pep  LAVFSFLILKERISVYTQAVLLLGFAGVVLLLNPSFRSGQETAALAGLAGGAMSGWAYLK
            ||||||||||||||||||||||||||||||||||||||||||||||||||||||||||||
orf135a     LAVFSFLILKERISVYTQAVLLLGFAGVVLLLNPSFRSGQETAALAGLAGGAMSGWAYLK
            110       120       130       140       150       160

100       110       120       130       140       150
orf135.pep  VRELSLAGEPGWRVVFYLSVTGVAMSSVWATLTGWHTLSFPSAVYLSCIGVSALIAQLSM
            ||||||||||||||||||||||||||||||||||||||||||||||||||||||||||||
orf135a     VRELSLAGEPGWRVVFYLSVTGVAMSSVWATLTGWHTLSFPSAVYLSCIGVSALIAQLSM
            170       180       190       200       210       220

160       170       180       190       200
orf135.pep  TRAYKVGDKFTVASLSYMTVVFSALSAAFFLGEELFWQEILGMCIIISAVFX
            ||||||||||||||||||||||||||||||||||:|||||||||||||||
orf135a     TRAYKVGDKFTVASLSYMTVVFSALSAAFFLAEELFWQEILGMCIIILSGILSSIRPTAF
            230       240       250       260       270       280 orf135a     KQRLQSLFRQRX
            290       300
```

The complete length ORF135a nucleotide sequence (SEQ ID NO: 543) is:

```
  1 ATGGATACCG CAAAAAAAGA CATTTTAGGA TCGGGCTGGA TGCTGGTGGC

51 GGCGGCCTGC TTTACCATTA TGAACGTATT GATTAAAGAG GCATCGGCAA

101 AATTTGCCCT CGGCAGCGGC GAATTGGTCT TTTGGCGCAT GCTGTTTTCA

151 ACCGTTGCGC TCGGGCTGC CGCCGTATTG CGTCGGGACA CCTTCCGCAC

201 GCCCCATTGG AAAAACCACT TAAACCGCAG TATGGTCGGG ACGGGGCGA

251 TGCTGCTGCT GTTTTACGCG GTAACGCATC TGCCTTTGGC CACCGGCGTT

301 ACCCTGAGTT ACACCTCGTC GATTTTTTTG GCGGTATTTT CCTTCCTGAT

351 TTTGAAAGAA CGGATTTCCG TTTACACGCA GGCGGTGCTG CTCCTTGGTT

401 TTGCCGGCGT GGTATTGCTG CTTAATCCCT CGTTCCGCAG CGGTCAGGAA

451 ACGGCGGCAC TCGCCGGGCT GGCGGGCGGC GCGATGTCCG GCTGGGCGTA

501 TTTGAAAGTG CGCGAACTGT CTTTGGCGGG CGAACCCGGC TGGCGCGTCG

551 TGTTTTACCT TTCCGTGACA GGTGTGGCGA TGTCATCGGT TTGGGCGACG

601 CTGACCGGCT GGCACACCCT GTCCTTTCCA TCGGCAGTTT ATCTGTCGTG

651 CATCGGCGTG TCCGCGCTGA TTGCCCAACT GTCGATGACG CGCGCCTACA

701 AAGTCGGCGA CAAATTCACG GTTGCCTCGC TTTCCTATAT GACCGTCGTT

751 TTTTCCGCTC TGTCTGCCGC ATTTTTTCTG GCCGAAGAGC TTTTCTGGCA

801 GGAAATACTC GGTATGTGCA TCATCATCCT CAGCGGTATT TTGAGCAGCA

851 TCCGCCCCAC TGCCTTCAAA CAGCGGCTGC AATCCCTGTT CCGCCAAAGA

901 TAA
```

This encodes a protein having amino acid sequence (SEQ ID NO: 544):

```
  1 MDTAKKDILG SGWMLVAAAC FTIMNVLIKE ASAKFALGSG ELVPWRMLFS

51 TVALGAAAVL RRDTFRTPHW KNHLNRSMVG TGAMLLLFYA VTHLPLATGV

101 TLSYTSSIFL AVFSFLILKE RISVYTQAVL LLGFAGVVLL LNPSFRSGQE

151 TAALAGLAGG AMSGWAYLKV RELSLAGEPG WRVVFYLSVT GVAMSSVWAT

201 LTGWHTLSFP SAVYLSCIGV SALIAQLSMT RAYKVGDKFT VASLSYMTVV

251 FSALSAAFFL AEELFWQEIL GMCIIILSGI LSSIRPTAFK QRLQSLFRQR

301 *
```

ORF135a (SEQ ID NO: 544) and ORF135-1 (SEQ ID NO: 542) show 99.3% identity in 300 aa overlap:

```
orf135a.pep MDTAKKDILGSGWMLVAAACFTIMNVLIKEASAKFALGSGELVFWRMLFSTVALGAAAVL
            ||||||||||||||||||||||||||||||||||||||||||||||||||||||||||||
orf135-1    MDTAKKDILGSGWMLVAAACFTIMNVLIKEASAKFALGSGELVFWRMLFSTVALGAAAVL orf135a.pep RRDTFRTPHWKNHLNRSMVGTGAMLLLFYAVTHLPLATGVTLSYTSSIFLAVFSFLILKE
            |||:||||||||||||||||||||||||||||||||||||||||||||||||||||||||
orf135-1    RRDXFRTPHWKNHLNRSMVGTGAMLLLFYAVTHLPLATGVTLSYTSSIFLAVFSFLILKE orf135a.pep RISVYTQAVLLLGFAGVVLLLNPSFRSGQETAALAGLAGGAMSGWAYLKVRELSLAGEPG
            ||||||||||||||||||||||||||||||||||||||||||||||||||||||||||||
orf135-1    RISVYTQAVLLLGFAGVVLLLNPSFRSGQETAALAGLAGGAMSGWAYLKVRELSLAGEPG
```

```
-continued
orf135a.pep  WRVVFYLSVTGVAMSSVWATLTGWHTLSFPSAVYLSCIGVSALIAQLSMTRAYKVGDKFT
             ||||||||||||||||||||||||||||||||||||||||||||||||||||||||||||
orf135-1     WRVVFYLSVTGVAMSSVWATLTGWHTLSFPSAVYLSCIGVSALIAQLSMTRAYKVGDKFT orf135a.pep  VASLSYMTVVFSALSAAFFLAEELFWQEILGMCIIILSGILSSIRPTAFKQRLQSLFRQR
             ||||||||||||||||||||||:|||||||||||||||||||||||||||||||||||||
orf135-1     VASLSYMTVVFSALSAAFFLGEELFWQEILGMCIIILSGILSSIRPTAFKQRLQSLFRQR
```

Homology with a Predicted ORF from N. gonorrhoeae

ORF135 (SEQ ID NO: 540) shows 97% identity over a 201aa overlap with a predicted ORF (ORF135ng) (SEQ ID NO: 546) from N.gonorrhoeae:

```
orf135.pep                         GTGAMLLLFYAVTXLPLATGVTLSYTSSIF   30
                                   ||||||||||||| |||:||||||||||||
orf135ng   STVTLGAAAVLRRDTFRTPHWKNHLNRSMVGTGAMLLLFYAVTHLPLTTGVTLSYTSSIF  335 orf135.pep LAVFSFLILKERISVYTQAVLLLGFAGVVLLLNPSFRSGQETAALAGLAGGAMSGWAYLK   90
           |||||||||||||||||||||||||||||||||||||||| ||||||||||||||||||
orf135ng   LAVFSFLILKERISVYTQAVLLLGFAGVVLLLNPSFRSGQEPAALAGLAGGAMSGWAYLK  395 orf135.pep VRELSLAGEPGWRVVFYLSVTGVAMSSVWATLTGWHTLSFPSAVYLSCIGVSALIAQLSM  150
           |||||||||||||||||||:||||||||||||||||||||||||||| ||||||||||||
orf135ng   VRELSLAGEPGWRVVFYLSATGVAMSSVWATLTGWHTLSFPSAVYLSGIGVSALIAQLSM  455 orf135.pep TRAYKVGDKFTVASLSYMTVVFSALSAAFFLGEELFWQEILGMCIIISAVF          201
           |||||||||||||||||||||||||||||||||||||||||||||||||:|
orf135ng   TRAYKVGDKFTVASLSYMTVVFSALSAAFFLGEELFWQEILGMCIIISAAF          506
```

An ORF135ng nucleotide sequence (SEQ ID NO: 545) was predicted to encode a protein having amino acid sequence (SEQ ID NO: 546):

```
  1   MPSRKAFRRM LRTASFQGLH LHHFHQKVGK CGIIGFGIHI FPTLLPAAQG

51   ILDIQLGLFR IDFAALAVYR RTQVDFIHTV IDGIASDQAF SEVVQILRRL

101   NLGHFTDTHL IAQARRFIAD FGNIRPMRRG EAKTFCRCFR FDGIDGIHGD

151   FRQCGHINRL APGKDCRNGK RDKVFFHTRH YNQVCLEKTN CSARKIKFRH

201   QKQAKTHSTS LAARFTIRPS LSQRPFMDTA KKDILGSGWM LVAAACFTVM

251   NVLIKEASAK FALGSGELVF WRMLFSTVTL GAAAVLRRDT FRTPHWKNHL

301   NRSMVGTGAM LLLFYAVTHL PLTTGVTLSY TSSIFLAVFS FLILKERISV

351   YTQAVLLLGF AGVVLLLNPS FRSGQEPAAL AGLAGGAMSG WAYLKVRELS

401   LAGEPGWRVV FYLSATGVAM SSVWATLTGW HTLSFPSAVY LSGIGVSALI

451   AQLSMTRAYK VGDKFTVASL SYMTVVFSAL SAAFFLGFEL FWQEILGMCI

501   IISAAF*
```

Further work revealed the following gonococcal sequence (SEQ ID NO: 547):

```
  1   ATGGATACCG CAAAAAAGA  CATTTTAGGA TCGGGCTGGA TGCTGGTGGC

51   GGCGGCCTGC TTCACCGTTA TGAACGTATT GATTAAAGAG GCATCGGCAA

101   AATTTGCCCT CGGCAGCGGC GAATTGGTCT TTTGGCGCAT GCTGTTTTCA

151   ACCGTTACGC TCGGTGCTGC CGCCGTATTG CGGCGCGACA CCTTCCGCAC

201   GCCCCATTGG AAAAACCACT TAAACCGCAG TATGGTCGGG ACGGGGCGA
```

```
-continued
251    TGCTGCTGCT GTTTTACGCG GTAACGCATC TGCCTTTGAC AACCGGCGTT

301    ACCCTGAGTT ACACCTCGTC GATTTTTttg GCGGTATTTT CCTTCCTGAT

351    TTTGAAAGAA CGGATTTCCG TTTACACGCA GGCGGTGCTG CTCCTTGGTT

401    TTGCCGGCGT GGTATTGCTG CTTAATCCCT CGTTCCGCAG CGGTCAGGAA

451    CCGGCGGCAC TCGCCGGGCT GGCGGGCGGC GCGATGTCCG GCTGGGCGTA

501    TTTGAAAGTG CGCGAACTGT CTTTGGCGGG CGAACCCGGC TGGCGCGTCG

551    TGTTTTACCT TTCCGCAACC GGCGTGGCGA TGTCGTCggt ttgggcgacg

601    Ctgaccggct ggCACAcccT GTCCTTTcca tcggcagttt ATCtgtCGGG

651    CATCGGCGTG tccgcgCtgA TTGCCCAaCT GtcgatgAcg cGCGcctaca 701    aaGTCGGCGA CAAATTCACG GTTGCCTCGC tttcctaTAt gaccgtCGTC 751    TTTTCCGCCC TGTCTGCCGC ATTTTTTCTg ggcgaagagc tttTCtggCA 801    GGAAATACTC GGTATGTGCA TCATTAtccT CAGCGGCATT TTGAGCAGCA

851    TCCGCCCCAT TGCCTTCAAA CAGCGGCTGC AAGCCCTCTT CCGCCAAAGA

901    TAA
```

The corresponds to the amino acid sequence (SEQ ID NO: 548; ORF135ng-1):

```
  1    MDTAKKDILG SGWMLVAAAC FTVMNVLIKE ASAKFALGSG ELVFWRMLFS

51    TVTLGAAAVL RRDTFRTPHW KNHLNRSMVG TGAMLLLFYA VTHLPLTTGV

101    TLSYTSSIFL AVFSFLILKE RISVYTQAVL LLGFAGVVLL LNPSFRSGQE

151    PAALAGLAGG AMSGWAYLKV RELSLAGEPG WRVVFYLSAT GVAMSSVWAT

201    LTGWHTLSFP SAVYLSGIGV SALIAQLSMT RAYKVGDKFT VASLSYMTVV

251    FSALSAAFFLGEELFWQEIL GMCIIILSGI LSSIRPIAFK QRLQALFRQR

301    *
```

ORF135NG-1 (SEQ ID NO: 548) and ORF135-1 (SEQ ID NO: 542) show 97.0% identity in 300 aa overlap:

```
orf135ng-1.pep  MDTAKKDILGSGWMLVAAACFTVMNVLIKEASAKFALGSGELVFWRMLFSTVTLGAAAVL
                ||||||||||||||||||||||||:|||||||||||||||:||||||||||||:||||||
orf135-1        MDTAKKDILGSGWMLVAAACFTIMNVLIKEASAKFALGSGELVFWRMLFSTVALGAAAVL orf135ng-1.pep  RRDTFRTPHWKNHLNRSMVGTGAMLLLFYAVTHLPLTTGVTLSYTSSIFLAVFSFLILKE
                |||:||||||||||||||||||||||||||||||||:|||||||||||||||||||||||
orf135-1        RRDXFRTPHWKNHLNRSMVGTGAMLLLFYAVTHLPLATGVTLSYTSSIFLAVFSFLILKE orf135ng-1.pep  RISVYTQAVLLLGFAGVVLLLNPSFRSGQEPAALAGLAGGAMSGWAYLKVRELSLAGEPG
                |||||||||||||||||||||||||||||| |||||||||||||||||||||||||||||
orf135-1        RISVYTQAVLLLGFAGVVLLLNPSFRSGQETAALAGLAGGAMSGWAYLKVRELSLAGEPG orf135ng-1.pep  WRVVFYLSATGVAMSSVWATLTGWHTLSFPSAVYLSGIGVSALIAQLSMTRAYKVGDKFT
                ||||||||:||||||||||||||||||||||||||||:||||||||||||||||||||||
orf135-1        WRVVFYLSVTGVAMSSVWATLTGWHTLSFPSAVYLSCIGVSALIAQLSMTRAYKVGDKFT orf135ng-1.pep  VASLSYMTVVFSALSAAFFLGEELFWQEILGMCIIILSGILSSIRPIAFKQRLQALFRQR
                |||||||||||||||||||||||||||||||||||||||||||| ||||||:|||||
orf135-1        VASLSYMTVVFSALSAAFFLGEELFWQEILGMCIIILSGILSSIRPTAFKQRLQSLFRQR
```

Based on this analysis, including the presence of several putative transmembrane domains in the gonococcal protein, it is predicted that the proteins from *N.meningitidis* and *N.gonorrhoeae*, and their epitopes, could be useful antigens for vaccines or diagnostics, or for raising antibodies.

Example 66

The following DNA sequence was identified in *N.meningitidis* (SEQ ID NO: 549):

```
  1 ATGAAGCGGC GTATAGCCGT CTTCGTCCTG TTCCCGCAGA TAATCCGAGT
 51 TTTGGGACAA CTGTTGCCGA AAATCGTCAA TACAGTTCCG GCACATCGGA
101 TGCTCTTCCA GATTTTCGGG ATGTTCTTTT TCTTCATACA CCAGCAATAT
151 CTGCCCGGGA TCGCCGAAAT CGATTCCCCA TGCGGCATCG TGTTCGGTGC
201 GCTCCTCTTC CGTCATCTGC CCGCGCATTG CCTGTATGGT AAAGCCGCCG
251 TAGGGGATGC CgTTGCACAC GAACATCCAG TCGCTGATGT CGTCAACCGG
301 AACGCAAACG cTTTCGCCTT GTTCGACATT GGTCAGTTCG CCsGGTTCAT
351 TGTTCAGCAC ACCGTAAATA TAAAGACCGT CAAAATAAAT ATCGTCGATC
401 CACATATGTT CGCAAATTTC GCCGTCTTCG CCGTCTTGGA AAAAAGGGAC
451 TTTGACCATG GCAAAATCCA AGGCGGAAAT AATGCGGCGG CGTTCCCAAA
501 AAAGcTCGCG CCAAAAATAT TTGAATGTTT TACGGGCGCG TTCGTCGGCA
551 CGGTTTACCG GTTCGTCTGC CTGTTCTACA TAATAAATGA CGGAATCGCC
601 CATCATaTCT GCTCCTCAAC GTGTACGGTA TCTGTTTGCA CCTTACTGCG
651 GCTTTCTgcC kTCGGCATCC GATTCGGATT TGAAAAGTTC mmrwyATTCG
701 GAATAG
```

This corresponds to the amino acid sequence (SEQ ID NO: 550; ORF136):

```
  1 MKRRIAVFVL FPQIIRVLGQ LLPKIVNTVP AHRMLFQIFG MFFFFIHQQY
 51 LPGIAEIDSP CGIVFGALLF RHLPAHCLYG KAAVGDAVAH EHPVADVVNR
101 NANAFALFDI GQFAXFIVQH TVNIKTVKIN IVDPHMFANF AVFAVLEKRD
151 FDHGKIQGGN NAAAFPKKLA PKIFECFTGA FVGTVYRFVC LFYIINDGIA
201 HHSAPQRVRY LFAPYCGFLP SASDSDLKSS XXSE*
```

Further work revealed the complete nucleotide sequence (SEQ ID NO: 551):

```
  1 ATGATGAAGC GGCGTATAGC CGTCTTCGTC CTGTTCCCGC AGATAATCCG
 51 AGTTTTGGGA CAACTGTTGC CGAAAATCGT CAATACAGTT CCGGCACATC
101 GGATGCTCTT CCAGATTTTC GGGATGTTCT TTTTCTTCAT ACACCAGCAA
151 TATCTGCCCG GGATCGCCGA AATCGATTCC CCATGCGGCA TCGTGTTCGG
201 TGCGCTCCTC TTCCGTCATC TGCCCGCGCA TTGCCTGTAT GGTAAAGCCG
251 CCGTAGGGGA TGCCGTTGCA CACGAACATC CAGTCGCTGA TGTCGTCAAC
301 CGGAACGCAA ACGCTTTCGC CTTGTTCGAC ATTGGTCAGT TCGCCGGGTT
351 CATTGTTCAG CACACCGTAA ATATAAAGAC CGTCAAAATA AATATCGTCG
401 ATCCACATAT GTTCGCAAAT TTCGCCGTCT TCGCCGTCTT GGAAAAAAGG
451 GACTTTGACC ATGGCAAAAT CCAAGGCGGA AATAATGCGG CGGCGTTCCC
```

```
-continued
501  AAAAAAGCTC GCGCCAAAAA TATTTGAATG TTTTACGGGC GCGTTCGTCG

551  GCACGGTTTA CCGGTTCGTC TGCCTGTTCT ACATAATAAA TGACGGAATC

601  GCCCATCATT CTGCTCCTCA ACGTGTACGG TATCTGTTTG CACCTTACTG

651  CGGCTTTCTG CCTTCGGCAT CCGATTCGGA TTTGAAAAGT TCCAAATATT

701  CGGAATAG
```

This corresponds to the amino acid sequence (SEQ ID NO: 552; ORF136-1):

```
  1  MMKRRIAVFV LFPQIIRVLG QLLPKIVNTV PAHRMLFQIF GMFFFFIHQQ

51  YLPGIAEIDS PCGIVFGALL FRHLPAHCLY GKAAVGDAVA HEHPVADVVN

101  RNANAFALFD IGQFAGFIVQ HTVNIKTVKI NIVDPHMFAN FAVFAVLEKR

151  DFDHGKIQGG NNAAAFPKKL APKIFECFTG AFVGTVYRFV CLFYIINDGI

201  AHHSAPQRVR YLFAPYCGFL PSASDSDLKS SKYSE*
```

Computer analysis of this amino acid sequence gave the following results:
Homology with a Predicted ORF from *N.meningitidis* (Strain A)
ORF136 (SEQ ID NO: 550) shows 71.7% identity over a 237aa overlap with an ORF (ORF136a) (SEQ ID NO: 554) from strain A of *N. meningitidis*:

```
                     10         20         30         40         50        59
orf136.pep    MKRRIAVFVLFPQIIRVLGQLLPKIVNTVPAHRMLFQIFGMFFFFIHQQYLPGIAEIDS
              ||||||||||:  |   ||:||||||||||||||||||||| ||||||||||||||||||
orf136a       MMKRRIAVFVLLMQKIRVLGQLLPKIVNTVPAHRMLFQXFGMFFFFIHQQYLPGIAEIDS
                     10         20         30         40         50         60

70         80         90        100        110       119
orf136.pep    PCGIVFGALLFRHLPAHCLYGKAAVGDAVAHEHPVADVVNRNANAFALFDIGQFAXFIVQ
              |||||||:||||| :|||||||||||||||:|||||||||||||||||||||||| ||||
orf136a       PCGIVFGTLLFRHXSTHCLYGKAAVGNAVAHEHPVADVVNRNANAFALFDIGQFAGFIVQ
                     70         80         90        100        110        120

120        130        140        150        160        170       179
orf136.pep    HTVNIKTVKINIVDPHMFANFAVFAVLEKRDFDHGXIQGGNNAAAFPKKLAPKIFECFTG
              |::|:|||||||||||||||||| ||||||||||| :  :| :             |:   |  |::  :  :
orf136a       HAINVKTVKINIVDPHMFANFAXFAVLEKRALTMAKSKXXXMRRRSQKSSRQKYLNVLRA
                    130        140        150        160        170        180 orf136.pep    AFVGTVYRFVCLFYIINDGIAHH---SAPQRVRYLFAPYCGFLPSASDSDLKSSXXSEX
               :  ||: |     :  :::    ||||||||||||||||||||||||||||    |||
orf136a       R---SPARFTGLSACSTXXMTESPIISAPQRVRYLFAPYCGFLPSASDSDLKSSKYSEX
                         190        200        210        220        230
```

The complete length ORF136a nucleotide sequence (SEQ ID NO: 553) is:

```
  1  ATGATGAAGC GGCGTATAGC CGTCTTCGTC CTGCTCATGC AGAAAATCCG

51  GATTTTGGGA CAACTGTTGC CGAAAATCGT CAATACAGTT CCGGCACATC

101  GGATGCTCTT CCAGATNTTC GGGATGTTCT TTTTCTTCAT ACACCAGCAA

151  TACCTGCCCG GGATCGCCGA AATCGATTCC CCATGCGGCA TCGTGTTCGG

201  TACGCTCCTC TTCCGTCATC NGTCCACGCA TTGCCTGTAT GGTAAAGCCG

251  CCGTAGGGAA TGCCGTTGCA CACGAACATC CAGTCGCTGA TGTCGTCAAC
```

```
301 CGGAACGCAA ACGCTTTCGC CTTGTTCGAC ATTGGTCAGT TCGCCGGGTT

351 CATTGTTCAG CACGCCATAA ATGTAAAGAC CGTCAAAATA AATATCGTCG

401 ATCCACATAT GTTCGCAAAT TTCGCCNTCT TCGCCGTCTT GGAAAAAAGG

451 GCTTTGACCA TGGCAAAATC TAAGGNGNNA NNGATGCGGC GGCGTTCCCA

501 AAAAAGCTCG CGCCAAAAAT ATTTGAATGT TTTGCGGGCG CGTTCGCCGG

551 CACGGTTTAC CGGTTTGTCT GCCTGTTCTA CATAATAAAT GACGGAATCG

601 CCCATCATAT CTGCTCCTCA ACGTGTACGG TATCTGTTTG CACCTTACTG

651 CGGCTTTCTG CCTTCGGCAT CCGATTCGGA TTTGAAAAGT TCCAAATATT

701 CGGAATAG
```

This encodes a protein having amino acid sequence (SEQ ID NO: 554):

```
  1 MMKRRIAVFV LLMQKIRILG QLLPKIVNTV PAHRMLFQXF GMFFFFIHQQ

51 YLPGIAEIDS PCGIVFGTLL FRHXSTHCLY GKAAVGNAVA HEHPVADVVN

101 RNANAFALFD IGQFAGFIVQ HAINVKTVKI NIVDPHMFAN FAXFAVLEKR

151 ALTMAKSKXX XMRRRSQKSS RQKYLNVLRA RSPARFTGLS ACST**MTES

201 PIISAPQRVR YLFAPYCGFL PSASDSDLKS SKYSE*
```

ORF136a (SEQ ID NO: 554) and ORF136-1 (SEQ ID NO: 552) show 73.1% identity in 238 aa overlap:

```
                   10         20         30         40         50         60
orf136a.pep MMKRRIAVFVLLMQKIRILGQLLPKIVNTVPAHRMLFQXFGMFFFFIHQQYLPGIAEIDS
            ||||||||||: |  ||:||||||||||||||||||||||| ||||||||||||||||||
orf136-1    MMKRRIAVFVLFPQIIRVLGQLLPKIVNTVPAHRMLFQIFGMFFFFIHQQYLPGIAEIDS
                   10         20         30         40         50         60

70         80         90        100        110        120
orf136a.pep PCGIVFGTLLFRHXSTHCLYGKAAVGNAVAHEHPVADVVNRNANAFALFDIGQFAGFIVQ
            ||||||:||||   :|||||||||||||:|||||||||||||||||||||||||||||||
orf136-1    PCGIVFGALLFRHLPAHCLYGKAAVGDAVAHEHPVADVVNRNANAFALFDIGQFAGFIVQ
                   70         80         90        100        110        120

130        140        150        160        170        180
orf136a.pep HAINVKTVKINIVDPHMFANFAXFAVLEKRALTMAKSKXXXMRRRSQKSSRQKYLNVLRA
            |::|:|||||||||||||||| ||||||| :  :|  :         |:   | ::  : :
orf136-1    HTVNIKTVKINIVDPHMFANFAVFAVLEKRDFDHGKIQGGNNAAAFPKKLAPKIFECFTG
                  130        140        150        160        170        180

190        200        210        220        230
orf136a.pep R---SPARFTGLSACSTXXMTESPIISAPQRVRYLFAPYCGFLPSASDSDLKSSKYSEX
              :  ||: |  :  :::    ||||||||||||||||||||||||||||||||||||
orf136-1    AFVGTVYRFVCLFYIINDGIAHH---SAPQRVRYLFAPYCGFLPSASDSDLKSSKYSEX
                 190        200        210        220        230
```

Homology with a Predicted ORF from *N.gonorrhoeae*

ORF136 (SEQ ID NO: 550) shows 92.3% identity over a 234aa overlap with a predicted ORF (ORF136ng) (SEQ ID NO: 556) from *N.gonorrhoeae*:

```
orf136.pep  MKRRIAVFVLFPQIIRVLGQLLPKIVNTVPAHRMLFQIFGMFFFFIHQQYLPGIAEIDS   59
            ||||||||||: |  ||:|||||||||||||||||||||||||||||||:|||||||||
orf136ng    MMKRRIAVFVLLMQKIRILGQLLPKIVNTVPAHRMLFQIFGMFFFFIHRQYLPGIAEIDS  60 orf136.pep  PCGIVFGALLFRHLPAHCLYGKAAVGDAVAHEHPVADVVNRNANAFALFDIGQFAXFIVQ 119
            |  |||||:||||   |||||||||||||||||||||||||:|||||||||||| ||||
orf136ng    PGGIVFGTLLFRHLSAHCLYGKAAVGDAVAHEHPVADVANRNANAFALFDIGQSAGFIVQ 120
```

```
orf136.pep  HTVNIKTVKINIVDPHMFANFAVFAVLEKRDFDHGKIQGGNNAAAFPKKLAPKIFECFTG  179
            ||||||||||||||||||||||||||||||||||||||||||||||||||||:||||||
orf136ng    HTVNIKTVKINIVDPHMFANFAVFAVLEKRDFDHGKIQCGNNAAAFPKKLAPKVFECFTG  180 orf136.pep  AFVGTVYRFVCLFYIINDGIAHHSAPQRVRYLFAPYCGFLPSASDSDLKSSXXSE       234
            ||:|||||||||||||||||||||:|||||||||||||  ||||||||||||  ||
orf136ng    AFAGTVYRFVCLFYIINDGIAHHTAPQRVRYLFAPYRGFLPPASDSDLKSSKYSE       235
```

The complete length ORF136ng nucleotide sequence (SEQ ID NO: 555) is:

```
  1 ATGATGGAGC GGCGTATAGC CGTCTTCGTC CTGCTCATGC AGAAAATCCG
 51 GATTTTGGGA CAACTGTTGC CGAAAATCGT CAATACAGTT CCGGCACATC
101 GGATGCTCTT CCAAATTTTC GGGATGTTCT TTTTCTTCAT ACACCGGCAA
151 TACCTGCCCG GGATCGCCGA AATCGATTCC CCAGGCGGTA TCGTGTTCGG
201 TACGCTCCTC TTCCGTCATC TGTCCGCGCA TTGCCTGTAC GGTAAAGCCG
231 CCGTAGGGGA TGCCGTTGCA CACGAACATC CAGTCGCTGA TGTCGCCAAC
301 CGGAACGCAA ACGCTTTCGC CTTGTTCGAC ATTGGTCAGT CCGCCGGGTT
351 CATTGTTCAG CACACCGTAA ATATAAAGAC CGTCAAAATA AATATCGTCG
401 ATCCACATAT GTTCGCAAAT TTCGCCGTCT TCGCCGTCTT GGAAAAAAGG
451 GACTTTGACC ATGGCAAAAT CCAAGGCGGA AATAATGCGG CGGCGTTCCC
501 AAAAAAGCTC GCGCCAAAAG TATTTGAATG TTTTACGGGC GCGTTCGCCG
551 GCACGGTTTA CCGGTTCGTC TGCCTGTTCT ACATAATAAA TGACGGAATC
601 GCCCATCATA CTGCTCCTCA ACGTGTACGG TATCTGTTTG CACCTTACCG
651 CGGTTTTCTA CCTCCGGCAT CCGATTCGGA TTTGAAAAGT TCCAAATATT
701 CGGAATAG
```

This encodes a protein having amino acid sequence (SEQ ID NO: 556):

```
  1 MMKRRIAVFV LLMQKIRILG QLLPKIVNTV PAHRMLFQIF GMFFFFIHRQ
 51 YLPGIAEIDS PGGIVFGTLL FRHLSAHCLY GKAAVGDAVA HEHPVADVAN
101 RNANAFALFD IGQSAGFIVQ HTVNIKTVKI NIVDPHMFAN FAVFAVLEKR
151 DFDHGKIQGG NNAAAFPKKL APKVFECFTG AFAGTVYRFV CLFYIINDGI
201 AHHTAPQRVR YLFAPYRGFL PPASDSDLKS SKYSE*
```

ORF136ng (SEQ ID NO: 556) and ORF136-1 (SEQ ID NO: 552) show 93.6% identity in 235 aa overlap:

```
orf136ng  MMKRRIAVFVLLMQKIRILGQLLPKIVNTVPAHRMLFQIFGMFFFFIHRQYLPGIAEIDS
          ||||||||||:|||::||||||||||||||||||||||||||||||:||||||||||||
orf136-1  MMKRRIAVFVLFPQIIRVLGQLLPKIVNTVPAHRMLFQIFGMFFFFTHQQYLPGIAEIDS orf136ng  PGGIVFGTLLFRHLSAHCLYGKAAVGDAVAHEHPVADVANRNANAFALFDIGQSAGFIVQ
          |||||:||||||||||:||||||||||||||||||||::|||||||||||||:||||||
orf136-1  PCGIVFGALLFRHLPAHCLYGKAAVGDAVAHEHPVADVVNRNANAFALFDIGQFAGFIVQ orf136ng  HTVNIKTVKINIVDPHMFANFAVFAVLEKRDFDHGKIQGGNNAAAFPKKLAPKVFECFTG
          ||||||||||||||||||||||||||||||||||||||||||||||||||||:||||||
orf136-1  HTVNIKTVKINIVDPHMFANFAVFAVLEKRDFDHGKIQGGNNAAAFPKKLAPKIFECFTG
```

```
                           -continued
orf136ng  AFAGTVYRFVCLFYIINDGIAHHTAPQRVRYLFAPYRGFLPPASDSDLKSSKYSEX
          ||:|||||||||||||||||||:|||||||||||  ||||  ||||||||||||||
orf136-1  AFVGTVYRFVCLFYIINDGIAHHSAPQRVRYLFAPYCGFLPSASDSDLKSSKYSEX
```

Based on the presence of the putative transmembrane domains in the gonococcal protein, it is predicted that the proteins from N.meningitidis and N.gonorrhoeae, and their epitopes, could be useful antigens for vaccines or diagnostics, or for raising antibodies.

Example 67

The following partial DNA sequence was identified in N.meningitidis (SEQ ID NO: 557):

```
  1  ATGGAAAATA TGGTAACGTT TTCAAAAATC AGACCGCTTT TGGCAATCGC
 51  CGCCGCCGCG TTGCTTGCCG CC.TGCGGAC GGCGGGAAAT AATGCTGTCC
101  GCAAGCCGGT GCAAACCGCC AAACCCGCCG CAGTGGTCGG TTTGGCACTC
151  GGTGGCGGCG CATCTAAAGG ATTTGCCCAT GTAGGTATTA TTAAGGTTTT
201  GAAAGAAAAC GGTATTCCTG TGAAGGTGGT TACCGGCACC TCCGCAGGTT
251  CGATTGTCGG CAACCTTTTT GCATCGGGTA TGTCGCCCGA CCGCCTCGAA
301  TTGGAAGCCG AAATTTTAGG CAAAACCGAT TTGGTCGATT TAACCTTGTC
351  CACCAATGGG TTTATCAAAG GCGAAAAGCT GCAAAATTAC ATCAACCGAA
401  AACTCCGCGG CATGCAGATT CAGCAGTTTC CCATCAAATT TGCCGCC..
```

This corresponds to the amino acid sequence (SEQ ID NO: 558; ORF137):

```
  1  MENMVTFSKI RPLLAIAAAA LLAAXRTAGN NAVRXPVQTA KPAAVVGLAL
 51  GGGASKGFAH VGIIKVLKEN GIPVKVVTGT SAGSIVGNLF ASGMSPDRLE
101  LEAEILGKTD LVDLTLSTNG FIKGAKLQNY INRKLRGMQI QQFPIKFAA..
```

Further work revealed the complete nucleotide sequence (SEQ ID NO: 559):

```
  1  ATGGAAAATA TGGTAACGTT TTCAAAAATC AGACCGCTTT TGGCAATCGC
 51  CGCCGCCGCG TTGCTTGCCG CCTGCGGCAC GGCGGGAAAT AATGCTGTCC
101  GCAAGCCGGT GCAAACCGCC AAACCCGCCG CAGTGGTCGG TTTGGCACTC
151  GGTGGCGGCG CATCTAAAGG ATTTGCCCAT GTAGGTATTA TTAAGGTTTT
201  GAAAGAAAAC GGTATTCCTG TCAAGGTGGT TACCGGCACA TCGGCAGGTT
251  CGATTGTCGG CAGCCTTTTT GCATCGGGTA TGTCGCCCGA CCGCCTCGAA
301  TTGGAAGCCG AAATTTTAGG CAAAACCGAT TTGGTCGATT TAACCTTGTC
351  CACCAGTGGT TTTATCAAAG GCGAAAAGCT GCAAAATTAC ATCAACCGAA
401  AAGTCGGCGG CAGGCAGATT CAGCAGTTTC CCATCAAATT TGCCGCCGTT
451  GCTACTGATT TTGAAACCGG CAAGGCCGTC GCTTTCAATC AGGGGAATGC
501  CGGGCAGGCT GTGCGCGCTT CCGCCGCCAT TCCCAATGTG TTCCAACCCG
551  TTATCATCGG CAGGCATACA TATGTTGACG GCGGTCTGTC GCAGCCCGTG
601  CCCGTCAGTG CCGCCCGGCG GCAGGGGGCG AATTTCGTGA TTGCCGTCGA
651  TATTTCCGCC CGTCCGGGCA AAAACATCAG CCAAGGTTTC TTCTCTTATC
```

```
                    -continued
701  TCGATCAGAC GCTGAACGTA ATGAGCGTTT CTGCGTTGCA AAATGAGTTG

751  GGGCAGGCGG ATGTGGTTAT CAAACCGCAG GTTTTGGATT TGGGTGCAGT

801  CGGCGGATTC GATCAGAAAA AACGCGCCAT CCGGTTGGGT GAGGAGGCAG

851  CACGTGCCGC ATTGCCTGAA ATCAAACGCA AACTGGCGGC ATACCGTTAT

901  TGA
```

This corresponds to the amino acid sequence (SEQ ID NO: 560; ORF137-1):

```
  1  MENMVTFSKI RPLLAIAAAA LLAACGTAGN NAVRKPVQTA KPAAVVGLAL

51  GGGASKGFAH VGIIKVLKEN GIPVKVVTGT SAGSIVGSLF ASGMSPDRLE

101  LEAEILGKTD LVDLTLSTSG FIKGEKLQNY INRKVGGRQI QQFPIKFAAV

151  ATDFETGKAV AFNQGNAGQA VRASAAIPNV FQPVIIGRHT YVDGGLSQPV

201  PVSAARRQGA NFVIAVDISA RPGKNISQGF FSYLDQTLNV MSVSALQNEL

251  GQADVVIKPQ VLDLGAVGGF DQKKRAIRLG EEAARAALPE IKRKLAAYRY

301  *
```

Computer analysis of this amino acid sequence gave the following results:
Homology with a Predicted ORF from *N.meningitidis* 30 (Strain A)

ORF137 (SEQ ID NO: 558) shows 93.3% identity over a 149aa overlap with an ORF (ORF137a) (SEQ ID NO: 562) from strain A of *N. meningitidis*:

```
                   10        20        30        40        50        60
orf137.pep  MENMVTFSKIRPLLAIAAAALLAAXRTAGNNAVRKPVQTAKPAAVVGLALGGGASKGFAH
            |||||||||||||||||||||||| ||||||:||||||||||||||||||||||||||||
orf137a     MENMVTFSKIRPLLAIAAAALLAACGTAGNNAARKPVQTAKPAAVVGLALGGGASKGFAH
                   10        20        30        40        50        60

70        80        90       100       110       120
orf137.pep  VGIIKVLKENGIPVKVVTGTSAGSIVGNLFASGMSPDRLELEAEILGKTDLVDLTLSTNG
            |||||||||||||||||||||||||||:||||||||||||||||||||||||||||||:|
orf137a     VGIIKVLKENGIPVKVVTGTSAGSIVGSLFASGMSPDRLELEAEILGKTDLVDLTLSTSG
                   70        80        90       100       110       120

130       140       149
orf137.pep  FIKGAKLQNYINRKLRGMQIQQFPIKFAA
            ||||  |||||||||: | :|||||||||
orf137a     FIKGEKLQNYINRKVGGRRIQQFPIKFAAVATDFETGKAVAFNQGNAGQAVRASAAIPNV
                  130       140       150       160       170       180
```

The complete length ORF137a nucleotide sequence (SEQ ID NO: 561) is:

```
  1  ATGGAAAATA TGGTAACGTT TTCAAAAATC AGACCGCTTT TGGCAATCGC

51  CGCCGCCGCG TTGCTTGCCG CCTGCGGCAC GGCGGGAAAT AATGCTGCCC

101  GCAAGCCGGT GCAAACCGCC AAACCCGCCG CAGTGGTCGG TTTGGCACTC

151  GGTGGCGGCG CATCTAAAGG ATTTGCCCAT GTAGGTATTA TTAAGGTTTT

201  GAAAGAAAAC GGTATTCCTG TGAAGGTGGT TACCGGCACA TCGGCAGGTT

251  CGATAGTCGG CAGCCTTTTT GCATCGGGTA TGTCGCCCGA CCGCCTCGAA
```

```
                  -continued
301  TTGGAAGCCG AAATTTTAGG TAAAACCGAT TTGGTCGATT TAACCTTGTC

351  CACCAGTGGT TTTATCAAAG GCGAAAAGCT GCAAAATTAC ATCAACCGAA

401  AAGTCGGCGG CAGGCGGATT CAGCAGTTTC CCATCAAATT TGCCGCCGTT

451  GCTACTGATT TTGAAACCGG CAAGGCCGTC GCTTTCAATC AAGGGAATGC

501  CGGGCAGGCT GTGCGCGCTT CCGCCGCCAT TCCCAATGTG TTCCAACCCG

551  TTATCATCGG CAGGCATACA TATGTTGACG GCGGTCTGTC GCAGCCCGTG

601  CCCGTCAGTG CCGCCCGGCG GCANGNNNNG NATNTCGTGA TTGCCGTCGA

651  TATTTCCGCC CGTCCGAGCA AAAACATCAG CCAAGGCTTC TTCTCTTATC

701  TCGATCAGAC GCTGAACGTA ATGAGCGTTT CCGCGTTGCA AAATGAGTTG

751  GGGCAGGCGG ATGTGGTTAT CAAACCGCAG GTTTTGGATT TGGGTGCAGT

801  CGGCGGATTC GATCAGAAAA AACGCGCCAT CCGGTTGGGT GAGGAGGCAG

851  CACGTGCCGC ATTGCCTGAA ATCAAACGCA AACTGGCGGC ATACCGTTAT

901  TGA
```

This encodes a protein having amino acid sequence (SEQ ID NO: 562):

```
  1  MENMVTFSKI RPLLAIAAAA LLAACGTAGN NAARKPVQTA KPAAVVGLAL

51  GGGASKGFAH VGIIKVLKEN GIPVKVVTGT SAGSIVGSLF ASGMSPDRLE

101  LEAEILGKTD LVDLTLSTSG FIKGEKLQNY INRKVGGRRI QQFPIKFAAV

151  ATDFETGKAV AFNQGNAGQA VRASAAIPNV FQPVIIGRHT YVDGGLSQPV

201  PVSAARRXXX XXVIAVDISA RPSKNISQGF FSYLDQTLNV MSVSALQNEL

251  GQADVVIKPQ VLDLGAVGGF DQKKRAIRLG EEAARAALPE IKRKLAAYRY

301  *
```

ORF137a (SEQ ID NO: 562) and ORF137-1 (SEQ ID NO: 560) show 97.3% identity in 300 aa overlap:

```
orf137a.pep MENMVTFSKIRPLLAIAAAALLAACGTAGNNAARKPVQTAKPAAVVGLALGGGASKGFAH
            |||||||||||||||||||||||||||||||:|||||||||||||||||||||||||||
orf137-1    MENMVTFSKIRPLLAIAAAALLAACGTAGNNAVRKPVQTAKPAAVVGLALGGGASKGFAH orf137a.pep VGIIKVLKENGIPVKVVTGTSAGSIVGSLFASGMSPDRLELEAEILGKTDLVDLTLSTSG
            ||||||||||||||||||||||||||||||||||||||||||||||||||||||||||||
orf137-1    VGIIKVLKENGIPVKVVTGTSAGSIVGSLFASGMSPDRLELEAEILGKTDLVDLTLSTSG orf137a.pep FIKGEKLQNYINRKVGGRRIQQFPIKFAAVATDFETGKAVAFNQGNAGQAVRASAAIPNV
            |||||||||||||||||||:||||||||||||||||||||||||||||||||::||||||
orf137-1    FIKGEKLQNYINRKVGGRQIQQFPIKFAAVATDFETGKAVAFNQGNAGQAVAASAAIPNV orf137a.pep FQPVIIGRHTYVDGGLSQPVPVSAARRXXXXXVIAVDISARPSKNISQGFFSYLDQTLNV
            |||||||||||||||||||||||||||        |||||||:||||||||||||||||
orf137-1    FQPVIIGRHTYVDGGLSQPVPVSAARRQGANFVIAVDISARPGKNISQGFFSYLDQTLNV orf137a.pep MSVSALQNELGQADVVIKPQVLDLGAVGGFDQKKRAIRLGEEAARAALPEIKRKLAAYRY
            ||||||||||||||||||||||||||||||||||||||||||||||||||||||||||||
orf137-1    MSVSALQNELGQADVVIKPQVLDLGAVGGFDQKKRAIRLGEEAARAALPEIKRKLAAYRY
```

Homology with a Predicted ORF from *N.gonorrhoeae*
ORF137 (SEQ ID NO: 558) shows 89.9% identity over a 149aa overlap with a predicted ORF (ORF137ng) (SEQ ID NO: 564) from *N.gonorrhoeae*:

```
orf137.pep  MENMVTFSKIRPLLAIAAAALLAAXRTAGNNAVRKPVQTAKPAAVVGLALGGGASKGFAH   60
            |||||||||||| :|||||||||||  ||||||:||||||||||||||:|||||||||||
orf137ng    MENMVTFSKIRSFLAIAAAALLAACGTAGNNAARKPVQTAKPAAVVALALGGGASKGFAH   60 orf137.pep  VGIIKVLKENGIPVKVVTGTSAGSIVGNLFASGMSPDRLELEAEILGKTDLVDLTLSTNG  120
            :||:||||||||||||||||||||||||:|:||||||||||||||||||||||||||:|
orf137ng    IGIVKVLKENGTPVKVVTGTSAGSIVGSLLASGMSPDRLELEAEILGKTDLVDLTLSTSG  120 orf137.pep  FIKGAKLQNYINRKLRGMQIQQFPIKFAA                                149
            ||||  |||||||||:  |  ||||||||||
orf137ng    FIKGEKLQNYINRKVGGRQIQQFPIKFAAVATDFETGKAVAFNQGNAGQAVRASAAIPNV  180
```

The complete length ORF137ng nucleotide sequence (SEQ ID NO: 563) is:

```
  1  ATGGAAAATA TGGTAACGTT TTCAAAAATC AGATCATTTT TGGCAATCGC
 51  CGCCGCCGCG TTGCTTGCCG CCTGCGGTAC GGCGGGAAAC AATGCCGCCC
101  GCAAGCCGGT GCAAACCGCC AAACCCGCCG CAGTGGTCGC TTTGGCACTC
151  GGTGGCGGCG CATCTAAAGG ATTTGCCCAT ATAGGAATTG TTAAGGTTTT
201  GAAAGAAAAC GGTATTCCTG TGAAGGTGGT TACCGGCACA TCGGCAGGTT
251  CGATAGTCGG CAGCCTTTTG GCATCGGGTA TGTCGCCCGA CCGCCTCGAA
301  TTGGAAGCCG AGATTTTAGG TAAAACCGAT TTAGTCGATT TAACCTTGTC
351  CACCAGTGGT TTTATCAAAG GCGAAAAGCT GCAAAATTAC ATCAACCGAA
401  AAGTCGGCGG CAGGCAGATT CAGCAGTTTC CCATCAAATT TGCCGCCGTT
451  GCCACTGATT TTGAAACCGG CAAGGCCGTC GCTTTCAATC AAGGGAATGC
501  CGGGCAGGCG GTTCGTGCTT CCGCCGCCAT TCCCAATGTG TTCCAGCCAG
551  TCATCATCGG CAGGCACAAA TATGTTGACG GCGGTCTGTC GCAGCCCGTG
601  CCCGTCAGTG CCGCTCGGCG GCAGGGGGCG AATTTCGTGA TTGCCGTCGA
651  TATTTCCGCA CGTCCGAGCA AAAATGTCGG TCAAGGTTTC TTCTCTTATC
701  TCGATCAGAC GCTGAACGTG ATGAGCGTTT CCGTGTTGCA AAACGAGTTG
751  gggcAGGCGG ATGTGGTTAT CAAACCGCag gtTTTGGATT TGGGTGCAGT
801  CGGCGGATTC GATCAGAAAA AGCGCGCCAT CCGGTTGGGC GAGGAGGCAG
851  CACGTGCCGC ATTGCCTGAA ATCAAACGCA AACTGGCGGC ATACCGTTAT
901  TGA
```

This encodes a protein having amino acid sequence (SEQ ID NO: 564):

```
  1  MENMVTFSKI RSFLAIAAAA LLAACGTAGN NAARKPVQTA KPAAVVALAL
 51  GGGASKGFAH IGIVKVLKEN GIPVKVVTGT SAGSIVGSLL ASGMSPDRLE
101  LEAEILGKTD LVDLTLSTSG FIKGEKLQNY INRKVGGRQI QQFPIKFAAV
151  ATDFETGKAV AFNQGNAGQA VRASAAIPNV FQPVIIGRHK YVDGGLSQPV
201  PVSAARRQGA NFVIAVDISA RPSKNVGQGF FSYLDQTLNV MSVSVLQNEL
251  GQADVVIKPQ VLDLGAVGGF DQKKRAIRLG EEAARAALPE IKRKLAAYRY
301  *
```

ORF137ng (SEQ ID NO: 564) and ORF137-1 (SEQ ID NO: 560) show 96.0% identity in 300 aa overlap:

```
orf137ng MENMVTFSKIRSFLAIAAAALLAACGTAGNNAARKPVQTAKPAAVVALALGGGASKGFAH
         ||||||||||:||||||||||||||||||||:|||||||||||||:||||||||||||
orf137-1 MENMVTFSKIRPLLAIAAAALLAACGTAGNNAVRKPVQTAKPAAVVGLALGGGASKGFAH orf137ng IGIVKVLKENGIPVKVVTGTSAGSIVGSLLASGMSPDRLELEAEILGKTDLVDLTLSTSG
         :||:|||||||||||||||||||||||||:|||||||||||||||||||||||||||||
orf137-1 VGIIKVLKENGIPVKVVTGTSAGSIVGSLFASGMSPDRLELEAEILGKTDLVDLTLSTSG orf137ng FIKGEKLQNYINRKVGGRQIQQFPIKFAAVATDFETGKAVAFNQGNAGQAVRASAAIPNV
         ||||||||||||||||||||||||||||||||||||||||||||||||||||||||||||
orf137-1 FIKGEKLQNYINRKVGGRQIQQFPIKFAAVATDFETGKAVAFNQGNAGQAVRASAAIPNV orf137ng FQPVIIGRHKYVDGGLSQPVPVSAARRQGANFVIAVDISARPSKNVGQGFFSYLDQTLNV
         ||||||||| ||||||||||||||||||||||||||||||||:||::||||||||||||
orf137-1 FQPVIIGRHTYVDGGLSQPVPVSAARRQGANFVIAVDISARPGKNISQGFFSYLDQTLNV orf137ng MSVSVLQNELGQADVVIKPQVLDLGAVGGFDQKKRAIRLGEEAARAALPEIKRKLAAYRY
         ||||:|||||||||||||||||||||||||||||||||||||||||||||||||||||||
orf137   MSVSALQNELGQADVVIKPQVLDLGAVGGFDQKKRAIRLGEEAARAALPEIKRKLAAYRY
```

Based on the presence of a predicted prokaryotic membrane lipoprotein lipid attachment site (underlined) in the gonococcal protein, it is predicted that the proteins from *N.meningitidis* and *N.gonorrhoeae*, and their epitopes, could be useful antigens for vaccines or diagnostics, or for raising antibodies.

Example 68

The following partial DNA sequence was identified in *N.meningitidis* (SEQ ID NO: 565):

```
  1 ATGTTTCGTT TACAATTCAG GCTGTTTCCC CCTTTGCGAA CCGCCATGCA
 51 CATCCTGTTG ACCGCCCTGC TCAAATGCCT CTCCCTGcTG CCGCTTTCCT
101 GTCTGCACAC GCTGGGAAAC CGGCTCGGAC ATCTGGCGTT TTACCTTTTA
151 AAGGAAGACC GCGCGCGCAT CGTCGCCmAT ATGCGGCAGG CGGGTTTGAA
201 CCCCGACCCC AAAACGGTCA AAGCCGTTTT TGCGGAAACG GCAAAAGGCG
251 GTTTGGAACT TGCCCCCGCG TTTTTCAGAA AACCGGAAGA CATAGAAACA
301 ATGTTCAAAG CGGTACACGG CTGGGAACAT GTGCAGCAGG CTTTGGACAA
351 ACACGAAGGG CTGCTATTC..
```

This corresponds to the amino acid sequence (SEQ ID NO: 566; ORF138):

```
  1 MFRLQFRLFP PLRTAMHILL TALLKCLSLL PLSCLHTLGN RLGHLAFYLL
 51 KEDRARIVAX MRQAGLNPDP KTVKAVFAET AKGGLELAPA FFRKPEDIET
101 MFKAVHGWEH VQQALDKHEG LLF
```

Further work revealed the complete nucleotide sequence (SEQ ID NO: 567):

```
  1 ATGTTTCGTT TACAATTCAG GCTGTTTCCC CCTTTGCGAA CCGCCATGCA
 51 CATCCTGTTG ACCGCCCTGC TCAAATGCCT CTCCCTGCTG CCGCTTTCCT
101 GTCTGCACAC GCTGGGAAAC CGGCTCGGAC ATCTGGCGTT TTACCTTTTA
151 AAGGAAGACC GCGCGCGCAT CGTCGCCAAT ATGCGGCAGG CGGGTTTGAA
201 CCCCGACCCC AAAACGGTCA AAGCCGTTTT TGCGGAAACG GCAAAAGGCG
```

-continued
```
251  GTTTGGAACT TGCCCCCGCG TTTTTCAGAA AACCGGAAGA CATAGAAACA

301  ATGTTCAAAG CGGTACACGG CTGGGAACAT GTGCAGCAGG CTTTGGACAA

351  ACACGAAGGG CTGCTATTCA TCACGCCGCA CATCGGCAGC TACGATTTGG

401  GCGGACGCTA CATCAGCCAG CAGCTTCCGT TCCCGCTGAC CGCCATGTAC

451  AAACCGCCGA AAATCAAAGC GATAGACAAA ATCATGCAGG CGGGCAGGGT

501  TCGCGGCAAA GGAAAAACCG CGCCTACCAG CATACAAGGG GTCAAACAAA

551  TCATCAAAGC CCTGCGTTCG GGCGAAGCAA CCATCGTCCT GCCCGACCAC

601  GTCCCCTCCC CTCAAGAAGG CGGGGAAGGC GTATGGGTGG ATTTCTTCGG

651  CAAACCTGCC TATACCATGA CGCTGGCGGC AAAATTGGCA CACGTCAAAG

701  GCGTGAAAAC CCTGTTTTTC TGCTGCGAAC GCCTGCCTGG CGGACAAGGT

751  TTCGATTTGC ACATCCGCCC CGTCCAAGGG GAATTGAACG GCGACAAAGC

801  CCATGATGCC GCCGTGTTCA ACCGCAATGC CGAATATTGG ATACGCCGTT

851  TTCCGACGCA GTATCTGTTT ATGTACAACC GCTACAAAAT GCCGTAA
```

This corresponds to the amino acid sequence (SEQ ID NO: 568; ORF138-1):

```
  1  MFRLQFRLFP PLRTAMHILL TALLKCLSLL PLSCLHTLGN RLGHLAFYLL

51  KEDRARIVAN MRQAGLNPDP KTVKAVFAET AKGGLELAPA FFRKPEDIET

101  MFKAVHGWEH VQQALDKHEG LLFITPHIGS YDLGGRYISQ QLPFPLTAMY

151  KPPKIKAIDK IMQAGRVRGK GKTAPTSIQG VKQIIKALRS GEATIVLPDH

201  VPSPQEGGEG VWVDFFGKPA YTMTLAAKLA HVKGVKTLFF CCERLPGGQG

251  FDLHIRPVQG ELNGDKAHDA AVFNRNAEYW IRRFPTQYLF MYNRYKMP*
```

Computer analysis of this amino acid sequence gave the following results:

Homology with a Predicted ORF from *N.meningitidis* (Strain A)

ORF138 (SEQ ID NO: 566) shows 99.2% identity over a 123aa overlap with an ORF (ORF138a) (SEQ ID NO: 570) from strain A of *N. meningitidis*:

```
                    10         20         30         40         50         60
orf138.pep  MFRLQFRLFPPLRTAMHILLTALLKCLSLLPLSCLHTLGNRLGHLAFYLLKEDRARIVAX
            ||||||||||||||||||||||||||||||||||||||||||||||||||||||||||||
orf138a     MFRLQFRLFPPLRTAMHILLTALLKCLSLLPLSCLHTLGNRLGHLAFYLLKEDRARIVAN
                    10         20         30         40         50         60

70         80         90        100        110        120
orf138.pep  MRQAGLNPDPKTVKAVFAETAKGGLELAPAFFRKPEDIETMFKAVHGWEHVQQALDKHEG
            ||||||||||||||||||||||||||||||||||||||||||||||||||||||||||||
orf138a     MRQAGLNPDPKTVKAVFAETAKGGLELAPAFFRKPEDIETMFKAVHGWEHVQQALDKHEG
                    70         80         90        100        110        120 orf138.pep  LLF
            |||
orf138a     LLFITPHIGSYDLGGRYISQQLPFPLTAMYKPPKIKAIDKIMQAGRVRGKGKTAPTSIQG
                   130        140        150        160        170        180
```

The complete length ORF138a nucleotide sequence (SEQ ID NO: 569) is:

```
  1 ATGTTTCGTT TACAATTCAG GCTGTTTCCC CCTTTGCGAA CCGCCATGCA
 51 CATCCTGTTG ACCGCCCTGC TCAAATGCCT CTCCCTGCTG CCGCTTTCCT
101 GTCTGCACAC GCTGGGAAAC CGGCTCGGAC ATCTGGCGTT TTACCTTTTA
151 AAGGAAGACC GCGCGCGCAT CGTCGCCAAT ATGCGTCAGG CAGGCATGAA
201 TCCCGACCCC AAAACGGTCA AAGCCGTTTT TGCGGAAACG GCAAAAGGCG
251 GTTTGGAACT TGCCCCCGCG TTTTTCAGAA AACCGGAAGA CATAGAAACA
301 ATGTTCAAAG CGGTACACGG CTGGGAACAT GTGCAGCAGG CTTTGGACAA
351 ACACGAAGGG CTGCTATTCA TCACGCCGCA CATCGGCAGC TACGATTTGG
401 GCGGACGCTA CATCAGCCAG CAGCTTCCGT TCCCGCTGAC CGCCATGTAC
451 AAACCGCCGA AAATCAAAGC GATAGACAAA ATCATGCAGG CGGGCAGGGT
501 TCGCGGCAAA GGAAAAACCG CGCCTACCAG CATACAAGGG GTCAAACAAA
551 TCATCAAAGC CCTGCGTTCG GGCGAAGCAA CCATCGTCCT GCCCGACCAC
601 GTCCCCTCCC CTCAAGAAGG CGGGGAAGGC GTATGGGTGG ATTTCTTCGG
651 CAAACCTGCC TATACCATGA CGCTGGCGGC AAAATTGGCA CACGTCAAAG
701 GCGTGAAAAC CCTGTTTTTC TGCTGCGAAC GCCTGCCTGG CGGACAAGGT
751 TTCGATTTGC ACATCCGCCC CGTCCAAGGG GAATTGAACG GCGACAAAGC
801 CCATGATGCC GCCGTGTTCA ACCGCAATGC CGAATATTGG ATACGCCGTT
851 TTCCGACGCA GTATCTGTTT ATGTACAACC GCTACAAAAT GCCGTAA
```

This encodes a protein having amino acid sequence (SEQ ID NO: 570):

```
  1 MFRLQFRLFP PLRTAMHILL TALLKCLSLL PLSCLHTLGN RLGHLAFYLL
 51 KEDRARIVAN MRQAGLNPDP KTVKAVFAET AKGGLELAPA FFRKPEDIET
101 MFKAVHGWEH VQQALDKHEG LLFITPHIGS YDLGGRYISQ QLPFPLTAMY
151 KPPKIKAIDK IMQAGRVRGK GKTAPTSIQG VKQIIKALRS GEATIVLPDH
201 VPSPQEGGEG VWVDFFGKPA YTMTLAAKLA HVKGVKTLFF CCERLPGGQG
251 FDLHIRPVQG ELNGDKAHDA AVFNRNAEYW IRRFPTQYLF MYNRYKMP*
```

ORF138a (SEQ ID NO: 570) and ORF138-1 (SEQ ID NO: 568) show 99.7% identity over a 298aa overlap:

```
orf138a.pep MFRLQFRLFPPLRTAMHILLTALLKCLSLLPLSCLHTLGNRLGHLAFYLLKEDRARIVAN
            ||||||||||||||||||||||||||||||||||||||||||||||||||||||||||||
orf138-1    MFRLQFRLFPPLRTAMHILLTALLKCLSLLPLSCLHTLGNRLGHLAFYLLKEDRARIVAN orf138a.pep MRQAGMNPDPKTVKAVFAETAKGGLELAPAFFRKPEDIETMFKAVHGWEHVQQALDKHEG
            |||||:||||||||||||||||||||||||||||||||||||||||||||||||||||||
orf138-1    MRQAGLNPDPKTVKAVFAETAKGGLELAPAFFRKPEDIETMFKAVHGWEHVQQALDKHEG orf138a.pep LLFITPHIGSYDLGGRYISQQLPFPLTAMYKPPKIKAIDKIMQAGRVRGKGKTAPTSTQG
            ||||||||||||||||||||||||||||||||||||||||||||||||||||||||||||
orf138-1    LLFITPHIGSYDLGGRYISQQLPFPLTAMYKPPKIKAIDKIMQAGRVRGKGKTAPTSTQG orf138a.pep VKQIIKALRSGEATIVLPDHVPSPQEGGEGVWVDFFGKPAYTMTLAAKLAHVKGVKTLFF
            ||||||||||||||||||||||||||||||||||||||||||||||||||||||||||||
orf138-1    VKQIIKALRSGEATIVLPDHVPSPQEGGEGVWVDFFGKPAYTMTLAAKLAHVKGVKTLFF
```

-continued
```
orf138a.pep  CCERLPGGQGFDLHIRPVQGELNGDKAHDAAVFNRNAEYWIRRFPTQYLFMYNRYKMP
             ||||||||||||||||||||||||||||||||||||||||||||||||||||||||||
orf138-1     CCERLPGGQGFDLHIRPVQGELNGDKAHDAAVFNRNAEYWIRRFPTQYLFMYNRYKMP
```

Homology with a Predicted ORF from *N.gonorrhoeae*
ORF138 (SEQ ID NO: 566) shows 94.3% identity over a 123aa overlap with a predicted ORF (ORF138ng) (SEQ ID NO: 572) from *N.gonorrhoeae*:

```
orf138.pep   MFRLQFRLFPPLRTAMHILLTALLKCLSLLPLSCLHTLGNRLGHLAFYLLKEDRARIVAX   60
             |||||||||||||||||||||||||||||||| |||||||||||||||||||||||||||
orf138ng     MFRLQFRLFPPLRTAMHILLTALLKCLSLLSLSCLHTLGNRLGHLAFYLLKEDRARIVAN   60 orf138.pep   MRQAGLNPDPKTVKAVFAETAKGGLELAPAFFRKPEDIETMFKAVHGWEHVQQALDKHEG  120
             |||||||||:|||||||||||||:||||||||||||||||||||||||||||||||| ||
orf138ng     MRQAGLNPDTQTVKAVFAETAKCGLELAPAFFKKPEDIETMFKAVHGWEHVQQALDKGEG  120 orf138.pep   LLF                                                           123
             |||
orf138ng     LLFITPHIGSYDLGGRYISQQLPFHLTAMYKPPKIKAIDKIMQAGRVRGKGKTAPTGIQG  180
```

The complete length ORF138ng nucleotide sequence (SEQ ID NO: 571) is:

```
  1  ATGTTTCGTT TACAATTCAG GCTGTTTCCC CCTTTGCGAA CCGCCATGCA

51  CATCCTGTTG ACCGCCCTGC TCAAATGCCT CTCCCTGCTG TCGCTTTCCT

101  GTCTGCACAC GCTGGGAAAC CGGCTCGGAC ATCTGGCGTT TTACCTTTTA

151  AAGGAAGACC GCGCGCGCAT CGTCGCCAAT ATGCGGCAGG CGGGTTTGAA

201  CCCCGACACG CAGACGGTCA AGCCGTTTT TGCGGAAACG GCAAAATGCG

251  GTTTGGAACT TGCCCCCGCG TTTTTCAAAA AACCGGAAGA CATCGAAACA

301  ATGTTCAAAG CGGTACACGG CTGGGAACAC GTGCAGCAGG CTTTGGACAA

351  GGGCGAAGGG CTGCTGTTCA TCACGCCGCA CATCGGCAGC TACGATTTGG

401  GCGGACGCTA CATCAGCCAG CAGCTTCCGT TCCACCTGAC CGCCATGTAC

451  AAGCCGCCGA AAATCAAAGC GATAGACAAA ATCATGCAGG CGGGCAGGGT

501  GCGCGGCAAA GGCAAAACcg cgcccaccgg catACAAGGG GTCAAACAAA 551  tcatcaAGGC CCTGCGCGCG GGCGAGGCAA CCAtcATCCT GCCCGACCAC 601  GTCCCTTCTC CGCAGGAagg cggCGGCGTG TGGGCGGATT TTTTCGGCAA 651  ACCTGCATAc acCATGACAC TGGCCGCAAA ATTGGCACAC GTCAAAGGCG

701  TGAAAACCCT GTTTTTCTGC TGCGAACGCC TGCCCGACGG ACAAGGCTTC

751  GTGTTGCACA TCCGCCCCGT CCAAGGGCAA TTGAACGGCA ACAAAGCCCA

801  CGATGCCGCC GTGTTCAACC GCAATACCGA ATATTGGATA CGCCGTTTTC

851  CGACGCAGTA TCTGTTTATG TACAACCGCT ATAAAACGCC GTAA
```

This encodes a protein having amino acid sequence (SEQ ID NO: 572):

```
  1  MFRLQFRLFP PLRTAMHILL TALLKCLSLL SLSCLHTLGN RLGHLAFYLL

51  KEDRARIVAN MRQAGLNPDT QTVKAVFAET AKCGLELAPA FFKKPEDIET

101  MFKAVHGWEH VQQALDKGEG LLFITPHIGS YDLGGRYISQ QLPFHLTAMY
```

```
151 KPPKIKAIDK IMQAGRVRGK GKTAPTGIQG VKQIIKALRA GEATIILPDH

201 VPSPQEGGGV WADFFGKPAY TMTLAAKLAH VKGVKTLFFC CERLPDGQGF

251 VLHIRPVQGE LNGNKAHDAA VFNRNTEYWI RRFPTQYLFM YNRYKTP*
```

ORF138ng (SEQ ID NO: 572) and ORF138-1 (SEQ ID NO: 568) show 94.3% identity over 299aa overlap:

```
orf138-1.pep    MFRLQFRLFPPLRTAMHILLTALLKCLSLLPLSCLHTLGNRLGHLAFYLLKEDRARIVAN
                |||||||||||||||||||||||||||||| |||||||||||||||||||||||||||||
orf138ng        MFRLQFRLFPPLRTAMHILLTALLKCLSLLSLSCLHTLGNRLGHLAFYLLKEDRARIVAN orf138-1.pep    MRQAGLNPDPKTVKAVFAETAKGGLELAPAFFRKPEDIETMFKAVHGWEHVQQALDKHEG
                |||||||||:|||||||||||  ||||||||||:||||||||||||||||||||||| ||
orf138ng        MRQAGLNPDTQTVKAVFAETAKCGLELAPAFFKKPEDIETMFKAVHGWEHVQQALDKGEG orf138-1.pep    LLFITPHIGSYDLGGRYISQQLPFPLTAMYKPPKIKAIDKIMQAGRVRGKGKTAPTSIQG
                |||||||||||||||||||||||||| ||||||||||||||||||||||||||||||:|||
orf138ng        LLFITPHIGSYDLGGRYISQQLPFHLTAMYKPPKIKAIDKIMQAGRVRGKGKTAPTGIQG orf138-1.pep    VKQIIKALRSGEATIVLPDHVPSPQEGGEGVWVDFFGKPAYTMTLAAKLAHVKGVKTLFF
                ||||||||:|||||:|||||||||||| |||:||||||||||||||||||||||||||||
orf138ng        VKQIIKALRAGEATIILPDHVPSPQEGG-GVWADFFGKPAYTMTLAAKLAHVKGVKTLFF orf138-1.pep    CCERLPGGQGFDLHIRPVQGELNGDKAHDAAVFNRNAEYWIRRFPTQYLFMYNRYKMP
                ||||||  ||||  |||||||||||||:|||||||||||:|||||||||||||||||||  |
orf138ng        CCERLPDGQGFVLHIRPVQGELNGNKAHDAAVFNRNTEYWIRRFPTQYLFMYNRYKTP
```

In addition, ORF138ng (SEQ ID NO: 572) is homologous to htrB protein (SEQ ID NO: 1147) from *Pseudomonas fluorescens*:

```
gnl|PID|e334283 (Y14568) htrB [Pseudomonas fluorescens] Length = 253
Score = 80.8 bits (196), Expect = 9e-15
Identities = 49/151 (32%), Positives = 79/151 (51%), Gaps = 6/151 (3%)

Query   101 MFKAVHGWEHVQQALDKGEGLLFITPHIGSYD-LGGRYISQQLPFHLTAMYKPPKIKAID   159
              + + V G E +++AL  G+G++ IT H+G+++  L    Y SQ  P       Y+PPK+KA+D
Sbjct:   94 LVREVEGLEVLKEALASGKGVVGITSHLGNWEVLNHFYCSQCKPI---IFYRPPKLKAVD  150

Query:  160 KIMQAGRVRGKGKTAPTGIQGVKQIIKALRAGEATIILPDHVPSPQEGGGVWADFFGKPA  219
              ++++  RV+   K A +  +G+  +IK +R G    I  D  P P E  G++   FF    A
Sbjct:  151 ELLRKQRVQLGNKVAASTKEGILSVIKEVRKGGQVGIPAD--PEPAESAGIFVPFFATQA  208

Query:  220 YTMTLAAKLAHVKGVKTLFFCCERLPDGQGF                              250
                T    +      +F    RLPDG G+
Sbjct   209 LTSKFVPNMLAGGKAVGVFLHALRLPDGSGY                              239
```

Figure 14A:
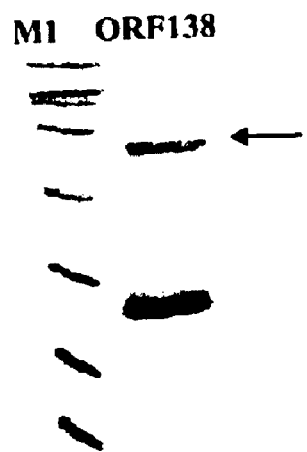
Figure 14B:
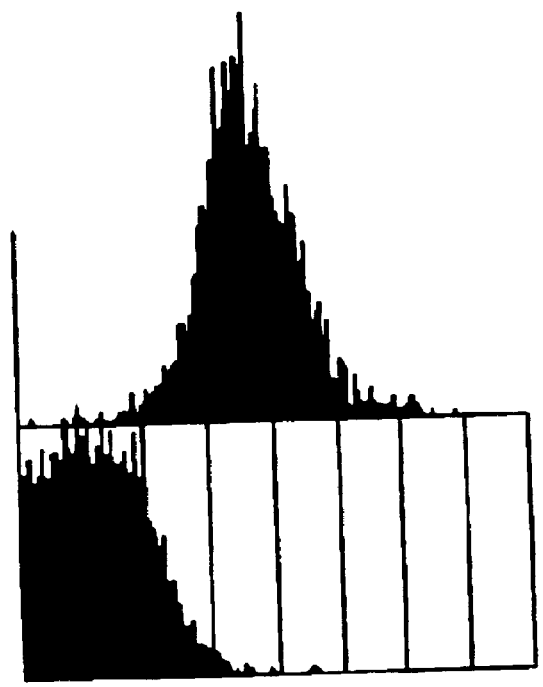

Based on this analysis, including the presence of a putative transmembrane domain in the gonococcal protein, it was predicted that the proteins from *N.meningitidis* and *N.gonorrhoeae*, and their epitopes, could be useful antigens for vaccines or diagnostics, or for raising antibodies. ORF138-1 (SEQ ID NO: 568) (57 kDa) was cloned in the pGex vectors and expressed in *E.coli*, as described above. The products of protein expression and purification were analyzed by SDS-PAGE. FIG. 14A shows the results of affinity purification of the GST-fusion protein. Purified GST-fusion protein was used to immunise mice, whose sera were used for ELISA (positive result) and FACS analysis (FIG. 14B). These experiments confirm that ORF138-1 (SEQ ID NO: 568) is a surface-exposed protein, and that it is a useful immunogen.

Example 69

The following partial DNA sequence was identified in *N.meningitidis* (SEQ ID NO: 573):

```
  1 ..GCGTGGTCGG CCGGCGAATC GTGGCGTGTG TTAATGGAAA GTGAAACGTG

51 GCATGCGGTG TGGAATACTT TGCGCTTCTC GGCGGCGGCG GTGTATGCGG

101 CAGCGGTTTT GGGTGTGGTG TATGCGGCGC CGGCGCGGCG GTCGGCGTGG
```

```
                    -continued
151 ATGCGCGGGC TGATGTTTTA GCCGTTTATG GTGTCGCCGG TTTGTGTTTC

201 GGCGGGCGTG CTGCTGCTTT ATCCGCAGTG GACGGCTTCG TTGCCGTTGC

251 TGCTGGCGAT GTATGCGCTG CTGGCGTATC CGTTTGTGGC AAAAGATGTT

301 TTATCAGCCT GGGATGCACT GCCGCCGGAT TACGGCAGGG CGGCGGCGGG

351 TTTGGGTGCA AACGGCTTTC AGACGGCATG CCGCATCACG TTCCCCCTCT

401 TGAAACCGGC GTTGCGGCGC GGTCTGACTT TGGCGGCGGC AACCTGCGTG

451 GGCGAATTTG CGGCGACATT GTTTCTGTCG CGTCCGGAAT GGCAGACGCT

501 GACGACTTTG ATTTATGCCT ATTTGGGACG CGCGGGTGAG GATAATTACG

551 CGCGGGCGAT GGTGCTG..
```

This corresponds to the amino acid sequence (SEQ ID NO: 574; ORF139):

```
  1  ..AWSAGESWRV LMESETWHAV WNTLRFSAAA VYAAAVLGVV YAAPARRSAW

51  MRGLMFXPFM VSPVCVSAGV LLLYPQWTAS LPLLLAMYAL LAYPFVAKDV

101  LSAWDALPPD YGRAAAGLGA NGFQTACRIT FPLLKPALRR GLTLAAATCV

151  GEFAATLFLS RPEWQTLTTL IYAYLGRAGE DNYARAMVL..
```

Further work revealed the complete nucleotide sequence (SEQ ID NO: 575):

```
   1    ATGGATGGAC GGCGTTGGGT GGTATGGGGT GCTTTTGCCC TGCTGCCTTC

51    GGCTTTTTTG GCGGTAATGG TCGTTGCGCC TTTGTGGGCG GTGGCGGCGT

101    ATGACGGTTT GGCGTGGCGC GCGGTGCTGT CGGATGCCTA TATGCTCAAA

151    CGTTTGGCGT GGACGGTATT TCAGGCAGCG GCAACCTGTG TGCTGGTGCT

201    GCCTTTGGGC GTGCCTGTCG CGTGGGTGCT GGCGCGGCTG GCGTTTCCGG

251    GGCGGGCTTT GGTGCTGCGC CTGCTGATGC TGCCTTTTGT GATGCCCACG

301    TTGGTGGCGG GCGTGGGCGT GCTGGCCCTG TTCGGGGCGG ACGGGCTGTT

351    GTGGCGCGGC AGGCAGGATA CGCCGTATCT GTTGTTGTAC GGCAATGTGT

401    TTTTCAACCT TCCTGTGTTG GTCAGGGCGG CGTATCAGGG GTTTGTGCAA

451    GTGCCTGCGG CACGGCTTCA GACGGCACGG ACGTTGGGCG CGGGGGCGTG

501    GCGGCGGTTT TGGGACATTG AAATGCCCGT TTTGCGCCCG TGGCTTGCCG

551    GCGGCGTGTG CCTTGTCTTT CTGTATTGTT TTTCCGGGTT CGGGCTGGCG

601    CTGCTGCTGG GCGGCAGCCG TTATGCCACG GTCGAAGTGG AAATTTACCA

651    GTTGGTCATG TTCGAACTCG ATATGGCGGT TGCTTCGGTG CTGGTGTGGC

701    TGGTGTTGGG GGTAACGGCG GCGGCAGGGT TGCTGTATGC GTGGTTCGGC

751    AGGCGCGCGG TTTCGGATAA GGCGGTTTCC CCTGTGATGC CGTCGCCGCC

801    GCAGTCGGTC GGGGAATATG TGCTGCTGGC GTTTGCGGCG GCGGTGTTGT

851    CTGTGTGCTG CCTGTTTCCT TTGTTGGCAA TTGTTGTGAA AGCGTGGTCG

901    GCCGGCGAAT CGTGGCGTGT GTTAATGGAA AGTGAAACGT GGCAGGCGGT

951    GTGGAATACT TTGCGCTTCT CGGCGGCGGC GGTGTATGCG GCGGCGGTTT

1001    TGGGTGTGGT GTATGCGGCG GCGGCGCGGC GGTCGGCGTG GATGCGCGGG
```

```
-continued
1051  CTGATGTTTT  TGCCGTTTAT  GGTGTCGCCG  GTTTGTGTTT  CGGCGGGCGT

1101  GCTGCTGCTT  TATCCGCAGT  GGACGGCTTC  GTTGCCGTTG  CTGCTGGCGA

1151  TGTATGCGCT  GCTGGCGTAT  CCGTTTGTGG  CAAAAGATGT  TTTATCAGCC

1201  TGGGATGCAC  TGCCGCCGGA  TTACGGCAGG  GCGGCGGCGG  GTTTGGGTGC

1251  AAACGGCTTT  CAGACGGCAT  GCCGCATCAC  GTTCCCCCTC  TTGAAACCGG

1301  CGTTGCGGCG  CGGTCTGACT  TTGGCGGCGG  CAACCTGCGT  GGGCGAATTT

1351  GCGGCGACAT  TGTTTCTGTC  GCGTCCGGAA  TGGCAGACGC  TGACGACTTT

1401  GATTTATGCC  TATTTGGGAC  GCGCGGGTGA  GGATAATTAC  GCGCGGGCGA

1451  TGGTGCTGAC  ATTGCTGTTG  GCGGCGTTCG  CGCTGGGTAT  TTTCCTGCTG

1501  TTGGACGGCG  GCGAAGGCGG  AAAACAGACG  GAAACGTTAT  AA
```

This corresponds to the amino acid sequence (SEQ ID NO: 576; ORF139-1):

```
  1  MDGRRWVVWG AFALLPSAFL AVMVVAPLWAVAAYDGLAWR AVLSDAYMLK

51  RLAWTVFQAA ATCVLVLPLG VPVAWVLARL AFPGRALVLR LLMLPFVMPT

101  LVAGVGVLAL FGADGLLWRG RQDTPYLLLY GNVFFNLPVL VRAAYQGFVQ

151  VPAARLQTAR TLGAGAWRRF WDIEMPVLRP WLAGGVCLVF LYCFSGFGLA

201  LLLGGSRYAT VEVEIYQLVM FELDMAVASV LVWLVLGVTA AAGLLYAWFG

251  RRAVSDKAVS PVMPSPPQSV GEYVLLAFAA AVLSVCCLFP LLAIVVKAWS

301  AGESWRVLME SETWQAVWNT LRFSAAAVYA AAVLGVVYAA AARRSAWMRG

351  LMFLPFMVSP VCVSAGVLLL YPQWTASLPL LLAMYALLAY PFVAKDVLSA

401  WDALPPDYGR AAAGLGANGF QTACRITFPL LKPALRRGLT LAAATCVGEF

451  AATLFLSRPE WQTLTTLIYA YLGPAGEDNY ARAMVLTLLL AAFALGIFLL

501  LDGGEGGKQT ETL*
```

Computer analysis of this amino acid sequence gave the following results:
Homology with a Predicted ORF from *N.meningitidis* (Strain A)

ORF139 (SEQ ID NO: 574) shows 94.7% identity over a 189aa overlap with an ORF (ORF139a) (SEQ ID NO: 578) from strain A of *N. meningitidis*:

```
                                              10         20         30
         orf139.pep                    AWSAGESWRVLMESETWHAVWNTLRFS
                    AAA
                                       |||||||||||||||||:||||| |||||
         orf139a    QSVGEYVLLAFAAAVXSVCCLFXLLAIVVKAWSAGESWRVLMESETWQAVWNTXRFSAAA
                    270       280       290       300       310       320

40        50        60        70        80        90
         orf139.pep VYAAAVLGVVYAAPARRSAWMRGLMFXPFMVSPVCVSAGVLLLYPQWTASLPLLLAMYAL
                    ||||||||||||  ||||||||||||| |||||||||||||||||| ||||||||||||||
         orf139a    VYAAAVLGVVYAAAARRSAWMRGLMFLPFMVSPVCVSAGVLLLXPQWTASLPLLLAMYAL
                    330       340       350       360       370       380

100       110       120       130       140       150
         orf139.pep LAYPFVAKDVLSAWDALPPDYGRAAAGLGANGFQTACRITFPLLKPALRRGLTLAAATCV
                    |||||||||||| |||||||||||||||||||||||||||||||||||||||||||||||
         orf139a    LAYPFVAKDVLSAXDALPPDYGRAAAGLGANGFQTACRITFPLLKPALRRGLTLAAATCV
                    390       400       410       420       430       440

160       170       180    189
         orf139.pep GEFAATLFLSRPEWQTLTTLIYAYLGRAGEDNYARAMVL
                    |||||||| || ||||||||||||| |||| ||||||||
         orf139a    GEFAATLFXSRXEWQTLTTLIYAYXGRAGXDNYARAMVLTLLLAAFALGXFLLLDGGEGG
                    450       460       470       480       490       500
```

The complete length ORF139a nucleotide sequence (SEQ ID NO: 577) is:

```
   1  ATGGATGGAC GGCGTTGGGC GGTATGGGGT GCTTTTGCCC TGCTGCCTTC
  51  GGCTTTTTTG GCGGCAATGG TCGTTGCGCC TTTGTGGGCG GTGGCGGCGT
 101  ATGACGGTTT GGCGTGGCGC GCGGTGCTGT CGGATGCCTA TATGCTCAAA
 151  CGTTTGGCGT GGACGGTATT TCAGGCAGCG GCAACCTGTG TGCTGGTGCT
 201  GCCTTTGGGC GTGCCTGTCG CGTGGGTGCT GGCGCGGCTG GCGTTTCCGG
 251  GGCGGGCTTT GGTGCTGCGC CTGCTGATGC TGCCTTTTGT GATGCCCACG
 301  TTGGTGGCGG GCGTGGGCGT GCTGGCTCTG TTCGGGGCGG ACGGCCTGTN
 351  GTGGCGCGGC TGGCAGGATA CGCCGTATCT GTTGTTGTAC GGCAATGTGT
 401  TTTTTNACCT TCCTGTGTTG GTCAGGGCGG CATATCAGGG GTTTGTGCAA
 451  GTGCCTGCGG CACGGCTTCA GACGGCACNG ACATTGGGCG CGGGGGCGTG
 501  GCGGCGGTTT TGGGACATTG AAATGCCCGT TTTGCGCCCG TGGCTTGCCG
 551  GCGGCGTGTG CCTTGTCTTC CTGTATTGTT TTTCGGGGTT CGGGCTGGCA
 601  TTGCTGCTGG GCGGCAGCCG TTATGCCACG GTCGAAGTGG AAATTTACCA
 651  GTTGGTCATG TTCGAACTCG ATATGGCGGT TGCTTCGGTG CTNGTGTGGC
 701  TGGTGTNGGG GGTAACNGCG GCGGCAGGGT TGCTGTATGC GTGGTTCGGC
 751  AGGCGCGCGG TTTCGGATAA GGCNGTTTCC CCTGTGATGC CGTCGCCGCC
 801  GCAGTCGGTC GGGGAATATG TGCTNCTGGC GTTTGCGGCG GCGGTGTNGT
 851  CTGTGTGCTG CCTGTTTCNT TTGTTGGCAA TTGTTGTGAA AGCGTGGTCG
 901  GCCGGCGAAT CGTGGCGTGT GTTAATGGAA AGTGAAACGT GGCAGGCGGT
 951  GTGGAATACT NTGCGCTTCT CGGCGGCGGC GGTGTATGCG GCGGCGGTTT
1001  TGGGTGTGGT GTATGCGGCG GCGGCGCGGC GGTCGGCGTG GATGCGCGGG
1051  CTGATGTTTT TGCCGTTTAT GGTGTCGCCG GTTTGTGTTT CGGCGGGCGT
1101  GCTGCTGCTT NATCCGCAGT GGACGGCTTC GTTGCCGCTG CTGCTGGCGA
1151  TGTATGCGCT GCTGGCGTAT CCGTTTGTGG CAAAAGATGT TTTATCAGCC
1201  TGNGATGCAC TGCCGCCGGA TTACGGCAGG GCGGCGGCGG GTTTGGGTGC
1251  AAACGGCTTT CAGACGGCAT GCCGCATCAC GTTCCCCCTC TTGAAACCGG
1301  CGTTGCGGCG CGGTCTGACT TTGGCGGCGG CAACCTGCGT GGGCGAATTT
1351  GCGGCAACCT TGTTCNTGTC GCGTCNCGAG TGGCAGACGC TGACGACTTT
1401  GATTTATGCC TATNTGGGAC GCGCGGGTGA NGATAATTAC GCGCGGGCGA
1451  TGGTGCTGAC ATTGCTGTTG GCGGCGTTCG CGCTGGGTAT NTTCCTGCTG
1501  TTGGACGGCG GCGAAGGCGG AAAACGGACG GAAACGTTAT AA
```

This encodes a protein having amino acid sequence (SEQ ID NO: 578):

```
   1  MDGRRWAVWG AFALLPSAFL AAMVVAPLWAVAAYDGLAWR AVLSDAYMLK
  51  RLAWTVFQAA ATCVLVLPLG VPVAWVLARL AFPGRALVLR LLMLPFVMPT
 101  LVAGVGVLAL FGADGLXWRG WQDTPYLLLY GNVFFXLPVL VRAAYQGFVQ
 151  VPAARLQTAX TLGAGAWRRF WDIEMPVLRP WLAGGVCLVF LYCFSGFGLA
```

-continued

```
201 LLLGGSRYAT VEVEIYQLVM FELDMAVASV LVWLVXGVTA AAGLLYAWFG

251 RRAVSDKAVS PVMPSPPQSV GEYVLLAFAA AVXSVCCLFX LLAIVVKAWS

301 AGESWRVLME SETWQAVWNT XRFSAAAVYA AAVLGVVYAA AARRSAWMRG

351 LMFLPFMVSP VCVSAGVLLL XPQWTASLPL LLAMYALLAY PFVAKDVLSA

401 XDALPPDYGR AAAGLGANGF QTACRITFPL LKPALRRGLT LAAATCVGEF

451 AATLFXSRXE WQTLTTLIYA YXGRAGXDNY ARAMVLTLLL AAFALGXFLL

501 LDGGEGGKRT ETL*
```

ORF139a (SEQ ID NO: 578) and ORF139-1 (SEQ ID NO: 576) show 96.5% homology over a 514aa overlap:

```
orf139a.pep  MDGRRWAVWGAFALLPSAFLAAMVVAPLWAVAAYDGLAWRAVLSDAYMLKRLAWTVFQAA
             ||||||:||||||||||||||:||||||||||||||||||||||||||||||||||||||
orf139-1     MDGRRWVVWGAFALLPSAFLAVMVVAPLWAVAAYDGLAWRAVLSDAYMLKRLAWTVFQAA orf139a.pep  ATCVLVLPLGVPVAWVLARLAFPGRALVLRLLMLPFVMPTLVAGVGVLALFGADGLXWRG
             ||||||||||||||||||||||||||||||||||||||||||||||||||||||||| ||
orf139-1     ATCVLVLPLGVPVAWVLARLAFPGRALVLRLLMLPFVMPTLVAGVGVLALFGADGLLWRG orf139a.pep  WQDTPYLLLYGNVFFXLPVLVRAAYQGFVQVPAARLQTAXTLGAGAWRRFWDIEMPVLRP
              |||||||||||| |||||||||||||||||||||||| ||||||||||||||||||||
orf139-1     RQDTPYLLLYGNVFFNLPVLVRAAYQGFVQVPAARLQTARTLGAGAWRRFWDIEMPVLRP orf139a.pep  WLAGGVCLVFLYCFSGFGLALLLGGSRYATVEVEIYQLVMFELDMAVASVLVWLVXGVTA
             |||||||||||||||||||||||||||||||||||||||||||||||||||||||| |||
orf139-1     WLAGGVCLVFLYCFSGFGLALLLGGSRYATVEVEIYQLVMFELDMAVASVLVWLVLGVTA orf139a.pep  AAGLLYAWFGRRAVSDKAVSPVMPSPPQSVGEYVLLAFAAAVXSVCCLFXLLAIVVKAWS
             |||||||||||||||||||||||||||||||||||||| |||| ||||||  ||||||||
orf139-1     AAGLLYAWFGRRAVSDKAVSPVMPSPPQSVGEYVLLAFAAAVLSVCCLFPLLAIVVKAWS orf139a.pep  AGESWRVLMESETWQAVWNTXRFSAAAVYAAAVLGVVYAAAARRSAWMRGLMFLPFMVSP
             |||||||||||||||||||| |||||||||||||||||||||||||||||||||||||||
orf139-1     AGESWRVLMESETWQAVWNTLRFSAAAVYAAAVLGVVYAAAARRSAWMRGLMFLPFMVSP orf139a.pep  VCVSAGVLLLXPQWTASLPLLLAMYALLAYPFVAKDVLSAXDALPPDYGRAAAGLGANGF
             |||||||||| ||||||||||||||||||||||||||||| |||||||||||||||||||
orf139-1     VCVSAGVLLLYPQWTASLPLLLAMYALLAYPFVAKDVLSAWDALPPDYGRAAAGLGANGF orf139a.pep  QTACRITFPLLKPALRRGLTLAAATCVGEFAATLFXSRXEWQTLTTLLYAYXGRAGXDNY
             |||||||||||||||||||||||||||||||||||| || ||||||||||||| |||||
orf139-1     QTACRITFPLLKPALRRGLTLAAATCVGEFAATLFLSRPEWQTLTTLIYAYLGRAGEDNY orf139a.pep  ARAMVLTLLLAAFALGXFLLLDGGEGGKRTETLX
             ||||||||||||||||| |||||||||||:||||
orf139-1     ARAMVLTLLLAAFALGIFLLLDGGEGGKQTETLX
```

Homology with a Predicted ORF from *N.gonorrhoeae*

ORF139 (SEQ ID NO: 574) shows 95.2% identity over a 189aa overlap with a predicted ORF (ORF139ng) (SEQ ID NO: 580) from *N.gonorrhoeae*:

```
orf139.pep                AWSAGESWRVLMESETWHAVWNTLRFSAAA   30
                          ||||||| |||||||||:||||||||||||
orf139ng    QSVGEYVLLAFSVAVLSVCCLFPLSAIVVKAWSAGESRRVLMESETWQAVWNTLRFSAAA  327 orf139.pep  VYAAAVLGVVYAAPARRSAWMRGLMFXPFMVSPVCVSAGVLLLYPQWTASLPLLLAMYAL   90
            |:|||||||||||  |:|||||:| |||||||||||||||||| ||||||||||||||||
orf139ng    VFAAAVLGVVYAAAARRLVWMRGLVFLPFMVSPVCVSAGVLLLYPGWTASLPLLLAMYAL  387 orf139.pep  LAYPFVAKDVLSAWDALPPDYGRAAAGLGANGFQTACRITFPLLKPALRRGLTLAAATCV  150
            ||||||||||||||||||||||||||||||||||||||||||||||||||||||||||||
orf139ng    LAYPFVAKDVLSAWDALPPDYGRAAAGLGANGFQTACRITFPLLKPALRRGLTLAAATCV  447 orf139.pep  GEFAATLFLSRPEWQTLTTLIYAYLGRAGEDNYARAMVL                      189
            |||||||||||||||||||||||||||||||||||||||
orf139ng    GEFAATLFLSRPEWQTLTTLIYAYLGRAGEDNYARAMVLTLLLSAFAVCIFLLLDNGEGG  507
```

The complete length ORF139ng nucleotide sequence (SEQ ID NO: 579) is predicted to encode a protein having amino acid sequence (SEQ ID NO: 580):

```
  1  MDGRCWAVRG AFSLLPSAFL AVMVVAPLWA VAAYDGLAWR AVLSDAYMLK
 51  RLAWTVFQAA ATCVLVLPLG VPVAWVLARL AFPGRALVLR LLMLPFVMPT
101  LVAGVGVLAL FGADGLLWRG RQDTPYLLLY GNVFFNLPVL VRAAYQGFAQ
151  VPAARLQTAR TLGAGAWRPF WDIEMPVLRP WLAGGVCLVF LYCFSGFGLA
201  LLLGGSRYAT VEVEIYQLVM FELDMAGASA LVWLVLGVTA AAGLLYAWFG
251  RRAVSDKAVS PVMPSPPQSV GEYVLLAFSV AVLSVCCLFP LSAIVVKAWS
301  AGESRRVLME SETWQAVWNT LRFSAAAVFA AAVLGVVYAA AARRLVWMRG
351  LVFLPFMVSP VCVSAGVLLL YPGWTASLPL LLAMYALLAY PFVAKDVLSA
401  WDALPPDYGR AAAGLGANGF QTACRITFPL LKPALRRGLT LAAATCVGEF
451  AATLFLSRPE WQTLTTLIYA YLGRAGEDNY ARAMVLTLLL SAFAVCIFLL
501  LDNGEGGKRT ETL*
```

Further work revealed a variant gonococcal DNA sequence (SEQ ID NO: 581):

```
   1  ATGGATGGAC GGTGTTGGGC GGTACGGGGT GCTTTTTCCC TGCTGCCTTC
  51  GGCTTTTTTG GCGGTAATGG TCGTTGCGCC TTTGTGGGCG GTGGCGGCGT
 101  ATGACGGTTT GGCGTGGCGC GCGGTGCTGT CGGATGCCTA TATGCTCAAA
 151  CGTTTGGCGT GGACGGTGTT TCAGGCGGCG GCAACCTGTG TGCTGGTGCT
 201  GCCTTTGGGC GTGCCTGTCG CGTGGGTGCT GGCGCGGCTG GCGTTCCCGG
 251  GGCGGGCTTT GGTGCTGCGC CTGCTGATGC TGCCGTTTGT GATGCCCACG
 301  CTGGTGGCGG GCGTGGGCGT GCTGGCTCTG TTCGGGGCGG ACGGGCTGTT
 351  GTGGCGCGGC CGGCAGGATA CGCCGTATCT GTTGTTGTAC GGCAATGTGT
 401  TTTTCAACCT GCCCGTGTTG GTCAGGGCGG CGTATCAGGG GTTTGCTCAA
 451  GTGCCTGCGG CACGGCTTCA GACGGCACGG ACGTTGGGCG CGGGGGCGTG
 501  GCGGCGGTTT TGGGACATTG AAATGCCCGT TTTGCGCCCG TGGCTTGCCG
 551  GCGGCGTGTG CCTTGTCTTC CTGTATTGTT TTTCGGGGTT CGGGCTGGCA
 601  TTGCTGTTGG GCGGCAGCCG TTATGCCACG GTCGAAGTGG AAATTTACCA
 651  GTTGGTTATG TTCGAACTCG ATATGGCGGG GGCTTCGGCG CTGGTGTGGC
 701  TGGTGTTGGG GGTAACGGCG GCGGCAGGGT TGCTGTATGC GTGGTTCGGC
 751  AGGCGCGCGG TTTCGGATAA GGCGGTTTCC CCCGTGATGC CGTCGCCGCC
 801  GCAATCGGTG GGGGAATATG TATTGCTGGC ATTTTCGGTG GCGGTGTTGT
 851  CCGTGTGCTG CCTGTTTCCT TTGTCGGCAA TTGTTGTGAA AGCGTGGTCG
 901  GCCGGCGAAT CGCGGCGTGT GTTAATGGAA AGTGAAACGT GGCAGGCAGT
 951  GTGGAATACt ttGCGCTTTT CGGCGGCGGC GGTGTTTGCG GCGGCGGTTT
1001  TGGGTGTGGT GTATGCGGCG GCGGCGCGGC GGCTGGTGTG GATGCGCGGA
1051  CTGGTGTTTT TACCGTTTAT GGTGTCGCCG GTTTGTGTTT CGGCGGGCGT
1101  GCTGCTGCTT TATCCGGGGT GGACGGCTTC GTTACCGCTG CTGCTGGCGA
1151  TGTATGCGCT GCTGGCGTAT CCGTTTGTGG CAAAAGATGT TTTATCGGCC
```

-continued

```
1201  TGGGATGCAC TGCCGCCGGA TTACGGCAGG GCGGCGGCAG GTTTGGGCGC

1251  AAACGGCTTT CAGACGGCAT GCCGTATCAC GTTCCCCCTC TTGAAACCGG

1301  CGTTGCGGCG CGGTCTGACT TTGGCGGCGG CGACGTGTGT GGGCGAATTT

1351  GCGGCAACCT TGTTCCTGTC GCGTCCGGAA TGGCAGACGT TGACGACTTT

1401  GATTTATGCC TATTTGGGGC GTGCGGGTGA GGACAATTAT GCGCGGGCAA

1451  TGGTGTTGAC ATTGCTGTTG TCGGCATTTG CGGTGTGCAT TTTCCTGCTG

1501  TTGGACAACG GCGAAGGCGg aaaACGGACG GAAACGTTAT AA
```

This corresponds to the amino acid sequence (SEQ ID NO: 582; ORF139ng-1):

```
  1  MDGRCWAVRG AFSLLPSAFL AVMVVAPLWAVAAYDGLAWR AVLSDAYMLK

51  RLAWTVFQAA ATCVLVLPLG VPVAWVLARL AFPGRALVLR LLMLPFVMPT

101  LVAGVGVLAL FGADGLLWRG RQDTPYLLLY GNVFFNLPVL VRAAYQGFAQ

151  VPAARLQTAR TLGAGAWRRF WDIEMPVLRP WLAGGVCLVF LYCFSGFGLA

201  LLLGGSRYAT VEVEIYQLVM FELDMAGASA LVWLVLGVTA AAGLLYAWFG

251  RRAVSDKAVS PVMPSPPQSV GEYVLLAFSV AVLSVCCLFP LSAIVVKAWS

301  AGESRRVLME SETWQAVWNT LRFSAAAVFA AAVLGVVYAA AARRLVWMRG

351  LVFLPFMVSP VCVSAGVLLL YPGWTASLPL LLAMYALLAY PFVAKDVLSA

401  WDALPPDYGR AAAGLGANGF QTACRITFPL LKPALRRGLT LAAATCVGEF

451  AATLFLSRPE WQTLTTLIYA YLGRAGEDNY ARAMVLTLLL SAFAVCIFLL

501  LDNGEGGKRT ETL*
```

ORF139ng-1 (SEQ ID NO: 582) and ORF139-1 (SEQ ID NO: 576) show 95.9% identity over 513aa overlap:

```
orf139ng MDGRCWAVRGAFSLLPSAFLAVMVVAPLWAVAAYDGLAWRAVLSDAYMLKRLAWTVFQAA
         ||||  | |   |  |:||||||||||||||||||||||||||||||||||||||||||
orf139-1 MDGRRWVWGAFALLPSAFLAVMVVAPLWAVAAYDGLAWRAVLSDAYMLKRLAWTVFQAA orf139ng ATCVLVLPLGVPVAWVLARLAFPGRALVLRLLMLPFVMPTLVAGVGVLALFGADGLLWRG
         ||||||||||||||||||||||||||||||||||||||||||||||||||||||||||||
orf139-1 ATCVLVLPLGVPVAWVLARLAFPGRALVLRLLMLPFVMPTLVAGVGVLALFGADGLLWRG orf139ng RQDTPYLLLYGNVFFNLPVLVRAAYQGFAQVPAARLQTARTLGAGAWRRFWDIEMPVLRP
         |||||||||||||||||||||||||||||:||||||||||||||||||||||||||||||
orf139-1 RQDTPYLLLYGNVFFNLPVLVRAAYQGFVQVPAARLQTARTLGAGAWRRFWDIEMPVLRP orf139ng WLAGGVCLVFLYCFSGFGLALLLGGSRYATVEVEIYQLVMFELDMAGASALVWLVLGVTA
         |||||||||||||||||||||||||||||||||||||||||||||:||||||||||||||
orf139-1 WLAGGVCLVFLYCFSGFGLALLLGGSRYATVEVEIYQLVMFELDMAVASVLVWLVLGVTA orf139ng AAGLLYAWFGRRAVSDKAVSPVMPSPPQSVGEYVLLAFSVAVLSVCCLFPLSAIVVKAWS
         ||||||||||||||||||||||||||||||||||||||::  ||||||||||||||||||
orf139-1 AAGLLYAWFGRRAVSDKAVSPVMPSPPQSVGEYVLLAFAAAVLSVCCLFPLLAIVVKAWS orf139ng AGESRRVLMESETWQAVWNTLRFSAAAVFAAAVLGVVYAAAARRLVWMRGLVFLPFMVSP
         ||||:||||||||||||||||||||||:|||||||||||||:||||:|||||||||||||
orf139   AGESWRVLMESETWQAVWNTLRFSAAAVYAAAVLGVVYAAAARRSAWMRGLMFLPFMVSP orf139ng VCVSAGVLLLYPGWTASLPLLLAMYALLAYPFVAKDVLSAWDALPPDYGRAAAGLGANGF
         |||||||||||||||||||||||||||||||||||||||||||||||||||||||||||||
orf139-1 VCVSAGVLLLYPQWTASLPLLLAMYALLAYPFVAKDVLSAWDALPPDYGRAAAGLGANGF orf139ng QTACRITFPLLKPALRRGLTLAAATCVGEFAATLFLSRPEWQTLTTLIYAYLGRAGEDNY
         |||||||||||||||||||||||||||||||||||||||||||||||||||||||||||||
orf139-1 QTACRITFPLLKPALRRGLTLAAATCVGEFAATLFLSRPEWQTLTTLIYAYLGRAGEDNY
```

```
                -continued
orf139ng ARAMVLTLLLSAFAVCIFLLLDNGEGGKRTETL
         |||||||||:|||:||||||:|||||:||||
orf139-1 ARAMVLTLLLAAFALGIFLLLDGGEGGKQTETL
```

Based on the presence of a predicted binding-protein-dependent transport systems inner membrane component signature (underlined) in the gonococcal protein, it is predicted that the proteins from *N.meningitidis* and *N.gonorrhoeae*, and their epitopes, could be useful antigens for vaccines or diagnostics, or for raising antibodies.

Example 70

The following partial DNA sequence was identified in *N.meningitidis* (SEQ ID NO: 583):

```
  1 ATGGACGGCT GGACACAGAC GCTGTCCGCG CAAACCCTGT TGGGCATTTC
 51 GGCGGCGGCA ATCATCCTCA TTCTGATTTT AATCGTCAGA TTCCGCATCC
101 ACGCGCTGCT GACACTGGTC ATCGTCAGCC TGCTGACGGC TTTGGCAACC
151 GGTTTGCCCA CAGGCAGCAT TGTCAAAGAC ATACTGGTCA AAAACTTCGG
201 CGGCACGCTC GGCGGCGTGG CGCTTCTGGT CGGCCTGGGC GCGATGCTCG
251 AACGTTTGGT C...
```

This corresponds to the amino acid sequence (SEQ ID NO: 584; ORF140):

```
 1 MDGWTQTLSA QTLLGISAAA IILILILIVR FRIHALLTLV IVSLLTALAT
51 GLPTGSIVKD ILVKNFGGTL GGVALLVGLG AMLERLV..
```

Further work revealed the complete nucleotide sequence (SEQ ID NO: 585):

```
  1 ATGGACGGCT GGACACAGAC GCTGTCCGCG CAAACCCTGT TGGGCATTTC
 51 GGCGGCGGCA ATCATCCTCA TTCTGATTTT AATCGTCAAA TTCCGCATCC
101 ACGCGCTGCT GACACTGGTC ATCGTCAGCC TGCTGACGGC TTTGGCAACC
151 GGTTTGCCCA CAGGCAGCAT TGTCAACGAC ATACTGGTCA AAAACTTCGG
201 CGGCACGCTC GGCGGCGTGG CGCTTCTGGT CGGCCTGGGC GCGATGCTCG
251 GACGTTTGGT CGAAACATCC GGCGGCGCAC AGTCGCTGGC GGACGCGCTG
301 ATCCGGATGT TCGGCGAAAA ACGCGCACCG TTCGCGCTGG GCGTTGCCTC
351 GCTGATTTTC GGCTTCCCGA TTTTCTTCGA TGCCGGACTA ATCGTCATGC
401 TGCCCATCGT GTTCGCCACC GCACGGCGCA TGAAACAGGA CGTACTGCCC
451 TTCGCGCTTG CCTCCATCGG CGCATTTTCC GTCATGCACG TCTTCCTGCC
501 GCCCCATCCG GGCCCGATTG CCGCTTCCGA ATTTTACGGC GCGAACATCG
551 GCCAAGTTTT GATTTTGGGT CTGCCGACCG CCTTCATCAC ATGGTATTTC
601 AGCGGCTATA TGCTCGGCAA AGTGTTGGGG CGCACCATCC ATGTTCCCGT
651 TCCCGAACTG CTCAGCGGCG GCACGCAAGA CAACGACCTG CCGAAAGAAC
701 CTGCCAAAGC AGGAACGGTC GTCGCCATCA TGCTGATTCC CATGCTGCTG
751 ATTTTCCTGA ATACCGGCGT ATCGGCCCTC ATCAGCGAAA AACTCGTAAG
801 TGCGGACGAA ACCTGGGTTC AGACGGCAAA AATAATCGGT TCGACACCGA
851 TCGCCCTTCT GATTTCCGTA TTGGTCGCAC TGTTTGTCTT GGGACGCAAA
```

-continued

```
 901  CGCGGCGAAA GCGGCAGCGC GTTGGAAAAA ACCGTGGACG GCGCACTCGC
 951  CCCCGTCTGT TCCGTGATTC TGATTACCGG CGCGGGCGGT ATGTTCGGCG
1001  GCGTTTTGCG CGCTTCCGGC ATCGGCAAGG CACTCGCCGA CAGCATGGCG
1051  GATTTGGGCA TTCCCGTCCT TTTGGGCTGT TTCCTTGTCG CCTTGGCACT
1101  GCGTATCGCG CAAGGTTCGG CAACCGTCGC CCTGACCACC GCCGCCGCGC
1151  TGATGGCTCC TGCCGTTGCC GCCGCCGGCT TTACCGACTG GCAGCTCGCC
1201  TGTATCGTAT TGGCAACGGC GGCAGGTTCG GTCGGTTGCA GCCACTTCAA
1251  CGACTCCGGC TTCTGGCTGG TCGGCCGTCT CTTGGACATG GACGTACCGA
1301  CCACGCTGAA AACCTGGACG GTCAACCAAA CCCTCATCGC ACTCATCGGC
1351  TTTGCCTTGT CCGCACTGCT GTTCGCCATC GTCTGA
```

This corresponds to the amino acid sequence (SEQ ID NO: 586; ORF140-1):

```
  1  MDGWTQTLSA QTLLGISAAA IILILILIVK FRIHALLTLV IVSLLTALAT
 51  GLPTGSIVND ILVKNFGGTL GGVALLVGLG AMLGRLVETS GGAQSLADAL
101  IRMFGEKRAP FALGVASLIF GFPIFFDAGL IVMLPIVFAT ARRMKQDVLP
151  FALASIGAFS VMHVFLPPHP GPIAASEFYG ANIGQVLILG LPTAFITWYF
201  SGYMLGKVLG RTIHVPVPEL LSGGTQDNDL PKEPAKAGTV VAIMLIPMLL
251  IFLNTGVSAL ISEKLVSADE TWVQTAKIIG STPIALLISV LVALFVLGRK
301  RGESGSALEK TVDGALAPVC SVILITGAGG MFGGVLRASG IGKALADSMA
351  DLGIPVLLGC FLVALALRIA QGSATVALTT AAALMAPAVA AAGFTDWQLA
401  CIVLATAAGS VGCSHFNDSG FWLVGRLLDM DVPTTLKTWT VNQTLIALIG
451  FALSALLFAI V*
```

Computer analysis of this amino acid sequence gave the following results:
Homology with a Predicted ORF from *N.meningitidis* (Strain A)

ORF140 (SEQ ID NO: 584) shows 95.4% identity over a 87aa overlap with an ORF (ORF140a) (SEQ ID NO: 588) from strain A of *N. meningitidis*:

```
                       10        20        30        40        50        60
orf140.pep  MDGWTQTLSAQTLLGISAAAIILILILIVRFRIHALLTLVIVSLLTALATGLPTGSIVKD
            ||||||||||||||||||||||||||||||:||||||||||||||||||||||||||||:|
orf140a     MDGWTQTLSAQTLLGISAAAIILILILIVKFRIHALLTLVIVSLLTALATGLPTGSIVND
                       10        20        30        40        50        60

70        80
orf140.pep  ILVKNFGGTLGGVALLVGLGAKLERLV
            :|||||||||||||||||||||   |||
orf140a     VLVKNFGGTLGGVALLVGLGAMLGRLVETSGGAQSLADALIRMFGEKRAPFALGVASLIF
                       70        80        90       100       110       120
```

The complete length ORF140a nucleotide sequence (SEQ ID NO: 587) is:

```
  1  ATGGACGGCT GGACACAGAC GCTGTCCGCG CAAACCCTGT TGGGCATTTC
 51  GGCGGCGGCA ATCATCCTCA TTCTGATTTT AATCGTCAAA TTCCGCATCC
101  ACGCGCTGCT GACACTGGTC ATCGTCAGCC TGCTGACGGC TTTGGCAACC
```

```
                   -continued
 151   GGTTTGCCCA CAGGCAGCAT TGTCAACGAC GTACTGGTCA AAAACTTCGG

201   CGGCACGCTC GGCGGCGTGG CGCTTCTGGT CGGCCTGGGC GCGATGCTCG

251   GACGTTTGGT CGAAACATCC GGCGGCGCAC AGTCGCTGGC GGACGCGCTG

301   ATCCGGATGT TCGGCGAAAA ACGCGCACCG TTCGCGCTGG GCGTTGCCTC

351   GCTGATTTTC GGCTTCCCGA TTTTCTTCGA TGCCGGACTA ATCGTCATGC

401   TGCCCATCGT GTTCGCCACC GCACGGCGCA TGAAACAGGA CGTACTGCCC

451   TTCGCGCTTG CCTCCATCGG CGCATTTTCC GTCATGCACG TCTTCCTGCC

501   GCCCCATCCG GGCCCGATTG CCGCTTCCGA ATTTTACGGC GCGAACATCG

551   GCCAAGTTTT GATTTTGGGT CTGCCGACCG CCTTCATCAC ATGGTATTTC

601   AGCGGCTATA TGCTCGGCAA AGTGTTGGGG CGCACCATCC ATGTTCCCGT

651   TCCCGAACTG CTCAGCGGCG GCACGCAAGA CAACGACCTG CCGAAAGAAC

701   CTGCCAAAGC AGGAACGGTC GTCGCCATCA TGCTGATTCC CATGCTGCTG

751   ATTTTCCTGA ATACCGGCGT ATCGGCCCTC ATCAGCGAAA AACTCGTAAG

801   TGCGGACGAA ACCTGGGTTC AGACGGCAAA AATAATCGGT TCGACACCGA

851   TCGCCCTTCT GATTTCCGTA TTGGTCGCAC TGTTTGTCTT GGGACGCAAA

901   CGCGGCGAAA GCGGCAGCGC GTTGGAAAAA ACCGTGGACG GCGCACTCGC

951   CCCCGTCTGT TCCGTGATTC TGATTACCGG CGCGGGCGGT ATGTTCGGCG

1001   GCGTTTTGCG CGCTTCCGGC ATCGGCAAGG CACTCGCCGA CAGCATGGCG

1051   GATTTGGGCA TTCCCGTCCT TTTGGGCTGT TTCCTTGTCG CCTTGGCACT

1101   GCGTATCGCG CAAGGTTCGG CAACCGTCGC CCTGACCACC GCCGCCGCGC

1151   TGATGGCTCC TGCCGTTGCC GCCGCCGGCT TTACCGACTG GCAGCTCGCC

1201   TGTATCGTAT TGGCAACGGC GGCAGGTTCG GTCGGTTGCA GCCACTTCAA

1251   CGACTCCGGC TTCTGGCTGG TCGGCCGCCT CTTGGACATG GACGTACCGA

1301   CCACGCTGAA AACCTGGACG GTCAACCAAA CCCTCATCGC ACTCATCGGC

1351   TTTGCCTTGT CCGCACTGCT GTTCGCCATC GTCTGA
```

This encodes a protein having amino acid sequence (SEQ ID NO: 588):

```
  1   MDGWTQTLSA QTLLGISAAA IILILILIVK FRIHALLTLV IVSLLTALAT

51   GLPTGSIVND VLVKNFGGTL GGVALLVGLG AMLGRLVETS GGAQSLADAL

101   IRMFGEKRAP FALGVASLIF GPPIFFDAGL IVMLPIVFAT ARRMKQDVLP

151   FALASIGAFS VMHVFLPPHP GPIAASEFYG ANIGQVLILG LPTAFITWYF

201   SGYMLGKVLG RTIHVPVPEL LSGGTQDHDL PKEPAKAGTV VAIMLIPMLL

251   IFLNTGVSAL ISEKLVSADE TWVQTAKIIG STPIALLISV LVALFVLGRK

301   RGESGSALEK TVDGALAPVC SVILITGAGG MFGGVLRASG IGKALADSMA

351   DLGIPVLLGC FLVALALRIA QGSATVALTT AAALMAPAVA AAGFTDWQLA

401   CIVLATAAGS VGCSHFNDSG FWLVGRLLDM DVPTTLKTWT VNQTLIALIG

451   FALSALLFAI V*
```

ORF140a (SEQ ID NO: 588) and ORF140-1 (SEQ ID NO: 586) show 99.8% identity over a 461aa overlap:

```
orf140-1.pep  MDGWTQTLSAQTLLGISAAAIILILILIVKFRIHALLTLVIVSLLTALATGLPTGSIVND   60
              ||||||||||||||||||||||||||||||||||||||||||||||||||||||||||||
orf140a       MDGWTQTLSAQTLLGISAAAIILILILIVKFRIHALLTLVIVSLLTALATGLPTGSIVND   60 orf140-1.pep  ILVKNFGGTLGGVALLVGLGAMLGRLVETSGGAQSLADALIRMFGEKRAPFALGYASLIF  120
              :|||||||||||||||||||||||||||||||||||||||||||||||||||||||:|||
orf140a       VLVKNFGGTLGGVALLVGLGAMLGRLVETSGGAQSLADALIRMFGEKRAPFALGVASLIF  120 orf140-1.pep  GFPIFFDAGLIVMLPIVFATARRMKQDVLPFALASIGAFSVMHVFLPPHPGPIAASEFYG  180
              ||||||||||||||||||||||||||||||||||||||||||||||||||||||||||||
orf140a       GFPIFFDAGLIVMLPIVFATARRMKQDVLPFALASIGAFSVMHVFLPPHPGPIAASEFYG  810 orf140-1.pep  ANIGQVLILGLPTAFITWYFSGYMLGKVLGRTIHVPVPELLSGGTQDNDLPKEPAKAGTV  240
              ||||||||||||||||||||||||||||||||||||||||||||||||||||||||||||
orf140a       ANIGQVLILGLPTAFITWYFSGYMLGKVLGRTIHVPVPELLSGGTQDNDLPKEPAKAGTV  240 orf140-1.pep  VAIMLIPMLLIFLNTGVSALISEKLVSADETWVQTAKIIGSTPIALLISVLVALFVLGRK  300
              ||||||||||||||||||||||||||||||||||||||||||||||||||||||||||||
orf140a       VAIMLIPMLLIFLNTGVSALISEKLVSADETWVQTAKIIGSTPIALLISVLVALFVLGRK  300 orf140-1.pep  RGESGSALEKTVDGALAPVCSVILITGAGGMFGGVLRASGIGKALADSMADLGIPVLLGC  360
              ||||||||||||||||||||||||||||||||||||||||||||||||||||||||||||
orf140a       RGESGSALEKTVDGALAPVCSVILITGAGGMFGGVLRASGIGKALADSMADLGIPVLLGC  360 orf140-1.pep  FLVALALRIAQGSATVALTTAAALMAPAVAAAGFTDWQLACIVLATAAGSVGCSHFNDSG  420
              ||||||||||||||||||||||||||||||||||||||||||||||||||||||||||||
orf140a       FLVALALRIAQGSATVALTTAAALMAPAVAAAGFTDWQLACIVLATAAGSVGCSHFNDSG  420 orf140-1.pep  FWLVGRLLDMDVPTTLKTWTVNQTLIALIGFALSALLFAIV                     461
              ||||||||||||||||||||||||||||||||||||||||
orf140a       FWLVGRLLDMDVPTTLKTWTVNQTLIALIGFALSALLFAIV                     461
```

Homology with a Predicted ORF from *N.gonorrhoeae*

ORF140 (SEQ ID NO: 584) shows 92% identity over a 87aa overlap with a predicted ORF (ORF140ng) (SEQ ID NO: 590) from *N.gonorrhoeae*:

```
orf140.pep  MDGWTQTLSAQTLLGISAAAIILILILIVRFRIHALLTLVIVSLLTALATGLPTGSIVKD   60
            |||  ||||||||||||||||||||||||:|||:|||||||:||||||||||||||||:|
orf140ng    MDGRTQTLSAQTLLGISAAAIILILILIVKFRIRALLTLVIASLLTALATGLPTGSIVND   60 orf140.pep  ILVKNFGGTLGGVALLVGLGAMLERLV                                    87
            :|||||||||||||||||||||||  |||
orf140ng    VLVKNFGGTLGGVALLVGLGAMLGRLVETSGGAQSLADALIRMFGEKRAPFAPGVASLIF  120
```

The complete length ORF140ng nucleotide sequence (SEQ ID NO: 589) was predicted to encode a protein having amino acid sequence (SEQ ID NO: 590):

```
  1  MDGRTQTLSA QTLLGISAAA IILILILIVK FRIRALLTLV IASLLTALAT

51  GLPTGSIVND VLVKNFGGTL GGVALLVGLG AMLGRLVETS GGAQSLADAL

101  IRMFGEKRAP FAPGVASLIF GFPIFFDAGL IVMLPIVFAT ARRMKQDVLP

151  FALASVGAFS VMHVFLPPHP GPIAASEFYG ANIGQVLILG LPTAFITWYF

201  SGYMLGKVLG RAIHVPVPRL LSGGTQDSDP PKEPAKAGTV VAVMLIPMLL

251  IFLNTGVSAL ISEKLVSADE TWVQTAKMIG STPVALLISV LAALLVLGRK

301  RGESGSTLEK TVDGALAPAC SVILITGAGG MFGGVLRASG IGKALADSMA

351  DLGIPVLLGC FLVALALRIA QGSATVALTT AAALMAPAVA AAGFTDWQLA

401  CIVLATAAGS VGCSHFNDSG FWLVGRLSDM DVPTTLKTWT VNQTLIAFIG

451  FALSALLFAI V*
```

Further work revealed a variant gonococcal DNA sequence (SEQ ID NO: 591):

```
   1  ATGGACGGCC GGACACAGAC GCTGTCCGCG CAAACCTTGT TGGGCATTTC
  51  GGCGGCGGCA ATCATCCTCA TTCTGATTTT AATCGTCAAA TTCCGCATCC
 101  GCGCGCTGCT GACACTGGTC ATCGCCAGCC TGCTGACGGC TTTGGCAACC
 151  GGTTTGCCCA CAGGCAGCAT CGTCAACGAC GTACTGGTCA AAAACTTCGG
 201  CGGCACGCTC GGCGGCGTGG CGCTTCTGGT CGGTCTGGGC GCAATGCTCG
 251  GACGTTTGGT AGAAACATCC GGCGGCGCAC AGTCGCTGGC GGACGCGCTG
 301  ATCCGGATGT TCGGCGAAAA ACGCGCACCG TTCGCTCCGG GCGTTGCCTC
 351  GCTGATTTTC GGCTTCCCGA TTTTCTTCGA TGCCGGACTA ATCGTCATGC
 401  TGCCCATCGT ATTCGCCACC GCACGGCGCA TGAAACAGGA CGTACTGCCC
 451  TTCGCGCTTG CCTCCGTCGG CGCATTTTCC GTCATGCACG TCTTCCTGCC
 501  GCCCCATCCG GGCCCGATTG CCGCTTCCGA ATTTTACGGC GCGAACATCG
 551  GCCAGGTTTT GATTTTGGGT CTGCCGACCG CCTTCATCAC ATGGTATTTC
 601  AGCGGCTATA TGCTCGGCAA AGTGTTGGGG CGCGCCATCC ATGTTCCCGT
 651  TCCCGAACTG CTCAGCGGCG GCACGCAAGA CAGCGACCCG CCGAAAGAAC
 701  CTGCCAAAGC AGGAACGGTC GTCGCCGTCA TGCTGATTCC CATGCTGCTG
 751  ATTTTCCTGA ATACCGGCGT ATCAGCCCTC ATCAGCGAAA AACTCGTAAG
 801  TGCGGACGAA ACTTGGGTrC AGACGGCAAA AATGATCGGT TCGACACCTG
 851  TCGCCCTTCT GATTTCCGTA TTGGCCGCAC TGTTGGTCTT GGGACGCAAA
 901  CGCGGCGAAA GCGGCAGCAC GTTGGAAAAA ACCGTGGACG GCGCACTCGC
 951  CCCCGCCTGT TCCGTGATTC TGATTACCGG CGCGGGCGGT ATGTTCGGCG
1001  GCGTTTTGCG CGCTTCCGGC ATCGGCAAGG CACTCGCCGA CAGCATGGCG
1051  GATTTGGGCA TTCCCGTCCT TTTGGGCTGC TTCCTTGTCG CCTTGGCACT
1101  GCGTATCGCG CAAGGTTCGG CAACCGTCGC CCTGACCACA GCCGCCGCGC
1151  TGATGGCTCC TGCCGTTGCC GCCGCCGGCT TTACCGACTG GCAGCTCGCC
1201  TGTATCGTAT TGGCAACGGC GGCAGGTTCG GTCGGTTGCA GCCACTTCAA
1251  CGACTCCGGC TTCTGGCTGG TCGGCCGCCT CTTGGATATG GACGTACCGA
1301  CCACGCTGAA AACCTGGACG GTCAACCAAA CCCTCATCGC ATTCATCGGC
1351  TTTGCCTTGT CCGCACTGCT GTTTGCCATC GTCTGA
```

This corresponds to the amino acid sequence (SEQ ID NO: 592; ORF140ng-1):

```
  1  MDGRTQTLSA QTLLGISAAA IILILILIVK FRIRALLTLV IASLLTALAT
 51  GLPTGSIVND VLVKNFGGTL GGVALLVGLG AMLGRLVETS GGAQSLADAL
101  IRMFGEKRAP FAPGVASLIF GFPIFFDAGL IVMLPIVFAT ARRMKQDVLP
151  FALASVGAFS VMHVFLPPHP GPIAASEFYG ANIGQVLILG LPTAFITWYF
201  SGYMLGKVLG RAIHVPVPEL LSGGTQDSDP PKEPAKAGTV VAVMLIPMLL
251  IFLNTGVSAL ISEKLVSADE TWVQTAKMIG STPVALLISV LAALLVLGRK
301  RGESGSTLEK TVDGALAPAC SVILITGAGG MFGGVLRASG IKALADSMA
```

-continued
```
351 DLGIPVLLGC FLVALALRIA QGSATVALTT AAALMAPAVA AAGFTDWQLA

401 CIVLATAAGS VGCSHFNDSG FWLVGRLLDM DVPTTLKTWT VNQTLIAFIG

451 FALSALLFAI V*
```

ORF140ng-1 (SEQ ID NO: 592) and ORF140-1 (SEQ ID NO: 586) show 96.3% identity over 461aa overlap:

```
orf140ng-1.pep  MDGRTQTLSAQTLLGISAAAIILILILIVKFRIRALLTLVIASLLTALATGLPTGSIVND
                |||  |||||||||||||||||||||||||||||:|||||||:|||||||||||||||||
orf140-1        MDGWTQTLSAQTLLGISAAAIILILILIVKFRIHALLTLVIVSLLTALATGLPTGSIVND orf140ng-1.pep  VLVKNFGGTLGGVALLVGLGAMLGRLVETSGGAQSLADALIRMFGEKRAPFAPGVASLIF
                :||||||||||||||||||||||||||||||||||||||||||||||||||| |||||||
orf140-1        ILVKNFGGTLGGVALLVGLGAMLGRLVETSGGAQSLADALIRMFGEKRAPFALGVASLIF orf140ng-1.pep  GFPIFFDAGLIVMLPIVFATARRMKQDVLPFALASVGAFSVMHVFLPPHPGPIAASEFYG
                ||||||||||||||||||||||||||||||||||||:|||||||||||||||||||||||
orf140-1        GFPIFFDAGLIVMLPIVFATARRMKQDVLPFALASIGAFSVMHVFLPPHPGPIAASEFYG orf140ng-1.pep  ANIGQVLILGLPTAFITWYFSGYMLGKVLGRAIHVPVPELLSGGTQDSDPPKEPAKAGTV
                |||||||||||||||||||||||||||||||:|||||||||||||||:|  |||||||||
orf140-1        ANIGQVLILGLPTAFITWYFSGYMLGKVLGRTIHVPVPELLSGGTQDNDLPKEPAKAGTV orf140ng-1.pep  VAVMLIPMLLIFLNTGVSALISEKLVSADETWVQTAKMIGSTPVALLISVLAALLVGRK
                ||:|||||||||||||||||||||||||||||||||:|||||:||||||||:||:|||||
orf140-1        VAIMLIPMLLIFLNTGVSALISEKLVSADETWVQTAKIIGSTPIALLISVLAVFLVGRK orf140ng-1.pep  RGESGSTLEKTVDGALAPACSVILITGAGGMFGGVLRASGIGKALLDSMADLGIPVLLGC
                ||||||:|||||||:|||||||||||||||||||||||||||||||:|||||||||||||
orf140-1        RGESGSALEKTVDGALAPVCSVILITGAGGMFGGVLRASGIGKALADSMADLGIPVLLGC orf140ng-1.pep  FLVALALRIAQGSATVALTTAAALMAPAVAAAGFTDWQLACIVLATAAGSVGCSHFNDSG
                ||||||||||||||||||||||||||||||||||||||||||||||||||||||||||||
orf140-1        FLVALALRIAQGSATVALTTAAALMAPAVAAAGFTDWQLACIVLATAAGSVGCSHFNDSG orf140ng-1.pep  FWLVGRLLDMDVPTTLKTWTVNQTLIAFIGFALSALLFAIV
                |||||||||||||||||||||||||||:||||||||||||||
orf140-1        FWLVGRLLDMDVPTTLKTWTVNQTLIALIGFALSALLFAIV
```

Furthermore, ORF140ng-1 (SEQ ID NO: 592) is homologous to an *E.coli* protein (SEQ ID NO: 1148):

```
gi|882633 (U29579) ORF_o454 [Escherichia coli] )gi|1789097 (AE000358) o454;
This 454 aa ORF is 34% identical (9 gaps) to 444 residues of an approx. 456 aa
protein GNTP_BACLI SW: P46832 [Escherichia coli] Length = 454
Score = 210 bits (529), Expect = 1e-53
Identities = 130/384 (33%), Positives = 194/364 (49%) Gaps = 19/384 (4%)

Query:   88 ETSGGAQSLADALIRMFGEKRAPFAPGVASLIFGFPIFFDAGLIVMLPIVFATARRMKQD   147
            E SGGA+SLA+     R  G+KR    A  +A+   G P+FFD G I++ PI++  A+  K
Sbjct:   80 EHSGGAESLANYFSRKLGDKRTIAALTLAAFFLGIPVFFDVGFIILAPIIYGFAKVAKIS   139

Query:  148 VLPFAAASVGAFSVMHVFLPPHPGPIAASEFYGANIGQVLILGLPTAFITWYFSGYMLGK   207
              L F L    G   +HV +PPHPGP+AA+    A+IG + I+G+  +I    GY    K
Sbjct:  140 PLKFGLPVAGIMLTVHVAVPPHPGPVAAAGLLHADIGWLTIIGIAIS-IPVGVVGYFAAK   198

Query:  208 VLGRAIHVPVPELL----------SGGTQDSDPPKEPAKAGTVVAVMLIPMLLIFLNTGV   257
             ++ +  +          E+L             G T+ SD     P  A V ++++IP+ +I     T
Sbjct:  199 IINKRQYAMSVEVLEQMQLAPASEEGATKLSDKINPPGVA-LVTSLIVIPIAIIMAGT--   255

Query:  258 SALISEKLVSADETWVQTAKMIGSTPXXXXXXXXXXXXXXXGRKRGESGSTLEKTVDGALA   317
               +S  L+    + T ++IGS                    +RG S         +AL
Sbjct:  256 ---VSATLMPPSHPLLGTLQLIGSPMVALMIALVLAFWLLALRRGWSLQHTSDIMGSALP   312

Query:  318 PACSVILITGAGGMFGGVLRASGIGKALADSMADLGIPVLLGCFLVALALRIAQGSXXXX   377
              A   VIL+TGAGG+FG VL  SG+GKALA+ +  +   +P+L   F+++LALR +QGS
Sbjct:  313 TAAVVILVTGAGGVFGKVLVESGVGKALANMLQMIDLPLLPAAFIISLALRASQGS--AT   370

Query:  378 XXXXXXXXXXXXXXGFTDWQLACIVLATAAGSVGCSHFNDSGFWLVGRLLDMDVPTTLK   437
                             G    Q     + LA   G +G SH NDSGFW+V + L + V        LK
Sbjct:  371 VAILTTGGLLSEAVMGLNPIQCVLVTLAACFGGLGASHINDSGFWIVTKYLGLSVADGLK   430
```

```
                          -continued
Query:  438  TWTVNQTLIAFIGFALSALLFAIV                                461
             TWTV  T++ F GF ++  ++A++
Sbjct:  431  TWTVLTTILGFTGFLITWCVWAVI                                454
```

Based on this analysis, including the identification of the presence of a putative leader sequence (double-underlined) and several putative transmembrane domains (single-underlined) in the gonococcal protein, it is predicted that the proteins from *N.meningitidis* and *N.gonorrhoeae*, and their epitopes, could be useful antigens for vaccines or diagnostics, or for raising antibodies.

Example 71

The following partial DNA sequence was identified in *N.meningitidis* (SEQ ID NO: 593):

```
  1  ..GATTTCGGCA TATCGCCCGT GTATCTTTGG GTTGCCGCCG CGTTCAAACA
 51    TTTGCTGTCG CCGTGGGCTG CCGACTCATA CGATGTCGCA CGCTTTGCAG
101    GCGTATTTTT TGCCGTTATC GGACTGACTT CCTGCGGCTT TGCCGGTTTC
151    AACTTTTTGG GCAGACACCA CGGGCGCAC. GTCGTCCTGA TTCTCATCGG
201    CTGTATCGGG CTGATTCCAG TTGCCCATTT CCTCAACCCC GCTGCCGCCG
251    CCTTTGCCGC CGCCGGACTG GTGCTGCACG GTTATTCTTT GGCTCGCCGG
301    CGCGTGATTG CCGCCTCTTT TCTGCTCGGT ACGGGCTGGA CGCTGATGTC
351    GTTGGCAGCA GCTTATCCGG CAGCATTTGC CCTGATGCTG CCCTTGCCCG
401    TACTGATGTT TTTCCGTCCG ..
       30
```

This corresponds to the amino acid sequence (SEQ ID NO. 594; ORF141):

```
  1  ..DFGISPVYLW VAAAFKHLLS PWAADSYDVA RFAGVFFAVI GLTSCGFAGF
 51    NFLGRHHGRX VVLILIGCIG LIPVAHFLNP AAAAFAAAGL VLHGYSLARR
101    RVIAASFLLG TGWTLMSLAA AYPAAFALML PLPVLMFFRP ..
       40
```

Further work revealed the complete nucleotide sequence (SEQ ID NO: 595):

```
  1  ATGCTGACCT ATACCCCGCC CGATGCCCGC CCGCCCGCCA AAACCCACGA
 51  AAAGCCGTGG CTGCTGCTGT TGATGGCGTT TGCCTGGTTG TGGCCCGGCG
101  TGTTTTCCCA CGATTTGTGG AATCCTGACG AACCTGCCGT CTATACCGCC
151  GTCGAAGCAC TGGCAGGCAG CCCCACCCCC TTGGTTGCCC ATCTGTTCGG
201  TCAAACCGAT TTCGGCATAC CGCCCGTGTA TCTTTGGGTT GCCGCCGCGT
251  TCAAACATTT GCTGTCGCCG TGGGCTGCCG ACTCATACGA TGCCGCACGC
301  TTTGCAGGCG TATTTTTTGC CGTTATCGGA CTGACTTCCT GCGGCTTTGC
351  CGGTTTCAAC TTTTTGGGCA GACACCACGG GCGCAgCGTC GTCCTGATTC
401  TCATCGGCTG TATCGGGCTG ATTCCAGTTG CCCATTTCCT CAACCCCGCT
451  GCCGCCGCCT TGCCGCCGC CGGACTGGTG CTGCACGGTT ATTCTTTGGC
501  TCGCCGGCGC GTGATTGCCG CCTCTTTTCT GCTCGGTACG GGCTGGACGC
551  TGATGTCGTT GGCAGCAGCT TATCCGGCAG CATTTGCCCT GATGCTGCCC
601  TTGCCCGTAC TGATGTTTTT CCGTCCGTGG CAAAGCAGGC GTTTGATGTT
```

-continued

```
 651   GACGGCAGTC GCCTCACTTG CCTTTGCCCT GCCGCTTATG ACCGTTTACC

701   CGCTGCTCTT GGCAAAAACG CAGCCCGCGC TGTTCGCGCA ATGGCTCGAC

751   TATCACGTTT TCGGTACGTT CGGCGGCGTG CGGCACGTTC AGACGGCATT

801   CAGTTTGTTT TACTATCTGA AAAACCTGCT TTGGTTTGCA TTGCCCGCGC

851   TGCCGCTGGC GGTTTGGACG GTTTGCCGCA CGCGCCTGTT TTCGACCGAC

901   TGGGGGATTT TGGGCGTCGT CTGGATGCTT GCCGTTTTGG TGCTGCTTGC

951   CGTCAATCCG CAGCGTTTTC AGGATAACCT CGTCTGGCTG CTTCCGCCGC

1001   TTGCCCTGTT CGGCGCGGCG CAACTGGACA GCCTGAGGCG CGGCGCGGCG

1051   GCGTTTGTCA ACTGGTTCGG CATTATGGCG TTCGGACTGT TTGCCGTGTT

1101   CCTGTGGACG GGCTTTTTCG CCATGAATTA CGGCTGGCCC GCCAAGCTTG

1151   CCGAACGCGC CGCCTATTTC AGCCCGTATT ATGTTCCTGA TATCGATCCC

1201   ATTCCGATGG CGGTTGCCGT ACTGTTCACA CCCTTGTGGC TGTGGGCGAT

1251   TACCCGGAAA AACATACGCG GCAGGCAGGC GGTTACCAAC TGGGCGGCAG

1301   GCGTTACCCT GACCTGGGCT TTGCTGATGA CGCTGTTCCT GCCGTGGCTG

1351   GACGCGGCGA AAAGCCACGC GCCGGTCGTC CGGAGTATGG AGGCATCGCT

1401   TTCCCCGGAA TTGAAACGGG AGCTTTCAGA CGGCATCGAG TGTATCGGCA

1451   TAGGCGGCGG CGACCTGCAC ACGCGGATTG TTTGGACGCA GTACGGCACA

1501   TTGCCGCACC GCGTCGGCGA TGTACAATGC CGCTACCGCA TCGTCCTCCT

1551   GCCCCAAAAT GCGGATGCGC CGCAAGGCTG GCAGACGGTT TGGCAGGGTG

1601   CGCGTCGGCG CAACAAAGAC AGTAAGTTCG CACTGATACG CAAAATCGGG

1651   GAAAATATAT AA
```

This corresponds to the amino acid sequence (SEQ ID NO: 596; ORF141-1):

```
  1   MLTYTPPDAR PPAKTHEKPW LLLLMAFAWL WPGVFSHDLW NPDEPAVYTA

51   VEALAGSPTP LVAHLFGQTD FGIPPVYLWV AAAFKHLLSP WAADSYDAAR

101   FAGVFFAVIG LTSCGFAGFN FLGRHHGRSV VLILIGCIGL IPVAHFLNPA

151   AAAFAAAGLV LHGYSLARRR VIAASFLLGT GWTLMSLAAA YPAAFALMLP

201   LPVLMFFRPW QSRRLMLTAV ASLAFALPLM TVYPLLLAKT QPALFAQWLD

251   YHVFGTFGGV RHVQTAFSLF YYLKNLLWFA LPALPLAVWT VCRTRLFSTD

301   WGILGVVWML AVLVLLAVNP QRFQDNLVWL LPPLALFGAA QLDSLRRGAA

351   AFVNWFGIMA FGLFAVFLWT GFFAKNYGWP AKLAERAAYF SPYYVPDIDP

401   IPMAVAVLFT PLWLWAITRK NIRGRQAVTN WAAGVTLTWA LLMTLFLPWL

451   DAAKSHAPVV RSMEASLSPE LKRELSDGIE CIGIGGGDLH TRIVWTQYGT

501   LPHRVGDVQC RYRIVLLPQN ADAPQGWQTV WQGARPRNKD SKFALIRKIG

551   ENI*
```

Computer analysis of this amino acid sequence gave the following results:
Homology with a Predicted ORF from *N.meningitidis* (Strain A)

ORF141 (SEQ ID NO: 594) shows 95.0% identity over a 140aa overlap with an ORF (ORF141a) (SEQ ID NO: 598) from strain A of *N. meningitidis*:

```
                              10        20        30
orf141.pep                    DFGISPVYLWVAAAFKHLLSPWAADSYDVA
                              ||||  |||||||||||||||||||||  |
orf141a    WNPDEPAVYTAVEALAGSPTPLVAHLFGQIDFGIPPVYLWAAAFKHLLSPWAADPYDAA
           40        50        60        70        80        90

40        50        60        70        80        90
orf141.pep   RFAGVFFAVIGLTSCGFAGFNFLGRHHGRXVVLILIGCIGLIPVAHFLNPAAAAFAAAGL
             ||||||||:|||||||||||||||||||| |||||||||||||||::|||||||||||||
orf141a      RFAGVFFAVVGLTSCGFAGFNFLGRHHGRSVVLILIGCIGLIPTVHFLNPAAAAFAAAGL
             100       110       120       130       140       150

100       110       120       130       140
orf141.pep   VLHGYSLARRRVIAASFLLGTGWTLMSLAAAYPAAFALMLPLPVLMFFRP
             |||||||||||||||||||||||||||||||||||||||||||||||||
orf141a      VLHGYSLARRRVIAASFLLGTGWTLMSLAAAYPAAFALMLPLPVLMFFRPWQSRRLMLTA
             160       170       180       190       200       210 orf141a      VASLAFALPLMTVYPLLLAKTQPALFAQWLDDHVFGTFGGVRHIQTAFSLFYYLKNLLWF
             220       230       240       250       260       270
```

The complete length ORF141a nucleotide sequence (SEQ ID NO: 597) is:

```
   1  ATGCTGACCT ATACCCCGCC CGATGCCCGC CCGCCCGCCA AAACCCACGA
  51  AAAGCCGTGG CTGTTGCTGT TGATGGCGTT TGCCTGGTTG TGGCCCGGCG
 101  TGTTTTCCCA CGATTTGTGG AATCCTGACG AACCTGCCGT CTATACCGCC
 151  GTCGAAGCAC TGGCAGGCAG CCCCACCCCT TTGGTTGCCC ATCTGTTCGG
 201  TCAAATCGAT TTCGGCATAC CGCCCGTGTA TCTTTGGGTT GCCGCCGCGT
 251  TCAAACATTT GCTGTCGCCG TGGGCTGCCG ACCCGTATGA TGCCGCACGC
 301  TTTGCCGGCG TGTTTTTCGC CGTTGTCGGA CTGACTTCCT GCGGCTTTGC
 351  CGGTTTCAAC TTTTTGGGCA GACACCACGG GCGCAGCGTC GTCCTGATTC
 401  TCATCGGCTG TATCGGGCTG ATTCCGACCG TACACTTTCT CAACCCCGCT
 451  GCCGCCGCCT TTGCCGCCGC CGGACTGGTG CTGCACGGTT ATTCTTTGGC
 501  TCGCCGGCGC GTGATTGCCG CCTCTTTTCT GCTCGGTACG GGTTGGACGC
 551  TGATGTCGTT GGCAGCAGCT TATCCGGCGG CATTTGCCCT GATGCTGCCC
 601  CTGCCCGTGC TGATGTTTTT CCGTCCGTGG CAAAGCAGGC GTTTGATGTT
 651  GACGGCAGTC GCCTCGCTTG CCTTTGCCCT GCCGCTTATG ACCGTTTACC
 701  CGCTGCTCTT GGCAAAAACG CAGCCCGCGC TGTTCGCGCA ATGGCTCGAC
 751  GATCACGTTT TCGGTACGTT CGGCGGCGTG CGGCACATTC AGACGGCATT
 801  CAGTTTGTTT TACTATCTGA AAAACCTGCT TTGGTTTGCA TTGCCTGCGC
 851  TGCCGCTGGC GGTTTGGACG GTTTGCCGCA CGCGCCTGTT TTCGACCGAC
 901  TGGGGGATTT TGGGCGTCGT CTGGATGCTT GCCGTTTTGG TGCTGCTTGC
 951  CGTCAATCCG CAGCGTTTTC AGGATAACCT CGTCTGGCTG CTTCCGCCGC
1001  TTGCCCTGTT CGGCGCGGCG CAACTGGACA GCCTGAGACG CGGCGCGGCG
1051  GCGTTTGTCA ACTGGTTCGG CATTATGGCG TTCGGACTGT TTGCCGTGTT
1101  CCTGTGGACG GGCTTTTTCG CCATGAATTA CGGCTGGCCC GCCAAGCTTG
1151  CCGAACGCGC CGCCTATTTC AGCCCGTATT ATGTTCCTGA TATCGATCCC
1201  ATTCCGATGG CGGTTGCCGT ACTGTTCACA CCCTTGTGGC TGTGGGCGAT
1251  TACCCGCAAA AACATACGCG GCAGGCAGGC GGTTACCAAC TGGGCGGCAG
```

```
-continued
1301  GCGTTACCCT GACCTGGGCT TTGCTGATGA CGCTGTTCCT GCCGTGGCTG

1351  GACGCGGCGA AAAGCCACGC GCCCGTCGTC CGGAGTATGG AGGCATCGCT

1401  TTCCCCGGAA TTAAAACGGG AGCTTTCAGA CGGCATCGAG TGTATCGACA

1451  TAGGCGGCGG CGACCTACAC ACGCGGATTG TTTGGACGCA GTACGGCACA

1501  TTGCCGCACC GCGTCGGCGA TGTACAATGC CGCTACCGCA TCGTCCGCTT

1551  GCCCCAAAAC GCGGATGCGC CGCAAGGCTG GCAGACGGTC TGGCAGGGTG

1601  CGCGCCCGCG CAACAAAGAC AGTAAGTTCG CACTGATACG GAAAACCGGG

1651  GAAAATATAT TAAAAACAAC AGATTGA
```

This encodes a protein having amino acid sequence (SEQ ID NO: 598):

```
  1  MLTYTPPDAR PPAKTHEKPW LLLLMAFAWL WPGVFSHDLW NPDEPAVYTA

51  VEALAGSPTP LVAHLFGQID FGIPPVYLWV AAAFKHLLSP WAADPYDAAR

101  FAGVFFAVVG LTSCGFAGFN FLGRHHGRSV VLILIGCIGL IPTVHFLNPA

151  AAAFAAAGLV LHGYSLARRR VIAASFLLGT GWTLMSLAAA YPAAFALMLP

201  LPVLMFFRPW QSRRLMLTAV ASLAFALPLM TVYPLLLAKT QPALFAQWLD

251  DHVFGTFGGV RHIQTAFSLF YYLKNLLWFA LPALPLAVWT VCRTRLFSTD

301  WGILGVVWML AVLVLLAVNP QRFQDNLVWL LPPLALFGAA QLDSLRRGAA

351  AFVNWFGIMA FGLFAVFLWT GFFAMNYGWP AKLAERAAYF SPYYVPDIDP

401  IPMAVAVLFT PLWLWAITRK NIRGRQAVTN WAAGVTLTWA LLMTLFLPWL

451  DAAKSHAPVV RSMEASLSPE LKRELSDGIE CIDIGGGDLH TRIVWTQYGT

501  LPHRVGDVQC RYRIVRLPQN ADAPQGWQTV WQGARPRNKD SKFALIRKTG

551  ENILKTTD*
```

ORF141a (SEQ ID NO: 598) and ORF141-1 (SEQ ID NO: 596) show 98.2% identity in 553 aa overlap:

```
orf141a.pep  MLTYTPPDARPPAKTHEKPWLLLLMAFAWLWPGVFSHDLWNPDEPAVYTAVEALAGSPTP
             ||||||||||||||||||||||||||||||||||||||||||||||||||||||||||||
orf141-1     MLTYTPPDARPPAKTHEKPWLLLLMAFAWLWPGVFSHDLWNPDEPAVYTAVEALAGSPTP orf141a.pep  LVAHLFGQIDFGIPPVYLWVAAAFKHLLSPWAADPYDAARFAGVFFAVVGLTSCGFAGFN
             ||||||||:|||||||||||||||||||||||||:|||||||||||||:|||||||||||
orf141-1     LVAHLFGQTDFGIPPVYLWVAAAFKHLLSPWAADSYDAARFAGVFFAVIGLTSCGFAGFN orf141a.pep  FLGRHHGRSVVLILIGCIGLIPTVHFLNPAAAAFAAAGLVLHGYSLARRRVIAASFLLGT
             |||||||||||||||||||||:|||||||||||||||||||||||||||||||||||||
orf141-1     FLGRHHGRSVVLILIGCIGLIPVAHFLNPAAAAFAAAGLVLHGYSLARRRVIAASFLLGT orf141a.pep  GWTLMSLAAAYPAAFALMLPLPVLMFFRPWQSRRLMLTAVASLAFALPLMTVYPLLLAKT
             ||||||||||||||||||||||||||||||||||||||||||||||||||||||||||||
orf141-1     GWTLMSLAAAYPAAFALMLPLPVLMFFRPWQSRRLMLTAVASLAFALPLMTVYPLLLAKT orf141a.pep  QPALFAQWLDDHVFGTFGGVRHIQTAFSLFYYLKNLLWFALPALPLAVWTVCRTRLFSTD
             ||||||||||:|||||||||||:|||||||||||||||||||||||||||||||||||||
orf141-1     QPALFAQWLDYHVFGTFGGVRGVQTAFSLFYYLKNLLWFALPALPLAVWTVCRTRLFSTD orf141a.pep  WGILGVVWMLAVLVLLAVNPQRFQDNLVWLLPPLALFGAAQLDSLRRGAAAFVNWFGIMA
             ||||||||||||||||||||||||||||||||||||||||||||||||||||||||||||
orf141-1     WGILGVVWMLAVLVLLAVNPQRFQDNLVWLLPPLALFGAAQLDSLRRGAAAFVNWFGIMA orf141a.pep  FGLFAVFLWTGFFAMNYGWPAKLAERAAYFSPYYVPDIDPIPMAVAVLFTPLWLWAITRK
             ||||||||||||||||||||||||||||||||||||||||||||||||||||||||||||
orf141-1     FGLFAVFLWTGFFAMNYGWPAKLAERAAYFSPYYVPDIDPIPMAVAVLFTPLWLWAITRK
```

-continued

```
orf141a.pep  NIRGRQAVTNWAAGVTLTWALLMTLFLPWLDAAKSHAPVVRSMEASLSPELKRELSDGIE
             ||||||||||||||||||||||||||||||||||||||||||||||||||||||||||||
orf141-1     NIRGRQAVTNWAAGVTLTWALLMTLFLPWLDAAKSHAPVVRSMEASLSPELKRELSDGIE orf141a.pep  CIDIGGGDLHTRIVWTQYGTLPHRVGDVQCRYRIVRLPQNADAPQGWQTVWQGARPRNKD
             || ||||||||||||||||||||||||||||||||| |||||||||||||| ||||||||
orf141-1     CIGIGGGDLHTRIVWTQYGTLPHRVGDVQCRYRIVLLPQNADAPQGWQTVWGGARPRNKD orf141a.pep  SKFALIRKTGENI
             ||||||||| ||||
orf141-1     SKFALIRKIGENI
```

Homology with a Predicted ORF from *N.gonorrhoeae*

ORF141 (SEQ ID NO: 594) shows 95% identity over a 140aa overlap with a predicted ORF (ORF141ng) (SEQ ID NO: 600) from *N.gonorrhoeae*:

```
orf141.pep               DFGISPVYLWVAAAFKHLLSPWAADSYDVA  30
                         |||| |||||||||||||||||||||  :|
orf141ng    WNPAEPAVYTAVEALAGSPTPLVAHLFGQTDFGIPPVYLWVAAAFKHLLSPWAAHPYDAA  126 orf141.pep  RFAGVFFAVIGLTSCGFAGFNFLGRHHGRXVVLILIGCIGLIPVAHFLNPAAAAFAAAGL  90
            |||||||||||||||||||||||||||| |||| |||||||||||:|||||||||||||
orf141ng    RFAGVFFAVIGLTSCGFAGFNFLGRHHGRSVVLIHIGCIGLIPVAHFFNPAAAAFAAAGL  186 orf141.pep  VLHGYSLARRRVIAASFLLGTGWTLMSLAAAYPAAFALMLPLPVLMFFRP  140
            ||||||||||||||||||||||||||||||||||||||||||||||||||
orf141ng    VLHGYSLARRRVIAASFLLGTGWTLMSLAAAYPAAFALMLPLPVLMFFRPWQSRRLMLTA  246
```

An ORF141ng nucleotide sequence (SEQ ID NO: 599) was predicted to encode a protein having amino acid sequence (SEQ ID NO: 600):

```
  1  MPSEAVSARP LCEYLLHLAI RPFLLTLMLT YTPPDARPPA KTHEKPWLLL

51  LMAFAWLWFG VFSHDLWNPA EPAVYTAVEA LAGSPTPLVA HLFGQTDFGI

101  PPVYLWVAAA FKHLLSPWAA HPYDAARFAG VFFAVIGLTS CGFAGFNFLG

151  RHHGRSVVLI HIGCIGLIPV AHFFNPAAAA FAAAGLVLHG YSLARRRVIA

201  ASFLLGTGWT LMSLAAAYPA AFALMLPLPV LMFFRPWQSR RLMLTAVASL

251  AFALPLMTVY PLLLAKTQPA LFAQWLNYHV FGTFGGVRHI QRAFSLFHYL

301  KNLLWFAPPG LPLAVWTVCR TRLFSTDWGI LGIVWMLAVL VLLAFNPQRF

351  QDNLVWLLPP LALFGAAQLD SLRRGAAAFV NWFGIMAFGL FAVFLWTGFF

401  AMNYGWPAKL AERAAYFSPY YVPDIDPIPM AVAVLFTPLW LWAITRKNIR

451  GRQAVTNWAA GVTLTWALLM TLFLPWLDAA KSHAPVVRSM EASFSPELKR

501  ELSDGIECIG IGGGDLHTRI VWTQYGTLPH RVGDVRCRYR IVRLPQNADA

551  PQGWQTVWQG ARPRNKDSKF ALIRKIGENI LKTTD*
```

Further work revealed the following gonococcal DNA sequence (SEQ ID NO: 601):

```
  1  ATGCTGACCT ATACCCCGCC CGATGCCCGC CCGCCCGCCA AAACCCACGA

51  AAAACCGTGG CTGCTGCTGT TGATGGCGTT TGCCTGGCTG TGGCCCGGCG

101  TGTTTTCCCA CGATTTGTGG AATCCTGCCG AACCTGCCGT CTATACCGCC

151  GTCGAAGCAC TGGCAGGCAG CCCCACCCCC TTGGTTGCCC ATCTGTTCGG
```

```
-continued
 201   TCAAACCGAT TTCGGCATAC CGCCCGTGTA TCTTTGGGTT GCCGCCGCAT
 251   TCAAACATTT GCTGTCGCCG TGGGCAGCCG ACCCGTATGA TGCCGCACGC
 301   TTTGCAGGCG TATTTTTTGC CGTTATCGGA CTGACTTCTT GCGGCTTTGC
 351   CGGTTTCAAC TTTTTGGGCA GACACCACGG GCGCAGCGTT GTTTTAATCC
 401   ATATCGGCTG TATCGGGCTG ATTCCGGTTG CCCATTTCCT CAATCCcgcc
 451   gccgccgcct tTGCCGCCGC CGGACTGGTG CTGCacggct actcgctgGC
 501   ACGCCGGCGC GTGATtgccg cctctTtccT GCTCGGTACG GGTTGGACGT
 551   TGATGTCGCT GGCGGCAGCT TATCCGGCGG CGTTTGCGCT GATGCTGCCC
 601   CTGCCCGTGC TGATGTTTTT CCGTCCGTGG CAAAGCAGGC GTTTGATGTT
 651   GACGGCAGTC GCCTCGCTTG CCTTTGCCCT GCCGCTTATG ACCGTTTACC
 701   CGCTGCTCtt gGCAAAAACG CAGCCCGCGC TGTTTGCGCA ATGGCTCAAC
 751   TATCACGTTT TCGGTACGTt cggcgGCGTG CGGCAcaTTC AGAggGCatT
 801   Cagtttgttt cactatctgA AAaatctgct ttggttcgca ccgcccgggC
 851   TGCCGCTGGC GGTTTGGACG GTTTGCCGCA CACGCCTGTT TTCGACCGAC
 901   TGGGGGATTT TGGGCATTGT CTGGATGCTT GCCGTTTTGG TGCTGCTCGC
 951   CTTTAATCCG CAGCGTTTTC AAGACAACCT CGTCTGGCTG CTGCCGCCGC
1001   TTGCCCTGTT CGGCGCGGCG CAACTGGACA GCCTGAGGCG CGGCGCGGCG
1051   GCTTTTGTCA ACTGGTTCGG CATTATGGCG TTCGGGCTGT TTGCCGTGTT
1101   CCTGTGGACG GGCTTTTTCG CCATGAATTA CGGCTGGCCC GCCAAGCTTG
1151   CCGAACGCGC CGCCTACTTC AGCCCGTATT ACGTTCCCGA CATCGATCCC
1201   ATTCCGATGG CGGTTGCCGT ACTGTTCACA CCCTTGTGGC TGTGGGCGAT
1251   TACCCGGAAA AACATACGCG GCAGGCAGGC GGTTACCAAC TGGGCGGCAG
1301   GCGTTACCCT GACCTGGGCT TTGCTGATGA CGCTGTTCCT GCCGTGGCTG
1351   GACGCGGCGA AAAGCCACGC GCCCGTCGTC CGGAGTATGG AGGCATCGTT
1401   TTCCCCGGAA TTAAAACGGG AGCTTTCAGA CGGCATCGAG TGTATCGGCA
1451   TAGGCGGCGG CGACCTGCAC ACGCGGATTG TTTGGACGCA GTACGGCACA
1501   TTGCCGCACC GCGTCGGCGA TGTCCGTTGC CGCTACCGTA TCGTCCGCCT
1551   GCCCCAAAAC GCGGATGCGC CGCAAGGCTG GCAGACGGTC TGGCAGGGTG
1601   CGCGCCCGCG CAACAAAGAC AGTAAGTTTG CACTGATACG GAAAATCGGG
1651   GAAAATATAT TAAAAACAAC AGATTGA
```

This corresponds to the amino acid sequence (SEQ ID NO: 602; ORF141ng-1):

```
  1   MLTYTPPDAR PPAKTHEKPW LLLLMAFAWL WPGVFSHDLW NPAEPAVYTA
 51   VEALAGSPTP LVAHLFGQTD FGIPPVYLWV AAAFKHLLSP WAADPYDAAR
101   FAGVFFAVIG LTSCGFAGFN FLGRHHGRSV VLIHIGCIGL IPVAHFLNPA
151   AAAFAAAGLV LHGYSLARRR VIAASFLLGT GWTLMSLAAA YPAAFALMLP
201   LPVLMFFRPW QSRRLMLTAV ASLAFALPLM TVYPLLLAKT QPALFAQWLN
251   YHVFGTFGGV RHIQRAFSLF HYLKNLLWFA PPGLPLAVWT VCRTRLFSTD
301   WGILGIVWML AVLVLLAFNP QRFQDNLVWL LPPLALFGAA QLDSLRRGAA
```

```
                       -continued
351  AFVNWFGIMA FGLFAVFLWT GFFAMNYGWP AKLAERAAYF SPYYVPDIDP

401  IPMAVAVLFT PLWLWAITRK NIRGRQAVTN WAAGVTLTWA LLMTLFLPWL

451  DAAKSHAPVV RSMEASFSPE LKRELSDGIE CIGIGGGDLH TRIVWTQYGT

501  LPHRVGDVRC RYRIVRLPQN ADAPQGWQTV WQGARPRNKD SKFALIRKIG

551  ENILKTTD*
```

ORF141ng-1 (SEQ ID NO: 602) and ORF141-1 (SEQ ID NO: 596) show 97.5% identity in 553 aa overlap:

```
orf141ng-1.pep  MLTYTPPDARPPAKTHEKPWLLLLMAFAWLWPGVFSHDLWNPAEPAVYTAVEALAGSPTP
                ||||||||||||||||||||||||||||||||||||||||| ||||||||||||||||||
orf141-1        MLTYTPPDARPPAKTHEKPWLLLLMAFAWLWPGVFSHDLWNPDEPAVYTAVEALAGSPTP orf141ng-1.pep  LVAHLFGQTDFGIPPVYLWVAAAFKHLLSPWAADPYDAARFAGVFFAVIGLTSCGFAGFN
                |||||||||||||||||||||||||||||||||||| ||||||||||||||||||||||
orf141-1        LVAHLFGQTDFGIPPVYLWVAAAFKHLLSPWAADSYDAARFAGVFFAVIGLTSCGFAGFN orf141ng-1.pep  FLGRHHGRSVVLIHIGCIGLIPVAHFLNPAAAAFAAAGLVLHGYSLARRRVIAASFLLGT
                |||||||||||| |||||||||||||||||||||||||||||||||||||||||||||
orf141-1        FLGRHHGRSVVLILIGCIGLIPVAHFLNPAAAAFAAAGLVLHGYSLARRRVIAASFLLGT orf141ng-1.pep  GWTLMSLAAAYPAAFALMLPLPVLMFFRPWQSRRLMLTAVASLAFALPLMTVYPLLLAKT
                ||||||||||||||||||||||||||||||||||||||||||||||||||||||||||
orf141-1        GWTLMSLAAAYPAAFALMLPLPVLMFFRPWQSRRLMLTAVASLAFALPLMTVYPLLLAKT orf141ng-1.pep  QPALFAQWLNYHVFGTFGGVRHIQRAFSLFHYLKNLLWFAPPGLPLAVWTVCRTRLFSTD
                ||||||||:|||||||||||||:| |||||:||||||||| :||||||||||||||||
orf141-1        QPALFAQWLDYHVFGTFGGVRHVQTAFSLFYYLKNLLWFALPALPLAVWTVCRTRLFSTD orf141ng-1.pep  WGILGIVWMLAVLVLLAFNPQRFQDNLVWLLPPLALFGAAQLDSLRRGAAAFVNWFGIMA
                |||||:|||||||||||| |||||||||||||||||||||||||||||||||||||||
orf141-1        WGILGVVWMLAVLVLLAVNPQRFQDNLVWLLPPLALFGAAQLDSLRRGAAAFVNWFGIMA orf141ng-1.pep  FGLFAVFLWTGFFAMNYGWPAKLAERAAYFSPYYVPDIDPIPMAVAVLFTPLWLWAITRK
                ||||||||||||||||||||||||||||||||||||||||||||||||||||||||||
orf141-1        FGLFAVFLWTGFFAMNYGWPAKLAERAAYFSPYYVPDIDPIPMAVAVLFTPLWLWAITRK orf141ng-1.pep  NIRGRQAVTNWAAGVTLTWALLMTLFLPWLDAAKSHAPVVRSMEASFSPELKRELSDGIE
                |||||||||||||||||||||||||||||||||||||||||||||:|||||||||||||
orf141-1        NIRGRQAVTNWAAGVTLTWALLMTLFLPWLDAAKSHAPVVRSMEASLSPELKRELSDGIE orf141ng-1.pep  CIGIGGGDLHTRIVWTQYGTLPHRVGDVRCRYRIVRLPQNADAPQGWQTVWQGARPRNKD
                |||||||||||||||||||||||||||||:||||||| |||||||||||||||||||||
orf141-1        CIGIGGGDLHTRIVWTQYGTLPHRVGDVQCRYRIVLLPQNADAPQGWQTVWQGARPRNKD orf141ng-1.pep  SKFALIRKIGENILKTTDX
                |||||||||||||
orf141-1        SKFALIRKIGENIX
```

Based on the presence of several putative transmembrane domains in the gonococcal protein, it is predicted that the proteins from N.meningitidis and N.gonorrhoeae, and their epitopes, could be useful antigens for vaccines or diagnostics, or for raising antibodies.

Example 72

The following partial DNA sequence was identified in N.meningitidis (SEQ ID NO: 603):

```
  1  ..CAATCCGCCA AATGGTTATC GGGCCAAACT CTAGTCGGCA CAGCAATTGG

51    GATACGCGGG CAGATAAAGC TTGGCGGCAA CCTGCATTAC GATATATTTA

101    CCGGCCGCGC ATTGAAAAAG CCCGAATTTT TCCAATCAAG GAAATGGGCA

151    AGCGGTTTTC AGGTAGGCTA TACGTTTTAA
```

This corresponds to the amino acid sequence (SEQ ID NO: 604; ORF142):

```
  1 ..QSAKWLSGQT LVGTAIGIRG QIKLGGNLHY DIFTGRALKK PEFFQSRKWA

51   SGFQVGYTF*
```

Further work revealed the complete nucleotide sequence (SEQ ID NO: 605):

```
    1   ATGGATAATT CGGGTAGTGA GGCGACAGGA AAATACCAAG GAAATATCAC
   51   TTTCTCTGCC GACAATCCTT TGGGACTGAG TGATATGTTC TATGTAAATT
  101   ATGGACGTTC GATTGGCGGT ACGCCCGATG AGGAAAGTTT TGACGGCCAT
  151   CGCAAAGAAG GCGGATCAAA CAATTACGCC GTACATTATT CAGCCCCTTT
  201   CGGTAAATGG ACATGGGCAT TCAATCACAA TGGCTACCGT TACCATCAGG
  251   CAGTTTCCGG ATTATCGGAA GTCTATGACT ATAATGGAAA AAGTTACAAT
  301   ACTGATTTCG GCTTCAACCG CCTGTTGTAT CGTGATGCCA AACGCAAAAC
  351   CTATCTCGGT GTAAAACTGT GGATGAGGGA AACAAAAAGT TACATTGATG
  401   ATGCCGAACT GACTGTACAA CGGCGTAAAA CTGCGGGTTG GTTGGCAGAA
  451   CTTTCCCACA AGAATATAT CGGTCGCAGT ACGGCAGATT TTAAGTTGAA
  501   ATATAAACGC GGCACCGGCA TGAAAGATGC TCTGCGCGCG CCTGAAGAAG
  551   CCTTTGGCGA AGGCACGTCA CGTATGAAAA TTTGGACGGC ATCGGCTGAT
  601   GTAAATACTC CTTTTCAAAT CGGTAAACAG CTATTTGCCT ATGACACATC
  651   CGTTCATGCA CAATGGAACA AAACCCCGCT AACATCGCAA GACAAACTGG
  701   CTATCGGCGG ACACCACACC GTACGTGGCT TCGACGGTGA AATGAGTTTG
  751   TCTGCCGAGC GGGGATGGTA TTGGCGCAAC GATTTGAGCT GGCAATTTAA
  801   ACCAGGCCAT CAGCTTTATC TTGGGGCTGA TGTAGGACAT GTTTCAGGAC
  851   AATCCGCCAA ATGGTTATCG GGCCAAACTC TAGTCGGCAC AGCAATTGGG
  901   ATACGCGGGC AGATAAAGCT TGGCGGCAAC CTGCATTACG ATATATTTAC
  951   CGGCCGCGCA TTGAAAAAGC CCGAATTTTT CCAATCAAGG AAATGGGCAA
 1001   GCGGTTTTCA GGTAGGCTAT ACGTTTTAA
```

This corresponds to the amino acid sequence (SEQ ID NO: 606; ORF142-1):

```
  1 MDNSGSEATG KYQGNITFSA DNPLGLSDMF YVNYGRSIGG TPDEESFDGH
 51 RKEGGSNNYA VHYSAPFGKW TWAFNHNGYR YHQAVSGLSE VYDYNGKSYN
101 TDFGFNRLLY RDAKRKTYLG VKLWMRETKS YIDDAELTVQ RRKTAGWLAE
151 LSHKEYIGRS TADFKLKYKR GTGMKDALRA PEEAFGEGTS RMKIWTASAD
201 VNTPFQIGKQ LFAYDTSVHA QWNKTPLTSQ DKLAIGGHHT VRGFDGEMSL
251 SAERGWYWRN DLSWQFKPGH QLYLGADVGH VSGQSAKWLS GQTLVGTAIG
301 IRGQIKLGGN LHYDIFTGRA LKKPEFFQSR KWASGFQVGY TF*
```

Computer analysis of this amino acid sequence gave the following results:
Homology with a Predicted ORF from N.gonorrhoeae ORF142 (SEQ ID NO: 604) shows 88.1% identity over a 59aa overlap with a predicted ORF (ORF142ng) (SEQ ID NO: 608) from N.gonorrhoeae:

```
orf142.pep                         QSAKWLSGQTLVGTAIGIRGQIKLGGNLHY    30
                                   |||||||||||:|||||||||||||||||
orf142ng  RGWYWRNDLSWQFKPGHQLYLGADVGHVSGQSAKWLSGQTLAGTAIGIRGQIKLGGNLHY   313 orf142.pep  DIFTGRALKKPEFFQSRKWASGFQVGYTP                                 59
            ||||||||||||:||::||::|||||||:|
orf142ng    DIFTGRALKKPEYFQTKKWVTGFQVGYSF                                342
```

The complete length ORF142ng nucleotide sequence (SEQ ID NO: 607) is:

```
   1  ATGGATAATT CGGGTAGTGA GGCGACAGGA AAATACCAAG GAAATATCAC
  51  TTTCTCTGCC GACAATCCTT TTGGACTGAG TGATATGTTC TATGTAAATT
 101  ATGGACGTTC AATTGGCGGT ACGCCCGATG AGGAAAATTT TGACGGCCAT
 151  CGCAAAGAAG GCGGATCAAA CAATTACGCC GTACATTATT CAGCCCCTTT
 201  CGGTAAATGG ACATGGGCAT TCAATCACAA TGGCTACCGT TACCATCAGG
 251  CGGTTTCCGG ATTATCGGGA GTCTATGACT ATAATGGAAA AAGTTACAAC
 301  ACTGATTTCG GCTTCAACCG CCTGTTGTAT CGTGATGCCA AACGCAAAAC
 351  CTATCTCAGT GTAAAACTGT GGACGAGGGA AACAAAAAGT TACATTGATG
 401  ATGCCGAACT GACTGTACAA CGGCGTAAAA CCACAGGTTG GTTGGCAGAA
 451  CTTTCCCACA AAGGATATAT CGGTCGCAGT ACGGCAGATT TTAAGTTGAA
 501  ATATAAACAC GGCACCGGCA TGAAAGATGC TCTGCGCGCG CCTGAAGAAG
 551  CCTTTGGCGA AGGCACGTCA CGTATGAAAA TTTGGACGGC ATCGGCTGAT
 601  GTAAATACTC CTTTTCAAAT CGGTAAACAG CTATTTGCCT ATGACACATC
 651  CGTTCATGCA CAATGGAACA AAACCCCGCT AACATCGCAA GACAAACTGG
 701  CTATCGGCGG ACACCACACC GTACGTGGCT TCGACGGTGA AATGAGTTTG
 751  CCTGCCGAGC GGGGATGGTA TTGGCGCAAC GATTTGAGCT GGCAATTTAA
 801  ACCAGGCCAT CAGCTTTATC TTGGGGCTGA TGTAGGACAT GTTTCAGGAC
 851  AATCCGCCAA ATGGTTATCG GGCCAAACTC TAGCCGGCAC AGCAATTGGG
 901  ATACGCGGGC AGATAAAGCT TGGCGGCAAC CTGCATTACG ATATATTTAC
 951  CGGCCGTGCA TTGAAAAAGC CCGAATATTT TCAGACGAAG AAATGGGTAA
1001  CGGGGTTTCA GGTGGGTTAT TCGTTTTGA
```

This encodes a protein having amino acid sequence (SEQ ID NO: 608):

```
   1  MDNSGSEATG KYQGNITFSA DNPFGLSDMF YVNYGRSIGG TPDEENFDGH
  51  RKEGGSNNYA VHYSAPFGKW TWAFNHNGYR YHQAVSGLSE VYDYNGKSYN
 101  TDFGFNRLLY RDAKRKTYLS VKLWTRETKS YIDDAELTVQ RRKTTGWLAE
 151  LSHKGYIGRS TADFKLKYKH GTGMKDALRA PEEAFGEGTS RMKIWTASAD
 201  VNTPFQIGKQ LFAYDTSVHA QWNKTPLTSQ DKLAIGGHHT VRGFDGEMSL
 251  PAERGWYWRN DLSWQFKPGH QLYLGADVGH VSGQSAKWLS GQTLAGTAIG
 301  IRGQIKLGGN LHYDIFTGRA LKKPEYFQTK KWVTGFQVGY SF*
```

The underlined sequence (aromatic-Xaa-aromatic amino acid motif) is usually found at the C-terminal end of outer membrane proteins.

ORF142ng (SEQ ID NO: 608) and ORF142-1 (SEQ ID NO: 606) show 95.6% identity over 342aa overlap.

```
orf142-1.pep  MDNSGSEATGKYQGNITFSADNPLGLSDMFYVNYGRSIGGTPDEESFDGHRKEGGSNNYA
              ||||||||||||||||||||||||||:||||||||||||||||||||:||||||||||||
orf142ng-1    MDNSGSEATGKYQGNITFSADNPFGLSDMFYVNYGRSIGGTPDEENFDGHRKEGGSNNYA orf142-1.pep  VHYSAPFGKWTWAFNHNGYRYHQAVSGLSEVYDYNGKSYNTDFGFNRLLYRDAKRKTYLG
              |||||||||||||||||||||||||||||||||||||||||||||||||||||||||||:
orf142ng-1    VHYSAPFGKWTWAFNHNGYRYHQAVSGLSEVYDYNGKSYNTDFGFNRLLYRDAKRKTYLS orf142-1.pep  VKLWMRETKSYIDDAELTVQRRKTAGWLAELSHKEYIGRSTADFKLKYKRGTGMKDALRA
              ||||  ||||||||||||||||||||:|||||||||  ||||||||||||:||||||||
orf142ng-1    VKLWTRETKSYIDDAELTVQRRKTTGWLAELSHKGYIGRSTADFKLKYKHGTGMKDALRA orf142-1.pep  PEEAFGEGTSRMKIWTASADVNTPFQIGKQLFAYDTSVHAQWNKTPLTSQDKLAIGGHHT
              ||||||||||||||||||||||||||||||||||||||||||||||||||||||||||||
orf142ng-1    PEEAFGEGTSRMKIWTASADVNTPFQIGKQLFAYDTSVHAQWNKTPLTSQDKLAIGGHHT orf142-1.pep  VRGFDGEMSLSAERGWYWRNDLSWQFKPGHQLYLGADVGHVSGQSAKWLSGQTLVGTAIG
              |||||||||| ||||||||||||||||||||||||||||||||||||||||||:|||||
orf142ng-1    VRGFDGEMSLPAERGWYWRNDLSWQFKPGHQLYLGADVGHVSGQSAKWLSGQTLAGTAIG orf142-1.pep  IRGQIKLGGNLHYDIFTGRALKKPEFFQSRKWASGFQVGYTF
              ||||||||||||||||||||||||||:|::||::||||||:|
orf142ng-1    IRGQIKLGGNLHYDIFTGRALKKPEYFQTKKWVTGFQVGYSF
```

In addition, ORF142ng (SEQ D NO: 608) is homologous to the HecB protein (SEQ D NO: 1149) of *E.chrysanthemi*:

```
gi|1772622 (L39897) HecB [Erwinia chrysanthemi] Length = 558
Score = 119 bits (295), Expect = 3e-26
Identities = 88/346 (25%), Positives = 151/346 (43%), Gaps = 22/346 (6%)

Query:    2 DNSGSEATGKYQGNITFSADNPFGLSDMFYVNYGRSIGGTPDEENFDGHRKEGGSNNYAV   61
            DNSG ++TG+ Q N + + DN FGL+D ++++ G S    + D    + G
Sbjct:  230 DNSGQKSTGEEQLNGSLALDNVFGLADQWFISAGHS---SRFATSHDAESLQAG------  280

Query:   62 HYSAPFGKWTWAFNHNGYRYHQAVSGLSEVYDYNGKSYNTDFGFNRLLYRDAKRKTYLSV  121
            +S P+G W   +N++ RY        + G S     F  +R+++RD   KT ++
Sbjct:  281 -FSMPYGYWNLGYNYSQSRYRNTFINRDFPWHSTGDSDTHRFSLSRVVFRDGTMKTAIAG  339

Query:  122 KLWTRETKSYIDDAELTVQRRKTTGWLAELSHKGYIGRSTADFKLKYKHGTGMKDALRAP  181
                R    +Y++ +  L    RK +     ++H +     A F      Y  G     +
Sbjct:  340 TFSQRTGNNYLNGSLLPSSSRKLSSVSLGVNHSQKLWGGLATFNPTYNRGVRWLGSETDT  399

Query:  182 EEAFGEGTSRMKIWTASADVNTPFQIGKQLFAYDTSVHAQWNKTPLTSQDKLAIGGHHTV  241
               +++ E  +    WT SA    P          Y  S++ Q++    L   ++L +GG  ++
Sbjct:  400 DKSADEPRAEFNKWTLSASYYHPV---TDSITYLGSLYGQYSARALYGSEQLTLGGESSI  456

Query:  242 RGFDGEMSLPAERGWYWRNDLSWQFKP----GHQLYLGA-DVGHVSGQSAKWLSGQTLAG  296
            RGF  E     RG YWRN+L+WQ        G+  ++ A D GH+       + +L G
Sbjct:  457 RGF-REQYTSGNRGAYWRNELNWQAWQLPVLGNVTFMAAVDGGHLYNHKQDNSTAASLWG  515

Query:  297 TAIGIRGQIKLGGNLHYDIFTGRALKKPEYFQTKKWVTGFQVGYSF                342
            A+G+     +    L   +  G +  P + Q     V G++VG SF
Sbjct:  516 GAVGMTVASRW---LSQQVTVGWPISYPAWLQPDTMVVGYRVGLSF                558
```

On the basis of this analysis, it is predicted that the proteins from *N.meningitidis* and *N.gonorrhoeae*, and their epitopes, could be useful antigens for vaccines or diagnostics, or for raising antibodies.

Example 73

The following partial DNA sequence was identified in *N.meningitidis* (SEQ ID NO: 609):

```
  1 ATGCGGACGA AATGGTCAGC AGTGAGAAGC TGCTTACTTG GgCGGACACC
 51 GCCGACATCG ATACCGCTTT GAACCTGTTG TACCGTTTGC AAAAACTCGA
```

-continued

```
101 ATTCCTCTAT GGCGATGAAA ACGGTCATTC AGACGGCATC AATTTGwCGG

151 ACGAGCAATT GCCGTTGCTG ATGGAACAAT TGTCCGGCAG CGGTAAGGCG

201 TTATTGGTCG ATCGGAACGG TCTGTATCTT GCCAACGCCA ATTTCCATCA

251 TGAGGCGGCG GAAGAGTTGG GGTTGTTGGC GGCAGAAGTC GCACAGATGG

301 AAAAGAAATA CCGGCTGCTG ATTAAGAACA AC..
```

This corresponds to the amino acid sequence (SEQ ID NO: 610; ORF143):

```
  1 MRTKWSAVRS CTWADTADID TALNLLYRLQ KLEFLYGDEN GHSDGINLXD

51 EQLPLLMEQL SGSGKALLVD RNGLYLANAN FHHEAAEELG LLAAEVAQME

101 KKYRLLIKNN ..
```

Further work revealed the complete nucleotide sequence (SEQ ID NO: 611):

```
  1 ATGGAATCAA CACTTTCACT ACAAGCAAAT TTATATCCCC GCCTGACTCC

51 TGCCGGTGCA TTTTATGCCG TATCCAGCGA TGCCCCCAGT GCCGGTAAAA

101 CTTTGTTGCA CAGCCTGTTG AAAGCAGATG CGGACGAAAT GGTCAGCAGT

151 GAGAAGCTGC TTACTTGGGC GGACACCGCC GACATCGATA CCGCTTTGAA

201 CCTGTTGTAC CGTTTGCAAA AACTCGAATT CCTCTATGGC GATGAAAACG

251 GTCATTCAGA CGGCATCAAT TTGTCGGACG AGCAATTGCC GTTGCTGATG

301 GAACAATTGT CCGGCAGCGG TAAGGCGTTA TTGGTCGATC GGAACGGTCT

351 GTATCTTGCC AACGCCAATT TCCATCATGA GGCGGCGGAA GAGTTGGGGT

401 TGTTGGCGGC AGAAGTCGCA CAGATGGAAA AGAAATACCG GCTGCTGATT

451 AAGAACAACC TGTATATCAA CAATAACGCT TGGGGCGTTT GCGATCCTTC

501 CGGTCAGAGC GAATTGACAT TTTTCCCATT GTATATCGGT TCAACCAAAT

551 TTATTTTGGT TATCGGCGGC ATTCCCGATT TGGGCAAAGA GGCATTTGTT

601 ACTTTGGTAA GGATTTTATA CCGCCGTTAC AGCAACCGCG TGTAA
```

This corresponds to the amino acid sequence (SEQ ID NO: 612; ORF143-1):

```
  1 MESTLSLQAN LYPRLTPAGA FYAVSSDAPS AGKTLLHSLL KADADEMVSS

51 EKLLTWADTA DIDTALNLLY RLQKLEFLYG DENGHSDGIN LSDEQLPLLM

101 EQLSGSGKAL LVDRNGLYLA NANFHHEAAE ELGLLAAEVA QMEKKYRLLI

151 KNNLYINNNA WGVCDPSGQS ELTFFPLYIG STKFILVIGG IPDLGKEAFV

201 TLVRILYRRY SNRV*
```

Computer analysis of this is of this amino acid sequence gave the following results:
Homology with a Predicted ORF from *N.meningitidis* (Strain A)

ORF143 (SEQ ID NO: 610) shows 92.4% identity over a 105aa overlap with an ORF (ORF143a) (SEQ ID NO: 4) from strain A of *N. meningitidis*:

```
                              10        20        30
orf143.pep                    MRTKWSAVRSCTWADTADIDTALNLLYRLQKLEFL
                              |: :   ||| |||||||||||||||||||||||
orf143a    GAFYAVSSDXPSAGKTLLHSLLKADADEMVSSEKLLTWAXTADIDTALNLLYRLQKLEFL
              20        30        40        50        60        70

40        50        60        70        80        90
orf143.pep   YGDENGHSDGINLXDEQLPLLMEQLSGSGKALLVDRNGLYLANANFHHEAAEELGLLAAE
             |||||||||||||| |||||||||||||||||||||||||||||||||||||||||||
orf143a      YGDENGHSDGINLSDEQLPLLMEQLSGSGKALLVDRNGLYLANANFHHEAAEELGLLAAE
                80        90       100       110       120       130

100       110
orf143.pep   VAQMEKKYRLLIKNN
             |||||||||| ||||
orf143a      VAQMEKKYRLXIKNNLYINNNAWGVCDPSGQSELTFFPLYIGSTKFILVIGGIPDLGKEA
               140       150       160       170       180       190
```

The complete length ORF143a nucleotide sequence (SEQ ID NO: 613) is:

```
  1  ATGGAATCAA CAATTTCACT ACAAGCAAAT TTATATCNCC GCCTGACTCC
 51  TGCCGGTGCA TTTTATGCCG TATCCAGCGA TGNCCCCAGT GCCGGTAAAA
101  CTTTGTTGCA CAGCCTGTTG AAAGCGGATG CGGACGAAAT GGTNAGCAGT
151  GAGAAGCTGC TTACCTGGGC GGANACCGCC GACATCGATA CCGCTTTGAA
201  CCTCTTGTAC CGTTTGCAAA AACTCGAATT CCTCTATGGC GATGAAAACG
251  GTCATTCAGA CGGCATCAAT TTGTCGGACG AGCAATTGCC GTTGCTGATG
301  GAACAATTGT CCGGCAGCGG TAAGGCGTTA TTGGTCGATC GGAACGGTCT
351  GTATCTTGCC AACGCCAATT CCATCATGA GGCGGCGGAA GAGTTGGGGT
401  TGTTGGCGGC AGAAGTCGCA CAGATGGAAA AGAAATACCG GCTGCNNATT
451  AAGAACAACC TGTATATCAA CAATAACGCT TGGGGCGTTT GCGATCCTTC
501  CGGTCAGAGC GAATTGACAT TTTTCCCATT GTATATCGGT TCAACCAAAT
551  TTATTTTGGT TATCGGCGGC ATTCCCGATT GGGCAAAGA GGCATTTGTT
601  ACTTTGGTAA GGATNTTATA CCNCCNGTTA CAGCAACCGC GTGTAAAACT
651  TGGGAGAGAG GANGGGTTAT GCAGCAATTA TTGA
```

This encodes a protein having amino acid sequence (SEQ ID NO: 614):

```
  1  MESTXSLQAN LYXRLTPAGA FYAVSSDXPS AGKTLLHSLL KADADEMVSS
 51  EKLLTWAXTA DIDTALNLLY RLQKLEFLYG DENGHSLGIN LSDEQLPLLM
101  EQLSGSGKAL LVDRNGLYLA NANFHHEAAE ELGLLAAEVA QMEKKYRLXI
151  KNNLYINNNA WGVCDPSGQS ELTFFPLYIG STKFILVIGG IPDLGKEAFV
201  TLVRXLYXXL QQPRVKLGRE XGLCSNY*
```

ORF143a (SEQ ID NO: 614) and ORF143-1 (SEQ ID NO: 612) show 97.1% identity in 207 aa overlap:

```
orf143a.pep  MESTXSLQANLYXRLTPAGAFYAVSSDXPSAGKTLLHSLLKADADEMVSSEKLLTWAXTA
             ||||  |||||| ||||||||||||||| |||||||||||||||||||||||||||  ||
orf143-1     MESTLSLQANLYPRLTPAGAFYAVSSDAPSAGKTLLHSLLKADADEMVSSEKLLTWADTA
```

```
                       -continued
orf143a.pep  DIDTALNLLYRLQKLEFLYGDENGHSDGINLSDEQLPLLMEQLSGSGKALLVDRNGLYLA
             ||||||||||||||||||||||||||||||||||||||||||||||||||||||||||||
orf143-1     DIDTALNLLYRLQXLEFLYGDENGHSDGINLSDEQLPLLMEQLSGSGKALLVDRNGLYLA orf143a.pep  NANFHHEAAEELGLLAAEVAQMEKKYRLXIKNNLYINNNAWGVCDPSGQSELTFFPLYIG
             |||||||||||||||||||||||||||| |||||||||||||||||||||||||||||||
orf143-1     NANFHHEAAEELGLLAAEVAQMEKKYRLLIKNNLYINNNAWGVCDPSGQSELTFFPLYIG orf143a.pep  STKFILVIGGIPDLGKEAFVTLVRXLY
             ||||||||||||||||||||||||| ||
orf143-1     STKFILVIGGIPDLGKEAFVTLVRILY
```

Homology with a Predicted ORF from *N.gonorrhoeae*

ORF143 (SEQ ID NO: 610) shows 95.5% identity over a 110aa overlap with a predicted ORF (ORF143ng) (SEQ ID NO: 616) from *N.gonorrhoeae*:

```
orf143.pep   MRTKWSAVRSCTWADTADIDTALNLLYRLQKLEFLYGDENGHSDGINLXDEQLPLLMEQL   60
             ||||||||||| : |||||||||||||||||||||||||||||||||| |||||||||||
orf143ng     MRTKWSAVRSCSRADTADIDTALNLLYRLQKLEFLYGDENGHSDGINLSDEQLPLLMEQL   60 orf143.pep   SGSGKALLVDPNGLYLANANFHHEAAEELGLLAAEVAQMEKKYRLLIKNN            110
             ||||||||||| |||||||||||| ||||||||||||||||||||| : ||
orf143ng     SGSGKALLVDRNGLYLANANFHHESAEELGLLAAEVAQMEKKYRLLIRNNLYINNNAWGV  120
```

An ORF143ng nucleotide sequence (SEQ ID NO: 615) was predicted to encode a protein having amino acid sequence (SEQ ID NO: 616):

```
  1  MRTKWSAVRS CSRADTADID TALNLLYRLQ KLEFLYGDEN GHSDGINLSD

51  EQLPLLMEQL SGSGKALLVD RNGLYLANAN FHHESAEELG LLAAEVAQME

101  KKYRLLIRNN LYINNNAWGV CDPSGQSELT FFPLYIGSTK FILVIAGIPD

151  LSKGGICYFG KDFIPPLLQP RVKLGTGGIM RQLLISILED LNNTSTDIIA

201  SAVISTDGLP MATMLPSHLN SDRVGAISAT LLALGSRSVQ ELACGELEQV

251  MIKGKSGYIL LSQAGKDAVL VLVAKETGRL GLILLDAKRA ARHIAEAI*
```

Further work revealed the following gonococcal DNA sequence (SEQ ID NO: 617):

```
  1  ATGGAATCAA CACTTTCACT ACAAGCGAAT TTATATCCCT GCCTGACTCC

51  TGCCGGTGCA TTTTATGCCG TATCCAGCGA TGCCCCCAGT GCCGGTAAAA

101  CTTTGTTGCG CAGCCTGTTG AAAGCGGATG CGGACGAAGT GGTCAGCAGT

151  GAGAAGCTGC TCGCGGCGGA CACCGCCGAC ATCGATACCG CTTTGAACCT

201  GTTGTACCGT TTGCAAAAAC TCGAATTCCT CTATGGCGAT GAAAACGGTC

251  ATTCAGACGG CATCAATTTG TCGGACGAGC AATTGCCGTT GCTGATGGAA

301  CAATTGTCCG GCAGCGGTAA GGCATTATTG GTCGATCGGA ACGGTCTGTA

351  TCTTGCCAAC GCCAATTTCC ATCATGAGTC GGCGGGAGAG TTGGGGTTGT

401  TGGCGGCAGA AGTCGCACAG ATGGAAAAGA AATACCGGCT GCTGATTAGG

451  AACAACCTGT ATATCAACAA TAACGCTTGG GGCGTTTGCG ATCCTTCCGG

501  TCAGAGCGAA TTGACATTTT TCCCATTGTA TATCGGTTCA ACCAAATTTA

551  TTTTGGTTAT CGCCGGCATT CCCGATTTGA GCAAAGAGGC ATTTGTTACT

601  TTGGTAAGGA TTTTATACCG CCGTTACAGC AACCGCGTGT AA
```

This corresponds to the amino acid sequence (SEQ ID NO: 618; ORF143ng-1):

```
  1  MESTLSLQAN LYPCLTPAGA FYAVSSDAPS AGKTLLRSLL KADADEVVSS

51  EKLLAADTAD IDTALNLLYR LQKLEFLYGD ENGHSDGINL SDEQLPLLME

101  QLSGSGKALL VDRNGLYLAN ANFHHESAEE LGLLAAEVAQ MEKKYRLLIR

151  NNLYINNNAW GVCDPSGQSE LTFFPLYIGS TKFILVIAGI PDLSKEAFVT

201  LVRILYRRYS NRV*
```

ORF143ng-1 (SEQ ID NO: 618) and ORF143-1 (SEQ ID NO: 612) show 95.8% identity in 214 aa overlap:

```
orf143ng-1.pep  MESTLSLQANLYPCLTPAGAFYAVSSDAPSAGKTLLRSLLKADADEVVSSEKLLA-ADTA    59
                |||||||||||| ||||||||||||||||||||||||:|||||||||:|||||||: ||||
orf143-1        MESTLSLQANLYPRLTPAGAFYAVSSDAPSAGKTLLHSLLKADADEMVSSEKLLTWADTA    60 orf143ng-1.pep  DIDTALNLLYRLQKLEFLYGDENGHSDGINLSDEQLPLLMEQLSGSGKALLVDRNGLYLA   119
                ||||||||||||||||||||||||||||||||||||||||||||||||||||||||||||
orf143-1        DIDTALNLLYRLQKLEFLYGDENGHSDGINLSDEQLPLLMEQLSGSGKALLVDRNGLYLA   120 orf143ng-1.pep  NANFHHESAEELGLLAAEVAQMEKKYRLLIRNNLYINNNAWGVCDPSGQSELTFFPLYIG   179
                |||||| :||||||||||||||||||||||:|||||||||||||||||||||||||||||
orf143-1        NANFHHEAAEELGLLAAEVAQMEKKYRLLIKNNLYINNNAWGVCDPSGQSELTFFPLYIG   180 orf143ng-1.pep  STKFILVIAGIPDLSKEAFVTLVRILYRRYSNRV                            213
                ||||||||:|||||:||||||||||||||||||
orf143-1        STKFILVIGGIPDLGKEAFVTLVRILYRRYSNRV                            214
```

Based on the presence of the putative transmembrane domains in the gonococcal protein, it is predicted that the proteins from *N.meningitidis* and *N.gonorrhoeae*, and their epitopes, could be useful antigens for vaccines or diagnostics, or for raising antibodies.

Example 74

The following partial DNA sequence was identified in *N.meningitidis* (SEQ ID NO: 619):

```
  1  ATGACCTTTT TACAACGTTT GCAAGGTTTG GCAGACAATA AAATCTGTGC

51  GTTTGCATGG TTCGTCGTCC GCCGCTTTGA TGAAGAACGC GTACCGCAGr

101  CGGCGGCAAG CATGACGTTT ACGACGCTGC TGGCACTCGT CCCCGTGCTG

151  ACCGTGATGG TGGCGGTCGC TTCGATTTTC CCCGTGTTCG ACCGCTGGTC

201  GGATTCGTTC GTCTCCTTCG TCAACCAAAC CATTGTGCCG CA.GGCGCGG

251  ACATGGTGTT CGACTATATC AATGCGTTCC GCGAGCAGGC GAACCGGCTG

301  ACGGCAATCG GCAGCGTGAT GCTGGTCGTT ACCTCGCTGA TGCTGATTCG

351  GACGATAGAC AATACGTTCA ACCGCATCTG G+e,dus aCGGGTCAA wTyC-
     CAGCGT

401  CCGTGGATG..
```

The corresponds to the amino acid sequence (SEQ ID NO: 620; ORF144):

```
  1  MTFLQRLQGL ADNKICAFAW FVVRRFDEER VPQXAASMTF TTLLALVPVL

51  TVMVAVASIF PVFDRWSDSF VSFVNQTIVP XGADMVFDYI NAFREQANRL

101  TAIGSVMLVV TSLMLIRTID NTFNRIWRVX XQRPWM...
```

Further work revealed the complete nucleotide sequence (SEQ ID NO: 621):

```
   1   ATGACCTTTT TACAACGTTT GCAAGGTTTG GCAGACAATA AAATCTGTGC
  51   GTTTGCATGG TTCGTCGTCC GCCGCTTTGA TGAAGAACGC GTACCGCAGG
 101   CGGCGGCAAG CATGACGTTT ACGACGCTGC TGGCACTCGT CCCCGTGCTG
 151   ACCGTGATGG TGGCGGTCGC TTCGATTTTC CCCGTGTTCG ACCGCTGGTC
 201   GGATTCGTTC GTCTCCTTCG TCAACCAAAC CATTGTGCCG CAGGGCGCGG
 251   ACATGGTGTT CGACTATATC AATGCGTTCC GCGAGCAGGC GAACCGGCTG
 301   ACGGCAATCG GCAGCGTGAT GCTGGTCGTT ACCTCGCTGA TGCTGATTCG
 351   GACGATAGAC AATACGTTCA ACCGCATCTG GCGGGTCAAT TCCCAGCGTC
 401   CGTGGATGAT GCAGTTTCTC GTCTATTGGG CTTTACTGAC GTTCGGGCCG
 451   CTGTCTTTGG GCGTGGGCAT TTCCTTTATG GTCGGCTCGG TACAGGATGC
 501   CGCGCTTGCC TCAGGTGCGC CGCAGTGGTC GGGCGCGTTG CGAACGGCGG
 551   CGACGCTGAC CTTCATGACG CTTTTGCTGT GGGGGCTGTA CCGCTTCGTG
 601   CCAAACCGCT TCGTTCCCGC GCGGCAGGCG TTTGTCGGGG CTTTGGCAAC
 651   AGCGTTTTGT CTGGAAACCG CGCGCTCCCT CTTCACTTGG TATATGGGCA
 701   ATTTCGACGG CTACCGCTCG ATTTACGGCG CGTTTGCCGC CGTGCCGTTT
 751   TTTCTGTTGT GGCTGAACCT GTTGTGGACG CTGGTCTTGG GCGGCGCGGT
 801   GCTGACTTCT TCACTCTCCT ACTGGCAGGG AGAAGCGTTC CGCAGGGGCT
 851   TCGACTCGCG CGGACGGTTT GACGACGTGT TGAAAATCCT GCTGCTTCTG
 901   GATGCGGCGC AAAAGAAGG CAAAGCCTTG CCTGTTCAGG AGTTCAGACG
 951   GCATATCAAT ATGGGCTACG ACGAGTTGGG CGAGCTTTTG GAAAAGCTGG
1001   CGCGGCACGG CTACATCTAT TCCGGCAGAC AGGGTTGGGT GTTGAAAACG
1051   GGGGCGGATT CGATTGAGTT GAACGAACTC TTCAAGCTCT TCGTTTACCG
1101   TCCGTTCCCT GTGCAAAGGG ATCATGTGAA CCAAGCTGTC GATGCGGTAA
1151   TGACACCGTG TTTGCAGACT TTGAACATGA CGCTGGCAGA GTTTGACGCT
1201   CAGGCGAAAA AACGGCAGTA G
```

This corresponds to the amino acid sequence (SEQ ID NO: 622; ORF144-1):

```
   1   MTFLQRLQGL ADNKICAFAW FVVRRFDEER VPQAAASMTF TTLLALVPVL
  51   TVMVAVASIF PVFDRWSDSF VSFVNQTIVP QGADMVFDYI NAFREQANRL
 101   TAIGSVMLVV TSLMLIRTID NTFNRIWRVN SQRPWMMQFL VYWALLTFGP
 151   LSLGVGISFM VGSVQDAALA SGAPQWSGAL RTAATLTFMT LLLWGLYRFV
 201   PNRFVPARQA FVGALATAFC LETARSLFTW YMGNFDGYRS IYGAFAAVPF
 251   FLLWLNLLWT LVLGGAVLTS SLSYWQGEAF RRGFDSRGRF DDVLKILLLL
 301   DAAQKEGKAL PVQEFRRHIN MGYDELGELL EKLARHGYIY SGRQGWVLKT
 351   GADSIELNEL FKLFVYRPLP VERDHVNQAV DAVMTPCLQT LNMTLAEFDA
 401   QAKKRQ*
```

Computer analysis of this amino acid sequence gave the following results:

Homology with a Predicted ORF from *N.meningitidis* (Strain A)

ORF144 (SEQ ID NO: 620) shows 96.3% identity over a 136aa overlap with an ORF (ORF144a) (SEQ ID NO: 624) from strain A of *N. meningitidis*:

```
                    10        20        30        40        50        60
orf144.pep  MTFLQRLQGLADNKICAFAWFVVRRFDEERVPQXAASMTFTTLLALVPVLTVMVAVASIF
            ||||||||||||||||||||||||||||||||| ||||||||||||||||||||||||||
orf144a     MTFLQRLQGLADNKICAFAWFVVRRFDEERVPQAAASMTFTTLLALVPVLTVMVAVASIF
                    10        20        30        40        50        60

70        80        90       100       110       120
orf144.pep  PVFDRWSDSFVSFVNQTIVPXGADMVFDYINAFREQANRLTAIGSVMLVVTSLMLIRTID
            |||||||||||||||||||| ||||||||||||||||||||||||||||||| |||||||
orf144a     PVFDRWSDSFVSFVNQTIVPQGADMVFDYINAFREQANRLTAIGSVMLVVTSXMLIRTID
                    70        80        90       100       110       120

130
orf144.pep  NTFNRIWRVXXQRPWM
            ||||||||| |||||
orf144a     NTFNRIWRVNSQRPWMMQFLVYWALLTFGPLSLGVGISFXVGSVQDAALASGAPQWSGAL
                   130       140       150       160       170       180
```

The complete length ORF144a nucleotide sequence (SEQ ID NO: 623) is:

```
   1  ATGACCTTTT TACAACGTTT GCAAGGTTTG GCAGACAATA AAATCTGTGC
  51  GTTTGCATGG TTCGTCGTCC GCCGCTTTGA TGAAGAACGC GTACCGCAGG
 101  CGGCGGCAAG CATGACGTTT ACGACACTGC TGGCACTCGT CCCCGTGCTG
 151  ACCGTGATGG TGGCGGTCGC TTCGATTTTC CCCGTGTTCG ACCGNTGGTC
 201  GGATTCGTTC GTCTCCTTCG TCAACCAAAC CATTGTGCCG CAGGGCGCGG
 251  ACATGGTNTT CGACTATATC AATGCGTTCC GCGAGCAGGC GAACCGGCTG
 301  ACGGCAATCG GCAGCGTGAT GCTGGTCGTT ACCTCGCNGA TGCTGATTCG
 351  GACGATAGAC AATACGTTCA ACCGCATCTG GCGGGTCAAT TCCCAGCGTC
 401  CGTGGATGAT GCAGTTTCTC GTCTATTGGG CTTTACTGAC GTTCGGGCCG
 451  CTGTCTTTGG GCGTGGGCAT TTCCTTTATN GTCGGCTCGG TACAGGATGC
 501  CGCGCTTGCC TCAGGTGCGC CGCAGTGGTC GGGCGCGTTG CGAACGGCGG
 551  CGACGCTGAN CTTCATGACG CTTTTGCTGT GGGGGCTGTA CCGCTNCGTG
 601  CCAAACCGCT TCGTTCCCGC GCGGCANGCG TTTGTCGGGG CTTTGGCAAC
 651  AGCGTTCTGT CTGGAAACCG CGCGTTCCCT CTTTACTTGG TATATGGGCA
 701  ATTTCGACGG CTACCGCTCG ATTTACGGNG CGTTTGCCGC CGTGCCGTTT
 751  TTTCTGTTGT GGCTGAACCT GTTGTGGACG CTGGTCTTGG GCGGCGCGGT
 801  GCTGACTTCT TCACTCTCCT ACTGGCAGGG AGAAGCGTTC CGCAGGGNCT
 851  TCGACTCGCG CGGACGGTTT GACGACGTGT TGAAAATCCT GCTGCTTCTG
 901  GATGCGGCGC AAAAAGAAGG CNAAGCCTTG CCTGTTCAGG AGTTCAGACG
 951  GCATATCAAT ATGGGCTACG ACGAGTTGGG CGAGCTTTTG GAAAAGCTGG
1001  CGCGGCACGG CTACATCTAT TCCGGCAGAC AGGGTTGGGT GTTGAAAACG
1051  GGGGCGGATT CGATTGAGTT GAACGAACTC TTCAAGCTCT TCGTTTACCG
1101  TCCGTTGCCT GTGGAAAGGG ATCATGTGAA CCAAGCTGTC GATGCGGTAA
1151  TGATGCCGTG TTTGCAGACT TTGAACATGA CGCTGGCAGA GTTTGACGCT
1201  CAGGCGAAAA AACAGCAGCA ATCTTGA
```

This encodes a protein having amino acid sequence (SEQ ID NO: 624):

```
  1  MTFLQRLQGL ADNKICAFAW FVVRRFDEER VPQAAASMTF TTLLALVPVL

51  TVMVAVASIF PVFDRWSDSF VSFVNQTIVP QGADMVFDYI NAFREQANRL

101  TAIGSVMLVV TSXMLIRTID NTFNRIWRVN SQRPWMMQFL VYWALLTFGP

151  LSLGVGISFX VGSVQDAALA SGAPQWSGAL RTAATLXFMT LLLWGLYRXV

201  PNRFVPARXA FVGALATAFC LETARSLFTW YMGNFDGYRS IYGAFAAVPF

251  FLLWLNLLWT LVLGGAVLTS SLSYWQGEAF RRXFDSRGRF DDVLKILLLL

301  DAAQKEGXAL PVQEFRRHIN MGYDELGELL EKLARHGYIY SGRQGWVLKT

351  GADSIELNEL FKLFVYRPLP VERDHVNQAV DAVMMPCLQT LNMTLAEFDA

401  QAKKQQQS*
```

ORF144a (SEQ ID NO: 624) and ORF144-1 (SEQ ID NO: 622) show 97.8% identity in 406 aa overlap:

```
orf144a.pep  MTFLQRLQGLADNKICAFAWFVVRRFDEERVPQAAASMTFTTLLALVPVLTVMVAVASIF
             ||||||||||||||||||||||||||||||||||||||||||||||||||||||||||||
orf144-1     MTFLQRLQGLADNKICAFAWFVVRRFDEERVPQAAASMTFTTLLALVPVLTVMVAVASIF orf144a.pep  PVFDRWSDSFVSFVNQTIVPQGADMVFDYINAFREQANRLTAIGSVMLVVTSXMLIRTID
             |||||||||||||||||||||||||||||||||||||||||||||||||||| |||||||
orf144-1     PVFDRWSDSFVSFVNQTIVPQGADMVFDYINAFREQANRLTAIGSVMLVVTSLMLIRTID orf144a.pep  NTFNRIWRVNSQRPWMMQFLVYWALLTFGPLSLGVGISFXVGSVQDAALASGAPQWSGAL
             ||||||||||||||||||||||||||||||||||||||| ||||||||||||||||||||
orf144-1     NTFNRIWRVNSQRPWMMQFLVYWALLTFGPLSLGVGISFMVGSVQDAALASGAPQWSGAL orf144a.pep  RTAATLXFMTLLLWGLYRXVPNRFVPARXAFVGALATAFCLETARSLFTWYMGNFDGYRS
             ||||||:||||||||||| ||||||||| |||||||||||||||||||||||||||||||
orf144-1     RTAATLTFMTLLLWGLYRFVPNRFVPARQAFVGALATAFCLETARSLFTWYMGNFDGYRS orf144a.pep  IYGAFAAVPFFLLWLNLLWTLVLGGAVLTSSLSYWQGEAFRRXFDSRGRFDDVLKILLLL
             |||||||||||||||||||||||||||||||||||||||||| |||||||||||||||||
orf144-1     IYGAFAAVPFFLLWLNLLWTLVLGGAVLTSSLSYWQGEAFRRGFDSRGRFDDVLKILLLL orf144a.pep  DAAQKEGXALPVQEFRRHINMGYDELGELLEKLARHGYIYSGRQGWVLKTGADSIELNEL
             ||||||| ||||||||||||||||||||||||||||||||||||||||||||||||||||
orf144-1     DAAQKEGKALPVQEFRRHINMGYDELGELLEKLARHGYIYSGRQGWVLKTGADSIELNEL orf144a.pep  FKLFVYRPLPVERDHVNQAVDAVMMPCLQTLNMTLAEFDAQAKKQQQS           408
             |||||||||||||||||||||||| |||||||||||||||||||||:|
orf144-1     FKLFVYRPLPVERDHVNQAVDAVMTPCLQTLNMTLAEFDAQAKKRQ             406
```

Homology with a Predicted ORF from *N.gonorrhoeae*

ORF144 (SEQ ID NO: 620) shows 91.2% identity over a 136aa overlap with a predicted ORF (ORF144ng) (SEQ ID NO: 626) from *N.gonorrhoeae*:

```
orf144.pep   MTFLQRLQGLADNKICAFAWFVVRRFDEERVPQXAASMTFTTLLALVPVLTVMVAVASIF   60
             |||||  || |||||||||||||:|||:||||| ||||||||||||||||||||||||||
orf144ng     MTFLQCWQGSADNKICAFAWFVIRRFSEERVPQAAASMTFTTLLALVPVLTVMVAVASIF   60 orf144.pep   PVFDRWSDSFVSFVNQTIVPXGADMVFDYINAFREQANRLTAIGSVMLVVTSLMLIRTID  120
             |||||||||||||||||||| |||||||||:|||:|||||||||||||||||||||||||
orf144ng     PVFDRWSDSFVSFVNQTIVPQGADMVFDYIDAFRDQANRLTAIGSVMLVVTSLMLIRTID  120 orf144.pep   NTFNRIWRVXXQRPWM                                              136
             |:||||||| :|||||
orf144ng     NAFNRIWRVNTQRPWMMQFLVYWALLTFGPLSLGVGISFMVGSVQDSVLSSGAQQWADAL  180
```

The complete length ORF144ng nucleotide sequence (SEQ ID NO: 625) is predicted to encode a protein having amino acid sequence (SEQ ID NO: 626):

```
  1  MTFLQCWQGS ADNKICAFAW FVIRRFSEER VPQAAASMTF TTLLALVPVL
 51  TVMVAVASIF PVFDRWSDSF VSFVNQTIVP QGADMVFDYI DAFREQANRL
101  TAIGSVMLVV TSLMLIRTID NAFNRIWRVN TQRPWMMQFL VYWALLTFGP
151  LSLGVGISFM VGSVQDSVLS SGAQQWADAL KTAARLAFMT LLLWGLYRFV
201  PNRFVPARQA FVGALITAFC LETARFLFTW YMGNFDGYRS IYGAFAAVPF
251  FLLWLNLLWT LVLGGAVLTS SLSYWQGEAF RRGFDSRGRF DDVLKILLLL
301  DAAQKEGRTL SVQEFRRHIN MGYDELGELL EKLARYGYIY SGRQGWVLKT
351  GADSIELSEL FKLFVYRPLP VERDHVNQAV DAVMTPCLQT LNMTLAEFDA
401  QAKKQQQS*
```

Further work revealed the following gonococcal DNA sequence (SEQ ID NO: 627):

```
   1  ATGACCTTTT TACAACGTTG GCAAGGTTTG GCGGACAATA AAATCTGTGC
  51  ATTTGCATGG TTCGTCATCC GCCGTTTCAG TGAAGAGCGC GTACCGCAGG
 101  CAGCGGCGAG CATGACGTTT ACGACACTGC TGGCACTCGT CCCCGTACTG
 151  ACCGTAATGG TCGCGGTCGC TTCGATTTTC CCCGTGTTCG ACCGCTGGTC
 201  GGATTCGTTC GTCTCCTTCG TCAACCAAAC CATTGTGCCG CAGGGCGCGG
 251  ATATGGTGTT CGACTATATC GACGCATTCC GCGATCAGGC AAACCGGCTG
 301  ACCGCCATCG GCAGCGTGAT GCTGGTCGTA ACCTCGCTGA TGCTGATTCG
 351  GACGATAGAC AATGCGTTCA ACCGCATCTG GCGGGTTAAC ACGCAACGCC
 401  CCTGGATGAT GCAGTTCCTC GTTTATTGGG CGTTGCTGAC TTTCGGGCCT
 451  TTGTCTTTGG GTGTGGGCAT TTCCTTTATG GTCGGGTCGG TTCAAGACTC
 501  CGTACTCTCC TCCGGAGCGC AACAATGGGC GGACGCGTTG AAGACGGCGG
 551  CAAGGCTGGC TTTCATGACG CTTTTGCTGT GGGGGCTGTA CCGCTTCGTG
 601  CCCAACCGCT TCGTGCCCGC CCGGCAGGCG TTTGTCGGAG CTTTGATTAC
 651  GGCATTCTGC CTGGAGACGG CACGTTTCCT GTTCACCTGG TATATGGGCA
 701  ATTTCGACGG CTACCGCTCG ATTTACGGCG CATTTGCCGC CGTGCCGTTT
 751  TTCCTGCTGT GGTTAAACCT GCTGTGGACG CTGGTCTTGG GCGGGGCGGT
 801  GCTGACTTCG TCGCTGTCTT ATTGGCAGGG CGAGGCCTTC CGCAGGGGAT
 851  TCGACTCGCG CGGACGGTTT GACGACGTGT TGAAAATCCT GCTGCTTCTG
 901  GATGCGGCGC AAAAAGAAGG CCGAACCCTG TCCGTTCAGG AGTTCAGACG
 951  GCATATCAAT ATGGGTTACG ATGAATTGGG CGAGCTTTTG GAAAAGCTGG
1001  CGCGGTACGG CTATATCTAT TCCGGCAGAC AGGGCTGGGT TTTGAAAACG
1051  GGGGCGGATT CGATTGAGTT GAGCGAACTC TTCAAGCTCT TCGTGTACCG
1101  CCCGTTGCct gtggaAAGGG ATCATGTGAA CCAAGCTGtc gaTGCGGTAA
1151  TGAcgccgtG TTTGCAGACT TTGAACATGA CGCTGGCGGA GTTTGACGCT
1201  CAGgcgAAAA AACAGCAGCA GTCTTGA
```

This encodes a variant of ORF144ng, having the amino acid sequence (SEQ ID NO: 628; ORF144ng-1):

```
  1   MTFLQRWQGL ADNKICAFAW FVIRRFSEER VPQAAASMTF TTLLALVPVL

51   TVMVAVASIF PVFDRWSDSF VSFVNQTIVP QGADMVFDYI DAFREQANRL

101   TAIGSVMLVV TSLMLIRTID NAFNRIWRVN TQRPWMMQFL VYWALLTFGP

151   LSLGVGISFM VGSVQDSVLS SGAQQWADAL KTAARLAFMT LLLWGLYRFV

201   PNRFVPARQA FVGALITAFC LETARFLFTW YMGNFDGYRS IYGAFAAVPF

251   FLLWLNLLWT LVLGGAVLTS SLSYWQGEAF RRGFDSRGRF DDVLKILLLL

301   DAAQKEGRTL SVQEFRRHIN MGYDELGELL EKLARYGYIY SGRQGWVLKT

351   GADSIELSEL FKLFVYRPLP VERDHVNQAV DAVMTPCLQT LNMTLAEFDA

401   QAKKQQQS*
```

ORF144ng-1 (SEQ ID NO: 628) and ORF144-1 (SEQ ID NO: 622) show 94.1% identity in 406 aa overlap:

```
orf144ng-1.pep  MTFLQRWQGLADNKICAFAWFVIRRFSEERVPQAAASMTFTTLLALVPVLTVMVAVASIF
                ||||||  ||||||||||||||:|||:|||||||||||||||||||||||||||||||||
orf144-1        MTFLQRLQGLADNKICAFAWFVVRRFDEERVPQAAASMTFTTLLALVPVLTVMVAVASIF orf144ng-1.pep  PVFDRWSDSFVSFVNQTIVPQGADMVFDYIDAFRDQANRLTAIGSVMLVVTSLMLIRTID
                ||||||||||||||||||||||||||||||:|||:|||||||||||||||||||||||||
orf144-1        PVFDRWSDSFVSFVNQTIVPQGADMVFDYINAFREQANRLTAIGSVMLVVTSLMLIRTID orf144ng-1.pep  NAFNRIWRVNTQRPWMMQFLVYWALLTFGPLSLGVGISFMVGSVQDSVLSSGAQQWADAL
                |:||||||||:|||||||||||||||||||||||||||||||||||||::|:||| ||:||
orf144-1        NTFNRIWRVNSQRPWMMQFLVYWALLTFGPLSLGVGISFMVGSVQDAALASGAPQWSGAL orf144ng-1.pep  KTAARLAFMTLLLWGLYRFVPNRFVPARQAFVGALITAFCLETARFLFTWYMGNFDGYRS
                :|||  |:||||||||||||||||||||||||||||| ||||||||:|||||||||||||
orf144-1        RTAATLTFMTLLLWGLYRFVPNRFVPARQAFVGALATAFCLETARSLFTWYMGNFDGYRS orf144ng-1.pep  IYGAFAAVPFFLLWLNLLWTLVLGGAVLTSSLSYWQGEAFRRGFDSRGRFDDVLKILLLL
                ||||||||||||||||||||||||||||||||||||||||||||||||||||||||||||
orf144-1        IYGAFAAVPFFLLWLNLLWTLVLGGAVLTSSLSYWQGEAFRRGFDSRGRFDDVLKILLLL orf144ng-1.pep  DAAQKEGRTLSVQEFRRHINMGYDELGELLEKLARYGYIYSGRQGWVLKTGADSIELSEL
                ||||||::| |||||||||||||||||||||:|||||||||||||||||||||||||:||
orf144-1        DAAQKEGKALPVQEFRRHINMGYDELGELLEKLARHGYIYSGRQGWVLKTGADSIELNEL orf144ng-1.pep  FKLFVYRPLPVERDHVNQAVDAVMTPCLQTLNMTLAEFDAQAKKQQQS
                |||||||||||||||||||||||||||||||||||||||||||||:|
orf144-1        FKLFVYRPLPVERDHVNQAVDAVMTPCLQTLNMTLAEFDAQAKKRQ
```

On this basis of this analysis, including the identification of several putative transmembrane domains in the gonococcal protein, it is predicted that the proteins from *N.meningitidis* and *N.gonorrhoeae*, and their epitopes, could be useful antigens for vaccines or diagnostics, or for raising antibodies.

Example 75

The following partial DNA sequence was identified in *N.meningitidis* (SEQ ID NO: 629):

```
  1  ..AGACACGCCC GCCGCATCCG CATCGACACC GCCATCAACC CCGAACTGGA
 51    AGCCCTCGCC GAACACCTCC ACTACCAATG GCAGGGCTTC CTCTGGCTCA
101    GCACCGATAT GCGTCAGGAA ATTTCCGCCC TCGTCATCCT GCTGCAACGC
151    ACCCGCCGCA AATGGCTGGA TGCCCACGAA CGCCAACACC TGCGCCAAAG
201    CCTGCTTGAA ACACGGGAAC ACGGCTGA
```

This corresponds to the amino acid sequence (SEQ ID NO: 630; ORF146):

```
  1  ..RHARRIRIDT AINPELEALA EHLHYQWQGF LWLSTDMRQE ISALVILLQR

51    TRRKWLDAHE RQHLRQSLLE TREHG*
```

Further work revealed the complete nucleotide sequence (SEQ ID NO: 631):

```
    1   ATGAACACCT CGCAACGCAA CCGCCTCGTC AGCCGCTGGC TCAACTCCTA

51   CGAACGCTAC CGCTACCGCC GCCTCATCCA CGCCGTCCGG CTCGGCGGGG

101   CCGTCCTGTT CGCCACCGCC TCCGCCCGGC TGCTCCACCT CCAACACGGC

151   GAGTGGATAG GGATGACCGT CTTCGTCGTC CTCGGCATGC TCCAGTTTCA

201   AGGGGCGATT TACTCCAAGG CGGTGGAACG TATGCTCGGC ACGGTCATCG

251   GGCTGGGCGC GGGTTTGGGC GTTTTATGGC TGAACCAGCA TTATTTCCAC

301   GGCAACCTCC TCTTCTACCT CACCGTCGGC ACGGCAAGCG CACTGGCCGG

351   CTGGGCGGCG GTCGGCAAAA ACGGCTACGT CCCTATGCTG GCAGGGCTGA

401   CGATGTGTAT GCTCATCGGC GACAACGGCA GCGAATGGCT CGACAGCGGA

451   CTCATGCGCG CCATGAACGT CCTCATCGGC GCGGCCATCG CCATCGCCGC

501   CGCCAAACTG CTGCCGCTGA AATCCACACT GATGTGGCGT TTCATGCTTG

551   CCGACAACCT GGCCGACTGC AGCAAAATGA TTGCCGAAAT CAGCAACGGC

601   AGGCGCATGA CCCGCGAACG CCTCGAGGAG AACATGGCGA AAATGCGCCA

651   AATCAACGCA CGCATGGTCA AAAGCCGCAG CCATCTCGCC GCCACATCGG

701   GCGAAAGCCG CATCAGCCCC GCCATGATGG AAGCCATGCA GCACGCCCAC

751   CGTAAAATCG TCAACACCAC CGAGCTGCTC CTGACCACCG CCGCCAAGCT

801   GCAATCTCCC AAACTCAACG GCAGCGAAAT CCGGCTGCTT GACCGCCACT

851   TCACACTGCT CCAAACCGAC CTGCAACAAA CCGTCGCCCT TATCAACGGC

901   AGACACGCCC GCCGCATCCG CATCGACACC GCCATCAACC CCGAACTGGA

951   AGCCCTCGCC GAACACCTCC ACTACCAATG GCAGGGCTTC CTCTGGCTCA

1001   GCACCAATAT GCGTCAGGAA ATTTCCGCCC TCGTCATCCT GCTGCAACGC

1051   ACCCGCCGCA AATGGCTGGA TGCCCACGAA CGCCAACACC TGCGCCAAAG

1101   CCTGCTTGAA ACACGGGAAC ACGGCTGA
```

This corresponds to the amino acid sequence (SEQ ID NO: 632; ORF146-1):

```
  1   MNTSQRNRLV SRWLNSYERY RYRRLIHAVR LGGAVLFATA SARLLHLQHG

51   EWIGMTVFVV LGMLQFQGAI YSKAVERMLG TVIGLGAGLG VLWLNQHYFH

101   GNLLFYLTVG TASALAGWAA VGKNGYVPML AGLTMCMLIG DNGSEWLDSG

151   LMRAMNVLIG AAIAIAAAKL LPLKSTLMWR FMLADNLADC SKMIAEISNG

201   RRMTRERLEE NMAKMRQINA RMVKSRSHLA ATSGESRISP AMMEAMQHAH

251   RKIVNTTELL LTTAAKLQSP KLNGSEIRLL DRHFTLLQTD LQQTVALING

301   RHARRIRIDT AINPELEALA EHLHYQWQGF LWLSTNMRQE ISALVILLQR

351   TRRKWLDAHE RQHLRQSLLE TREHG*
```

Computer analysis of this amino acid sequence gave the following results:

Homology with a Predicted ORF from *N.meningitidis* (Strain A)

ORF146 (SEQ ID NO: 630) shows 98.6% identity over a 74aa overlap with an ORF (ORF146a) (SEQ ID NO: 634) from strain A of *N. meningitidis*:

```
                                          10        20        30
orf146.pep                       RHARRIRIDTAINPELEALAEHLHYQWQGF
                                 |||||||||||||||||||||||||||||
orf146a     KLNGSEIRLLDRHFTLLQTDLQQTVALINGRHARRIRIDTAINPELEALAEHLHYQWQGF
                   280       290       300       310       320       330

40        50        60        70
orf146.pep  LWLSTDMRQEISALVILLQRTRRKWLDAHERQHLRQSLLETREHGX
            |||||:|||||||||||||||||||||||||||||||||||||||:
orf146a     LWLSTNMRQEISALVILLQRTRRKWLDAHERQHLRQSLLETREHSX
                  340       350       360       370
```

The complete length ORF I46a nucleotide sequence (SEQ ID NO: 633) is:

```
   1  ATGAACACCT CGCAACGCAA CCGCCTCGTC AGCCGCTGGC TCAACTCCTA
  51  CGAACGCTAC CGCTACCGCC GCCTCATCCA CGCCGTCCGG CTCGGCGGGG
 101  CCGTCCTGTT CGCCACCGCC TCCGCCCGGC TGCTCCACCT CCAACACGGC
 151  GAGTGGATAG GGATGACCGT CTTCGTCGTC CTCGGCATGC TCCAGTTTCA
 201  AGGGGCGATT TACTCCAAGG CGGTGGAACG TATGCTCGGC ACGGTCATCG
 251  GGCTGGGCGC GGGTTTGGGC GTTTTATGGC TGAACCAGCA TTATTTCCAC
 301  GGCAACCTCC TCTTCTACCT CACCGTCGGC ACGGCAAGCG CACTGGCCGG
 351  CTGGGCGGCG GTCGGCAAAA ACGGCTACGT CCCTATGCTG GCGGGGCTGA
 401  CGATGTGCAT GCTCATCGGC GACAACGGCA GCGAATGGTT CGACAGCGGC
 451  CTGATGCGCG CGATGAACGT CCTCATCGGC GCGGCCATCG CCATCGCCGC
 501  CGCCAAACTG CTGCCGCTGA AATCCACACT GATGTGGCGT TTCATGCTTG
 551  CCGACAACCT GACCGACTGC AGCAAAATGA TTGCCGAAAT CAGCAACGGC
 601  AGGCGCATGA CCCGCGAACG CCTCGAAGAG AACATGGCGA AAATGCGCCA
 651  AATCAACGCA CGCATGGTCA AAAGCCGCAG CCACCTCGCC GCCACATCGG
 701  GCGAAAGCCG CATCAGCCCC GCCATGATGG AAGCCATGCA GCACGCCCAC
 751  CGTAAAATTG TCAACACCAC CGAGCTGCTC CTGACCACCG CCGCCAAGCT
 801  GCAATCTCCC AAACTCAACG GCAGCGAAAT CCGGCTGCTT GACCGCCACT
 851  TCACACTGCT CCAAACCGAC CTGCAACAAA CCGTCGCCCT TATCAACGGC
 901  AGACACGCCC GCCGCATCCG CATCGACACC GCCATCAACC CCGAACTGGA
 951  AGCCCTCGCC GAACACCTCC ACTACCAATG GCAGGGCTTC CTCTGGCTCA
1001  GCACCAATAT GCGTCAGGAA ATTTCCGCCC TCGTCATCCT GCTGCAACGC
1051  ACCCGCCGCA AATGGCTGGA TGCCCACGAA CGCCAACACC TGCGCCAAAG
1101  CCTGCTTGAA ACACGGGAAC ACAGTTGA
```

This encodes a protein having amino acid sequence (SEQ ID NO: 634):

```
  1  MNTSQRNRLV SRWLNSYERY RYRRLIHAVR LGGAVLFATA SARLLHLQHG
 51  EWIGMTVFVV LGMLQFQGAI YSKAVERMLG TVIGLGAGLG VLWLNQHYFH
```

-continued
```
101 GNLLFYLTVG TASALAGWAA VGKNGYVPML AGLTMCMLIG DNGSEWFDSG

151 LMRAMNVLIG AAIAIAAAKL LPLKSTLMWR FMLADNLTDC SKMIAEISNG

201 RRMTRERLEE NMAKMRQINA RMVKSRSHLA ATSGESRISP AMMEAMQHAH

251 RKIVNTTELL LTTAAKLQSP KLNGSEIRLL DRHFTLLQTD LQQTVALING

301 RHARRIRIDT AINPELEALA EHLHYQWQGF LWLSTNMRQE ISALVILLQR

351 TRRKWLDAHE RQHLRQSLLE TREHS*
```

ORF146a (SEQ ID NO: 634) and ORF146-1 (SEQ ID NO: 632) show 99.5% identity in 374 aa overlap:

```
orf146a.pep    MNTSQRNRLVSRWLNSYERYRYRRLIHAVRLGGAVLFATASARLLHLQHGEWIGMTVFVV
               ||||||||||||||||||||||||||||||||||||||||||||||||||||||||||||
orf146-1       MNTSQRNRLVSRWLNSYERYRYRRLIHAVRLGGAVLFATASARLLHLQHGEWIGMTVFVV orf146a.pep    LGMLQFQGAIYSKAVERMLGTVIGLGAGLGVLWLNQHYFHGNLLFYLTVGTASALAGWAA
               ||||||||||||||||||||||||||||||||||||||||||||||||||||||||||||
orf146-1       LGMLQFQGAIYSKAVERMLGTVIGLGAGLGVLWLNQHYFHGNLLFYLTVGTASALAGWAA orf146a.pep    VGKNGYVPMLAGLTMCMLIGDNGSEWFDSGLMRAMNVLIGAAIAIAAAKLLPLKSTLMWR
               |||||||||||||||||||||||||||||:||||||||||||||||||||||||||||||
orf146-1       VGKNGYVPMLAGLTMCMLIGDNGSEWLDSGLMRAMNVLIGAAIAIAAAKLLPLKSTLMWR orf146a.pep    FMLADNLTDCSKMIAEISNGRRMTRERLEENMAKMRQINARMVKSRSHLAATSGESRISP
               |||||| :|||||||||||||||||||||||||||||||||||||||||||||||||||
orf146-1       FMLADNLADCSKMIAEISNGRRMTRERLEENMAKMRQINARMVKSRSHLAATSGESRISP orf146a.pep    AMMEAMQHAHRKIVNTTELLLTTAAKLQSPKLNGSEIRLLDRHFTLLQTDLQQTVALING
               ||||||||||||||||||||||||||||||||||||||||||||||||||||||||||||
orf146-1       AMMEAMQHAHRKIVNTTELLLTTAAKLQSPKLNGSEIRLLDRHFTLLQTDLQQTVALING orf146a.pep    RHARRIRIDTAINPELEALAEHLHYQWQGFLWLSTNMRQEISALVILLQRTRRKWLDAHE
               ||||||||||||||||||||||||||||||||||||||||||||||||||||||||||||
orf146-1       RHARRIRIDTAINPELEALAEHLHYQWQGFLWLSTNMRQEISALVILLQRTRRKWLDAHE orf146a.pep    RQHLRQSLLETREHSX
               |||||||||||||||:
orf146-1       RQHLRQSLLETREHGX
```

Homology with a Predicted ORF from *N.gonorrhoeae*

ORF146 (SEQ ID NO: 630) shows 97.3% identity over a 75aa overlap with a predicted ORF (ORF146ng) (SEQ ID NO: 636) from *N.gonorrhoeae*:

```
orf146.pep                         RHARRIRIDTAINPELEALAEHLHYQWQGF    30
                                   |||||||||||||||||||||||||||||||
orf146ng    KLNGSEIRLLDRHFTLLQTDLQQTAALINGRHARRIRIDTAINPELEALAEHLHYQWQGF   364 orf146.pep  LWLSTDMRQEISALVILLQRTRRKWLDAHERQHLRQSLLETREHG   75
            |||||:||||||||||||||||||||||||||||||||||||||||
orf146ng    LWLSTNMRQEISALVIPLQRTRRKWLDAHERQHLRQSLLETREHG   409
```

An ORF146ng nucleotide sequence (SEQ ID NO: 635) was predicted to encode a protein having amino acid sequence (SEQ ID NO: 636):

```
  1 MSGVRFPSPA PIPSTDPPSG SLCFFTFPLQ TASDMNSSQR KRLSGRWLNS

51 YERYRHRRLI HAVRLGGTVL FATALARLLH LQHGEWIGMT VFVVLGMLQF

101 QGAIYSNAVE RMLGTVIGLG AGLGVLWLNQ HYFHGNLLFY LTIGTASALA

151 GWAAVGKNGY VPMLAGLTMC MLIGDNGSEW LDSGLMRAMN VLIGAAIAIA
```

-continued

```
201 AAKLLPLKST LMWRFMLADN LADCSKMIAE ISNGRRMTRE RLEQNMVKMR

251 QINARMVKSR SHLAATSGES RISPSMMEAM QHAHRKIVNT TELLLTTAAK

301 LQSPKLNGSE IRLLDRHFTL LQTDLQQTAA LINGRHARRI RIDTAINPEL

351 EALAEHLHYQ WQGFLWLSTN MRQEISALVI PLQRTRRKWL DAHERQHLRQ

401 SLLETREHG*
```

Further work revealed the following gonococcal DNA sequence (SEQ ID NO: 637):

```
   1 ATGAACTCCT CGCAACGCAA ACGCCTTTCC GgccGCTGGC TCAACTCCTA

51 CGAACGCTac cGCCaccGCC GCCTCATACA TGCCGTGCGG CTCGGCggaa 101 ccgtCCTGTT CGCCACCGCA CTCGCCCGgc tACTCCACCT CCAacacggc 151 gAATGGATAG GGAtgaCCGT CTTCGTCGTC CTCGGCATGC TCCAGTTCCA 201 AGGCgcgatt tActccaacg cggtgGAacg taTGctcggt acggtcatcg 251 ggctgGGCGC GGGTTTGGgc gTTTTATGGC TGAACCAGCA TTAtttccac 301 ggcaacCTcc tcttctacct gaccatcggc acggcaagcg cactggccgg 351 ctGGGCGGCG GTCGGCAAAA acggctacgt ccctatgctg GCGGGGctgA 401 CGATGTGCAT gctcatcggc gACAACGGCA GCGAATGGCT CGACAGCGGC

451 CTGATGCGCG CGATGAACGT CCTCATCGGC GCCGCCATCG CCATTGCCGC

501 CGCCAAACTG CTGCCGCTGA AATCCACACT GATGTGGCGT TTCATGCTTG

551 CCGACAACCT GGCCGACTGC AGCAAAATGA TTGCCGAAAT CAGCAACGGC

601 AGGCGTATGA CGCGCGAACG TTTGGAGCAG AATATGGTCA AAATGCGCCA

651 AATCAACGCA CGCATGGTCA AAAGCCGCAG CCACCTCGCC GCCACATCGG

701 GCGAAAGCCG CATCAGCCCC TCCATGATGG AAGCCATGCA GCACGCCCAC

751 CGCAAAATCG TCAACACCAC CGAGCTGCTC CTGACCACCG CCGCCAAGCT

801 GCAATCTCCC AAACTCAACG GCAGCGAAAT CCGGCTGCTC GACCGCCACT

851 TCACACTGCT CCAAACCGAC CTGCAACAAA CCGCCGCCCT CATCAACGGC

901 AGACACGCCC GCCGCATCCG CATCGACACC GCCATCAACC CCGAACTGGA

951 AGCCCTCGCC GAACACCTCC ACTACCAATG GCAGGGCTTC CTCTGGCTCA

1001 GCACCAATAT GCGTCAGGAA ATTTCCGCCC TCGTCATCCT GCTGCAACGC

1051 ACCCGCCGCA AATGGCTGGA TGCCCACGAA CGCCAACACC TGCGCCAAAG

1101 CCTGCTTGAA ACACGGGAAC ACGGCTGA
```

This corresponds to the amino acid sequence (SEQ ID NO: 638; ORF146ng-1):

```
  1 MNSSQRKRLS GRWLNSYERY RHRRLIHAVR LGGTVLFATA LARLLHLQHG

51 EWIGMTVFVV LGMLQFQGAI YSNAVERMLG TVIGLGAGLG VLWLNQHYFH

101 GNLLFYLTIG TASALAGWAA VGKNGYVPML AGLTMCMLIG DNGSEWLDSG

151 LMRAMNVLIG AAIAIAAAKL LPLKSTLMWR FMLADNLADC SKMIAEISNG

201 RRMTRERLEQ NMVKMRQINA RMVKSRSHLA ATSGESRISP SMMEAMQHAH

251 RKIVNTTELL LTTAAKLQSP KLNGSEIRLL DRHFTLLQTD LQQTAALING
```

```
301  RHARRIRIDT AINPELEALA EHLHYQWQGF LWLSTNMRQE ISALVILLQR

351  TRRKWLDAHE RQHLRQSLLE TREHG*
```

ORF146ng-1 (SEQ ID NO: 638) and ORF146-1 (SEQ ID NO: 632) show 96.5% identity in 375 aa overlap

```
orf146-1.pep  MNTSQRNRLVSRWLNSYERYRYRRLIHAVRLGGAVLFATASARLLHLQHGEWIGMTVFVV
              ||:|||:||  :|||||||||||:|||||||||:||||||  ||||||||||||||||||
orf146ng-1    MNSSQRKRLSGRWLNSYERYRHRRLIHAVRLGGTVLFATALARLLHLQHGEWIGMTVFVV orf146-1.pep  LGMLQFQGAIYSKAVERMLGTVIGLGAGLGVLWLNQHYFHGNLLFYLTVGTASALAGWAA
              |||||||||||| :|||||||||||||||||||||||||||||||||||:||||||||||
orf146ng-1    LGMLQFQGAIYSNAVERMLGTVIGLGAGLGVLWLNQHYFHGNLLFYLTIGTASALAGWAA orf146-1.pep  VGKNGYVPMLAGLTMCMLIGDNGSEWLDSGLMRAMNVLIGAAIAIAAAKLLPLKSTLMWR
              ||||||||||||||||||||||||||||||||||||||||||||||||||||||||||||
orf146ng-1    VGKNGYVPMLAGLTMCMLIGDNGSEWLDSGLMRAMNVLIGAAIAIAAAKLLPLKSTLMWR orf146-1.pep  FMLADNLADCSKMIAEISNGRRMTRERLEENMAKMRQINARMVKSRSHLAATSGESRISP
              ||||||||||||||||||||||||||||||:||:|||||||||||||||||||||||||
orf146ng-1    FMLADNLADCSKMIAEISNGRRMTRERLEQNMVKMRQINARMVKSRSHLAATSGESRISP orf146-1.pep  AMMEAMQHAHRKIVNTTELLLTTAAKLQSPKLNGSEIRLLDRHFTLLQTDLQQTVALING
              :||||||||||||||||||||||||||||||||||||||||||||||||||||||:|||||
orf146ng-1    SNNEAMQHAHRKIVNTTELLLTTAAKLQSPKLNGSEIRLLDRHFTLLQTDLQQTAALING orf146-1.pep  RHARRIRIDTAINPELEALAEHLHYQWQGFLWLSTNMRQEISALVILLQRTRRKWLDAHE
              ||||||||||||||||||||||||||||||||||||||||||||||||||||||||||||
orf146ng-1    RHARRIRIDTAINPELEALAEHLHYQWQGFLWLSTNMRQEISALVILLQRTRRKWLDAHE orf146-1.pep  RQHLRQSLLETREHGX
              ||||||||||||||||
orf146ng-1    RQHLRQSLLETREHGX
```

Furthermore, ORF146ng-1 (SEQ ID NO: 638) shows homology with a hypothetical *E.coli* protein (SEQ ID NO: 1150):

```
sp|P33011|YEEA_ECOLI HYPOTHETICAL 40.0 KD PROTEIN IN COBU-SBMC INTERGENIC
REGION
)gi|1736674|gnl|PID|d1016553 (D90838) ORF_ID:o348#20; similar to [SwissProt
Accession Number P33011] [Escherichia coli] )gi|1736682|gnl|PID|d1016560
(D90839)
ORF_ID:o348#20; similar to [SwissProt Accession Number P33011] [Escherichia
coli]
)gi|1788318 (AE000292) f352; 100% identical to fragment YEEA_ECOLI SW: P33011
but
has 203 additional C-terminal residues [Escherichia coli] Length = 352
Score = 109 bits (271), Expect = 2e-23
Identities = 89/347 (25%), Positives = 150/347 (42%), Gaps = 21/347 (6%)

Query:  20 YRHRRLIHAVRLGGTVLFATALARLLHLQHGEWIGMTVFVVLGMLQFQGAIYSNAVERML   79
           YRH R++H  R+    L  + RL +     W +T+ V++G + F G +   A ER+
Sbjct:  15 YRHYRIVHGTRVALAFLLTFLIIRLFTIPESTWPLVTMVVIMGPISFWGNVVPRAFERIG   74

Query:  80 GTVIGLGAGLGVLWLNQHYFHGNLLFYLTIGTASALAGWAAVGKNGYVPMLAGLTMCMLI  139
           GTV+G   GL  L        L  +   A L GW A+GK  Y  G+T+ +++
Sbjct:  75 GTVLGSILGLIALQLE---LISLPLMLVWCAAAMFLCGWLALGKKPYQGLLIGVTLAIVV  131

Query: 140 GDNGSEWLDSGLMRAMNVLIGXXXXXXXXXLLPLKSTLMWRFMLADNLADCSKMIAEISN  199
           G   E +D+ L R+ +V++G         + P ++ + WR  LA  +L + +++      +
Sbjct: 132 GSPTGE-IDTALWRSGDVILGSLLAMLFTGIWPQRAFIHWRIQLAKSLTEYNRVYQSAFS  190

Query: 200 GRRMTRERLEQNMVKMRQINARMVKSRSHLAATSGESRISPSMMEAMQHAHRKIVNXXXX  259
            + R  RLE ++  K+         VK R  +A  S E+RI  S+  E +Q   +R +V
Sbjct: 191 PNLLERPRLESHLQKLL---TDAVKMRGLIAPASKETRIPKSIYEGIQTINRNLVCMLEL  247

Query: 260 XXXXXXQSPK---LNGSEIRLLDRHFXXXXXXXXXXXAALINGRHARRIRIDTAINPEL  316
                 +      LN  ++R  D                 AL  G          +N  +
Sbjct: 248 QINAYWATRPSHFVLLNAQKLR--DTQHMMQQILLSLVHALYEGNPQPVFANTEKLNDAV  305
```

-continued

```
sp|P33011|YEEA_ECOLI HYPOTHETICAL 40.0 KD PROTEIN IN COBU-SBMC INTERGENIC
REGION
)gi|1736674|gnl|PID|d1016553 (D90838) ORF_ID:o348#20; similar to [SwissProt
Accession Number P33011] [Escherichia coli] )gi|1736682|gnl|PID|d1016560
(D90839)
ORF_ID:o348#20; similar to [SwissProt Accession Number P33011] [Escherichia
coli]
)gi|1788318 (AE000292) f352; 100% identical to fragment YEEA_ECOLI SW: P33011
but
has 203 additional C-terminal residues [Escherichia coli] Length = 352
Score = 109 bits (271), Expect = 2e-23
Identities = 89/347 (25%), Positives = 150/347 (42%), Gaps = 21/347 (6%)

Query: 317 EALAEHL--HYQWQ-------GFLWLSTNMRQEISALVILLQRTRRK            354
           E L + L  H+ +        G++WL+      ++  L  L+ R  RK
Sbjct: 306 EELRQLLNNHHDLKVVETPIYGYVWLNMETAHQLELLSNLICRALRK            352
```

On the basis of this analysis, including the identification of several transmembrane domains in the gonococcal protein, it is predicted that the proteins from *N.meningitidis* and *N.gonorrhoeae*, and their epitopes, could be useful antigens for vaccines or diagnostics, or for raising antibodies.

Example 76

The following partial DNA sequence was identified in *N.meningitidis* (SEQ ID NO: 639)

```
  1 ..GCCGAAGACA CGCGCGTTAC CGCACAGCTT TTGAGCGCGT ACGGCATTCA
 51   GGGCAAACTC GTCAGTGTGC GCGAACACAA CGAACGGCAG ATGGCGGACA
101   AGATTGTCGG CTATCTTTCA GACGGCATGG TTGTGGCACA GGTTTCCGAT
151   GCGGGTACGC CGGCCGTGTG CGACCCGGGC GCGAAACTCG CCCGCCGCGT
201   GCGTGAGGCC GGGTTTAAAG TCGTTCCCGT CGTGGGCGCA AC.GCGGTGA
251   TGGCGGCTTT GAGCGTGGCC GGTGTGGAAG GATCCGATTT TTATTTCAAC
301   GGTTTTGTAC CGCCGAAATC GGGAGAACGC AGGAAACTGT TTGCCAAATG
351   GGTGCGGGCG GCGTTTCCTA TCGTCATGTT TGAAACGCCG CACCGCATCG
401   GTGCAGCGCT TGCCGATATG GCGGAACTGT TCCCCGAACG CCGATTAATG
451   CTGGCGCGCG AAATTACGAA AACGTTTGAA ACGTTCTTAA GCGGCACGGT
501   TGGGGAAATT CAGACGGCAT TGTCTGCCGA CGGCGACCAA TCGCGCGGCG
551   AGATGGTGTT GGTGCTTTAT CCGGCGCAGG ATGAAAAACA CGAAGGCTTG
601   TCCGAGTCCG CGCAAAACAT CATGAAAATC CTCACAGCCG AGCTGCCGAC
651   CAAACAGGCG GCGGAGCTTG CTGCCAAAAT CACGGGCGAG GGAAAGAAAG
701   CTTTGTACGA T..
```

This corresponds to the amino acid sequence (SEQ ID NO: 640; ORF147):

```
  1 ..AEDTRVTAQL LSAYGIQGKL VSVREHNERQ MADKIVGYLS DGMVVAQVSD
 51   AGTPAVCDPG AKLARRVREA GFKVVPVVGA XAVMAALSVA GVEGSDFYFN
101   GFVPPKSGER RKLFAKWVRA AFPIVMFETP HRIGAALADM AELFPERRLM
151   LAREITKTFE TFLSGTVGEI QTALSADGDQ SRGEMVLVLY PAQDEKHEGL
201   SESAQNIMKI LTAELPTKQA AELAAKITGE GKKALYD..
```

Further work revealed the complete nucleotide sequence (SEQ ID NO: 641):

```
  1 ATGTTTCAGA AACATTTGCA GAAAGCCTCC GACAGCGTCG TCGGAGGGAC
 51 ATTATACGTG GTTGCCACGC CCATCGGCAA TTTGGCGGAC ATTACCCTGC
101 GCGCTTTGGC GGTATTGCAA AAGGCGGACA TCATCTGTGC CGAAGACACG
151 CGCGTTACCG CACAGCTTTT GAGCGCGTAC GGCATTCAGG GCAAACTCGT
201 CAGTGTGCGC GAACACAACG AACGGCAGAT GGCGGACAAG ATTGTCGGCT
251 ATCTTTCAGA CGGCATGGTT GTGGCACAGG TTTCCGATGC GGGTACGCCG
301 GCCGTGTGCG ACCCGGGCGC GAAACTCGCC CGCCGCGTGC GTGAGGCCGG
351 GTTTAAAGTC GTTCCCGTCG TGGGCGCAAG CGCGGTGATG GCGGCTTTGA
401 GCGTGGCCGG TGTGGAAGGA TCCGATTTTT ATTTCAACGG TTTTGTACCG
451 CCGAAATCGG GAGAACGCAG GAAACTGTTT GCCAAATGGG TGCGGGCGGC
501 GTTTCCTATC GTCATGTTTG AAACGCCGCA CCGCATCGGT GCGACGCTTG
551 CCGATATGGC GGAACTGTTC CCCGAACGCC GATTAATGCT GGCGCGCGAA
601 ATTACGAAAA CGTTTGAAAC GTTCTTAAGC GGCACGGTTG GGGAAATTCA
651 GACGGCATTG TCTGCCGACG GCAACCAATC GCGCGGCGAG ATGGTGTTGG
701 TGCTTTATCC GGCGCAGGAT GAAAAACACG AAGGCTTGTC CGAGTCCGCG
751 CAAAACATCA TGAAAATCCT CACAGCCGAG CTGCCGACCA AACAGGCGGC
801 GGAGCTTGCT GCCAAAATCA CGGGCGAGGG AAAGAAAGCT TTGTACGATC
851 TGGCTCTGTC TTGGAAAAAC AAATAG
```

This corresponds to the amino acid sequence (SEQ ID NO: 642; ORF147-1):

```
  1 MFQKHLQKAS DSVVGGTLYV VATPIGNLAD ITLRALAVLQ KADIICAEDT
 51 RVTAQLLSAY GIQGKLVSVR EHNERQMADK IVGYLSDGMV VAQVSDAGTP
101 AVCDPGAKLA RRVREAGFKV VPVVGASAVM AALSVAGVEG SDFYFNGFVP
151 PKSGERRKLF AKWVRAAFPI VMFETPHRIG ATLADMAELF PERRLMLARE
201 ITKTFETFLS GTVGEIQTAL SADGNQSRGE MVLVLYPAQD EKHEGLSESA
251 QNIMKILTAE LPTKQAAELA AKITGEGKKA LYDLALSWKN K*
```

Computer analysis of this amino acid sequence gave the following results:
Homology with Hypothetical Protein ORF286 (SEQ ID NO: 1151) of *E.coli* (Accession Number U18997)
ORF147 (SEQ ID NO: 640) and *E.coli* ORF286 protein (SEQ ID NO: 1151) show 36% aa identity in 237aa overlap:

```
Orf147:    1 AEDTRVTAQLLSAYGIQGKLVSVREHNERQMADKIVGYLSDGMVVAQVSDAGTPAVCDPG   60
             AEDTR  T  LL  +GI  +L ++ +HNE+Q A+ ++   L +G  +A VSDAGTP + DPG
Orf286:   43 AEDTRHTGLLLQHFGINARLFALHDHNEQQKAETLLAKLQEGQNIALVSDAGTPLINDPG  102

Orf147:   61 AKLARRVREXXXXXXXXXXXXXXXXXXXXXXXXXXEGSDFYFNGFVPPKSGERRKLFAKWVRA  120
             L R RE                               F + GF+P KS  RR
Orf286:  103 YHLVRTCREAGIRVVPLPGPCAAITALSAAGLPSDRFCYEGFLPAKSKGRRDALKAIEAE  162
```

-continued
```
Orf147:   121 AFPIVMFETPHRIGAALADMAELFPERR-LMLAREITKTFETFLSGTVGEIQTALSADGD  179
              ++ +E+ HR+  D+  +  E R ++LARE+TKT+ET      VGE+    + D +
Orf286:   163 PRTLIFYESTHRLLDSLEDIVAVLGESRYVVLARELTKTWETIHGAPVGELLAWVKEDEN  222

Orf147:   160 QSRGEMVLVLYPAQDEKHEGLSESAQNIMKILTAELPTKQAAELAAKITGEGKKALY    236
              + +GEMVL++       + E L  A   + +L AELP K+AA LAA+I G  K ALY
Orf286:   223 RRKGEMVLIV-EGHKAQEEDLPADALRTLALLQAELPLKKAAALAAEIHGVKKNALY    278
```

Homology with a Predicted ORF from *N.meningitidis* (Strain A)

ORF147 (SEQ ID NO: 640) shows 96.6% identity over a 237aa overlap with ORF75a (SEQ ID NO: 290) from strain A of *N. meningitidis*:

```
                              10        20        30
orf147.pep                    AEDTRVTAQLLSAYGIQGKLVSVREHNERQ
                              ||||||||||||||||||||||||||||||
orf75a      TLYVVATPIGNLADITLRALAVLQKADIICAEDTRVTAQLLSAYGIQGKLVSVREHNERQ
            20        30        40        50        60        70

40        50        60        70        80        90
orf147.pep  MADKIVGYLSDGMVVAQVSDAGTPAVCDPGAKLARRVREAGFKVVPVVGAXAVMAALSVA
            ||||||||||||||||||||||||||||||||||||||||:|||||||||  |||||||
orf75a      MADKIVGYLSDGMVVAQVSDAGTPAVCDPGAKLARRVREVGFKVVPVVGASAVMAALSVA
            80        90       100       110       120       130

100       110       120       130       140       150
orf147.pep  GVEGSDFYFNGFVPPKSGERRKLFAKWVRAAFPIVMFETPHRIGAALADMAELFPERRLM
            || |||||||||||||||||||||||||||:|||:||||||||||:||||||||||||||
orf75a      GVAGSDFYFNGFVPPKSGERRKLFAKWVRVAFPVVMFETPHRIGATLADMAELFPERRLM
            140       150       160       170       180       190

160       170       180       190       200       210
orf147.pep  LAREITKTFETFLSGTVGEIQTALSADGDQSRGEMVLVLYPAQDEKHEGLSESAQNIMKI
            |||||||||||||||||||||||||:|||:||||||||||||||||||||||||||||||
orf75a      LAREITKTFETFLSGTVGEIQTALAADGNQSRGEMVLVLYPAQDEKHEGLSESAQNIMKI
            200       210       220       230       240       250

220       230
orf147.pep  LTAELPTKQAAELAAKITGEGKKALYD
            |||||||||||||||||||||||||||
orf75a      LTAELPTKQAAELAAKITGEGKKALYDLALSWKNKX
            260       270       280       290
```

ORF147a is identical to ORF75a (SEQ ID NO: 290), which includes aa 56–292 of ORF75 (SEQ ID NO: 286). Homology with a Predicted ORF from *N.gonorrhoeae*

ORF147 (SEQ ID NO: 640) shows 94.1% identity over a 237aa overlap with a predicted ORF (ORF147ng) (SEQ ID NO: 644) from *N. gonorrhoeae*:

```
orf147.pep                    AEDTRVTAQLLSAYGIQGKLVSVREHNERQ   30
                              ||||||||||||||||||||:|||||||||
orf147ng    TLYVVATPIGNLADITLRALAVLQKADIICAEDTRVTAQLLSAYGIQGRLVSVREHNERQ   85 orf147.pep  MADKIVGYLSDGMVVAQVSDAGTPAVCDPGAKLARRVREAGFKVVPVVGAXAVMAALSVA   90
            ||||::|:||||:||||||||||||||||||||||||||||||||||||||  |||||||
orf147ng    MADKVIGFLSDGLVVAQVSDAGTPAVCDPGAKLARRVREAGFKVVPVVGASAVMAALSVA  145 orf147.pep  GVEGSDFYFNGFVPPKSGERRKLFAKWVRAAFPIVMFETPHRIGAALADMAELFPERRLM  150
            || ||||||||||||||||||||||||||:|||:|||||||||||:||||||||||||||
orf147ng    GVAESDFYFNGFVPPKSGERRKLFAKWVRAAFPVVMFETPHRIGATLADMAELFPERRLM  205 orf147.pep  LAREITKTFETFLSGTVGEIQTALSADGDQSRGEMVLVLYPAQDEKHEGLSESAQNIMKI  210
            |||||||||||||||||||||||:|||:|||||||||||||||||||||||||||:|||
orf147ng    LAREITKTFETFLSGTVGEIQTALAADGNQSRGEMVLVLYPAQDEKHEGLSESAQNAMKI  265 orf147.pep  LTAELPTKQAAELAAKITGEGKKALYD                                  237
            |:|||||||||||||||||||||||||
orf147ng    LAAELPTKQAAELAAKITGEGKKALYDLALSWKNK                          300
```

An ORF147ng nucleotide sequence (SEQ ID NO: 643) was predicted to encode a protein having amino acid sequence (SEQ ID NO: 644):

```
  1 MSVFQTAFFM FQKHLQKASD SVVGGTLYVV ATPIGNLADI TLRALAVLQK
 51 ADIICAEDTR VTAQLLSAYG IQGRLVSVRE HNERQMADKV IGFLSDGLVV
101 AQVSDAGTPA VCDPGAKLAR RVREAGFKVV PVVGASAVMA ALSVAGVAES
151 DFYFNGFVPP KSGERRKLFA KWVRAAFPVV MFETPHRIGA TLADMAELFP
201 ERRLMLAREI TKTFETFLSG TVGEIQTALA ADGNQSRGEM VLVLYPAQDE
251 KHEGLSESAQ NAMKILAAEL PTKQAAELAA KITGEGKKAL YDLALSWKNK
301 *
```

Further work revealed the following gonococcal DNA sequence (SEQ ID NO: 645):

```
  1 ATGTTTCAGA AACACTTGCA GAAAGCCTCC GACAGCGTCG TCGGAGGGAC
 51 ATTATACGTG GTTGCCACGC CCATCGGCAA TTTGGCAGAC ATTACCCTGC
101 GCGCTTTGGC GGTATTGCAA AAGGCGGACA TCATTTGTGC CGAAGACACG
151 CGCGTTACTG CGCAGCTTTT GAGCGCGTAC GGCATTCAGG GCAGGTTGGT
201 CAGTGTGCGC GAACACAACG AGCGGCAGAT GGCGGACAAG GTAATCGGTT
251 TCCTTTCAGA CGGCCTGGTT GTGGCGCAGG TTTCCGATGC GGGTACGCCG
301 GCCGTGTGCG ACCCGGGCGC GAAACTCGCC CGCCGCGTGC GCGAAGCAGG
351 GTTCAAAGTC GTTCCCGTCG TGGGCGCAAG CGCGGTAATG GCGGCGTGGA
401 GTGTGGCCGG TGTGGCGGAA TCCGATTTTT ATTTCAACGG TTTTGTACCG
451 CCGAAATCGG GCGAACGTAG GAAATTGTTT GCCAAATGGG TGCGGGCGGC
501 ATTTCCTGTC GTCATGTTTG AAACGCCGCA CCGAATCGGG GCAACGCTTG
551 CCGATATGGC GGAATTGTTC CCCGAACGCC GTCTGATGCT GGCGCGCGAA
601 ATCACGAAAA CGTTTGAAAC GTTCTTAAGC GGCACGGTTG GGGAAATTCA
651 GACGGCATTG GCGGCGGACG GCAACCAATC GCGCGGCGAG ATGGTGTTGG
701 TGCTTTATCC GGCGCAGGAT GAAAAACACG AAGGCTTGTC CGAGTCTGCG
751 CAAAATGCGA TGAAAATCCT TGCGGCCGAG CTGCCGACCA AGCAGGCGGC
801 GGAGCTTGCC GCCAAGATTA CAGGTGAGGG CAAAAAGGCT TTGTACGATT
851 TGGCACTGTC GTGGAAAAAC AAATGA
```

This corresponds to the amino acid sequence (SEQ ID NO: 646; ORF147ng-1):

```
  1 MFQKHLQKAS DSVVGGTLYV VATPIGNLAD ITLRALAVLQ KADIICAEDT
 51 RVTAQLLSAY GIQGRLVSVR EHNERQMADK VIGFLSDGLV VAQVSDAGTP
101 AVCDPGAKLA RRVREAGFKV VPVVGASAVM AALSVAGVAE SDFYFNGFVP
151 PKSGERRKLF AKWVRAAFPV VMFETPHRIG ATLADMAELF PERRLMLARE
201 ITKTFETFLS GTVGEIQTAL AADGNQSRGE MVLVLYPAQD EKHEGLSESA
251 QNAMKILAAE LPTKQAAELA AKITGEGKKA LYDLALSWKN K*
```

ORF147ng-1 (SEQ ID NO: 646) shows homology to a hypothetical *E.coli* protein (SEQ ID NO: 1152):

```
sp|P45528|YRAL_ECOLI HYPOTHETICAL 31.3 KD PROTEIN IN AGAI-MTR INTERGENIC REGION
(F286)
)gi|606086 (U18997) ORF_f286 [Escherichia coli]
)gi|1789535 (AE000395) hypothetical 31.3 kD protein in agai-mtr intergenic region
[Escherichia coli] Length = 286
Score = 218 bits (550), Expect = 3e-56
Identities = 128/284 (45%), Positives = 171/284 (60%), Gaps = 4/284 (1%)

Query:    4 KHLQKASDSVVGGTLYVVATPIGNLADITLRALAVLQKADIICAEDTRVTAQLLSAYGIQ    63
            K Q A +S  G LY+V TPIGNLADIT RAL VLQ  D+I AEDTR T  LL  +GI
Sbjct:    2 KQHQSADNSQ--GQLYIVPTPIGNLADITQRALEVLQAVDLIAAEDTRHTGLLLQHFGIN   59

Query:   64 GRLVSVREHNERQMADKVIGFLSDGLVVAQVSDAGTPAVCDPGAKLARRVREAGFKVVPV   123
            RL ++ +HNE+Q A+ ++   L +G  +A VSDAGTP + DPG L R  REAG +VVP+
Sbjct:   60 ARLFALHDHNEQQKAETLLAKLQEGQNIALVSDAGTPLINDPGYHLVRTCREAGIRVVPL  119

Query:  124 VGASAVMAALSVAGVAESDFYFNGFVPPKSGERRKLFAKWVRAAFPVVMFETPHRIGATL   183
            G  A + ALS AG+     F + GF+P KS  RR            ++ +E+ HR+  +L
Sbjct:  120 PGPCAAITALSAAGLPSDRFCYEGFLPAKSKGRRDALKAIEAEPRTLIFYESTHRLLDSL  179

Query:  184 ADMAELFPERR-LMLAREITKTFETFLSGTVGEIQTALAADGNQSRGEMVLVLYPAQDEK   242
            D+ + E R ++LARE+TKT+ET      VGE+  +  D N+ +GEMVL++          +
Sbjct:  180 EDIVAVLGESRYVVLARELTKTWETIHGAPVGELLAWVKEDENRRKGEMVLIV-EGHKAQ  238

Query:  243 HEGLSESAQNMAKILAAELPTKQAAELAAKITGEGKKALYDLAL                  286
            E L   A   + +L AELP K+AA LAA+I G  K ALY AL
Sbjct:  239 EEDLPADALRTLALLQAELPLKKAAALAAEIHGVKKNALYKYAL                  282
```

Based on the computer analysis and the presence of a putative transmembrane domain in the gonococcal protein, it is predicted that these proteins from *N.meningitidis* and *N.gonorrhoeae*, and their epitopes, could be useful antigens for vaccines or diagnostics, or for raising antibodies.

Example 77

The following partial DNA sequence was identified in *N.meningitidis* (SEQ ID NO: 647)

```
  1  ATGAAAACAA CCGACAAACG GACAACCGAA ACACACCGCA AAGCCCCGAA
 51  AACCGGTCGC ATCCGCTTCT C.GCTGCTTA CTTAGCCATA TGCCTGTCGT
101  TCGGCATTCT TCCCCAAGCC TGGGCGGGAC ACACTTATTT CGGCATCAAC
151  TACCAATACT ATCGCGACTT TGCCCAAAAT AAAGGCAAGT TTGCAGTCGG
201  GGCCAAAGAT ATTGAGGTTT ACAACAAAAA AGGGGAGTTG GTCGGCAAAT
251  CAATGACAAA AGCCCCGATG ATTGATTTTT CTGTGGTGTC GCGTAACGGC
301  GTGGCGGcAT TGGTGGGCGt ATCAATATAT TGTGAGCGTG GCACATAACG
351  GCGGCTATAA CAACGTTGAT TTTGGTGCGG AAGGAAk.AA tATCCC.GAT
401  CAACAwCGww TTACTTATAA AATTGTGAAA CGGAATAATT ATAAAGCAGG
451  GACTAAAGGC CATCCTTATG GCGGCGATTA TCATATGCCG CGTTTGCATA
501  AATwTGTCAC AGATGCAGAA CCTGTTGAAA TGACCAGTTA TATGGATGGG
551  CGGAAATATA TCGATCAAAA TAATTACCCT GACCGTGTTC GTATTGGGGC
601  AGGCAGGCAA TATTGGCGAT CTGATGGAGA TGAGCCCAAT AACCGCGAAA
651  GTTCATATCA TATTGCAAGT .......... .......... ..........
701  .......... .....GGCTC ACCAATGTTT ATCTATGATG CCCAAAAGCA
751  AAAGTGGTTA ATTAATGGGG TATTGCAAAC GGGCAACCCC TATATAGGAA
801  AAAGCAATGG CTTCCAGCTG GTTCGTAAAG ATTGGTTCTA TGATGAAATC
851  TTTGCTGGAG ATACCCATTC AGTATTCTAC GAACCACGTC AAAATGGGAA
901  ATACTCTTTT AACGACGATA ATAATGGCAC AGGAAAAATC AATGCCAAAC
```

```
                         -continued
 951    ATGAACACAA TTCTCTGCCT AATAGATTAA AAACACGAAC CGTTCAATTG

1001    TTTAATGTTT CTTTATCCGA GACAGCAAGA GAACCTGTTT ATCATGCTGC

1051    AGGTGGTGTC AACAGTTATC GACCCAGACT GAATAATGGA GAAAATATTT

1101    CCTTTATTGA CGAAGGAAAA GGCGAATTGA TACTTACCAG CAACATCAAT

1151    CAAGGTGCTG GAGGATTATA TTTCCAAGGA GATTTTACGG TCTCGCCTGA

1201    AAATAACGAA ACTTGGCAAG GCGCGGGCGT TCATATCAGT GAAGACAGTA

1251    CCGTTACTTG GAAAGTAAAC GGCGTGGCAA ACGACCGCCT GTCCAAAATC

1301    GGCAAAGGCA CGCTG..... .......... .......... ..........
                                          //
2101    .......... .......... .......... .......... ...GATAAAG

2151    TGACTGCTTC ATTGACTAAG ACCGACATCA GCGGCAATGT CGATCTTGCC

2201    GATCACGCTC ATTTAAATCT CACAGGGCTT GCCACACTCA ACGGCAATCT

2251    TAGTGCAAAT GGCGATACAC GTTATACAGT CAGCCACAAC GCCACCCAAA

2301    ACGGCAACCk TAgCCtCGtG G.sAATGcCC AAGCAACATT TAATCAAGCC

2351    ACATTAAACG GCAACACATC GGCTTCgGGC AATGCTTCAT TTAATCTAAG

2401    CGACCACGCC GTACAAAACG GCAGTCTGAC GCTTTCCGGC AACGCTAAGG

2451    CAAACGTAAG CCATTCCGCA CTCAACGGTA ATGTCTCCCT AGCCGATAAG

2501    GCAGTATTCC ATTTTGAAAG CAGCCGCTTT ACCGGACAAA TCAGCGGCGG

2551    CAagGATACG GCATTACACT TAAAAGACAG CGAATGGACG CTGCCGTCAg

2601    GarCGGAATT AGGCAATTTA AACCTTGACA ACGCCACCAT TACaCTCAAT

2651    TCCGCCTATC GCCACGATGC GGCAGGGGCG CAAACCGGCA GTGCGACAGA

2701    TGCGCCGCGC CGCCGTTCGC GCCGTTCGCG CCGTTCCCTA TTATmCGTTA

2751    CACCGCCAAC TTCGGTAGAA TCCCGTTTCA ACACGCTGAC GGTAAACGGC

2801    AAATTGAACG GTCAGGGAAC ATTCCGCTTT ATGTCGGAAC TCTTCGGCTA

2851    CCGCAGCGAC AAATTGAAGC TGGCGGAAAG TTCCGAAGGC ACTTACACCT

2901    TGGCGGTCAA CAATACCGGC AACGAACCTG CAAGCCTCGA ACAATTGACG

2951    GTAGTGGAAG GAAAAGACAA CAAACCGCTG TCCGAAAACC TTAATTTCAC

3001    CCTGCAAAAC GAACACGTCG ATGCAGGCGC GTGG...... ..........
                                          //
3551    .......... .......... ....TTAGAC CGCGTATTTG CCGAAGACCG

3601    CCGCAACGCC GTTTGGACAA GCGGCATCCG GGACACCAAA CACTACCGTT

3651    CGCAAGATTT CCGCGCCTAC CGCCAACAAA CCGACCTGCG CCAAATCGGT

3701    ATGCAGAAAA ACCTCGGCAG CGGGCGCGTC GGCATCCTGT TTTCGCACAA

3751    CCGGACCGAA ACACCTTCG ACGACGGCAT CGGCAACTCG GCACGGCTTG

3801    CCCACGGCGC CGTTTTCGGG CAATACGGCA TCGACAGGTT CTACATCGGC

3851    ATCAGnCGCG GGCGCGGGTT TTAGCAGCGG CAGCCTTTcA GACGGCATCG

3901    GAGsmAAAwT CCGCCGCCGC GTGCtGCATT ACGGCATTCA GGCACGAtAC

3951    CGCGCCGgtt tCggCGgATt CGGCATCGAA CCGCACATCG GCGCAACGCg 4001    ctATTTCGTC CAAAAAGCGG ATTACCGCTA CGAAAACGTC AATATCGCCA 4051    CCCCCGGCCT TGCATTCAAC CGcTACCGCG CGGGCATTAa GGCAGATTAT
```

```
                    -continued
4101   TCATTCAAAC CGGCGCAACA CATTTCCATC ACGCCTTATT TGAGCCTGTC

4151   CTATACCGAT GCCGCTTCGG GCAAAGTCCG AACACGCGTC AATACCGCCG

4201   TATTGGCTCA GGATTTCGGC AAAACCCGCA GTGCGGAATG GGgCGTAAAC

4251   GCCGAAATCA AAGGTTTCAC GCTGTCCCTC CACGCTGCCG CCGCCAAAGG

4301   CCCGCAACTG GAAGCGCAAC ACAGCGCGGG CATCAAATTA GGCTACCGCT

4351   GGTAA...
```

This corresponds to the amino acid sequence (SEQ ID NO: 648; ORF1):

```
   1   MKTTDKRTTE THRKAPKTGR IRFXAAYLAI CLSFGILPQA WAGHTYFGIN

51   YQYYRDFAEN KGKFAVGAKD IEVYNKKGEL VGKSMTKAPM IDFSVVSRNG

101   VAALVGVQYI VSVAHNGGYN NVDFGAEGXN IXDQXRXTYK IVKRNNYKAG

151   TKGHPYGGDY HMPRLHKXVT DAEPVEMTSY MDGRKYIDQN NYPDRVRIGA

201   GRQYWRSDED EPNNRESSYH IAS....... ........GS PMFIYDAQKQ

251   KWLINGVLQT GNPYIGKSNG FQLVRKDWFY DEIFAGDTHS VFYEPRQNGK

301   YSFNDDNNGT GKINAKHEHN SLPNRLKTRT VQLFNVSLSE TAREPVYHAA

351   GGVNSYRPRL NNGENISFID EGKGRLILTS NINQGAGGLY FQGDFTVSPE

401   NNETWQGAGV HISEDSTVTW KVNGVANDRL SKIGKGTL.. ..........
                                  //
 701   .......... ....DKVTAS LTKTDISGNV DLADHAHLNL TGLATLNGNL

751   SANGDTRYTV SHNATQNGNX SLVXNAQATF NQATLNGNTS ASGNASFNLS

801   DHAVQNGSLT LSGNAKANVS HSALNGNVSL ADKAVFHFES SRFTGQISGG

851   KDTALHLKDS EWTLPSGXEL GNLNLDNATI TLNSAYRHDA AGAQTGSATD

901   APRRRSRRSR RSLLXVTPPT SVESRFNTLT VNGKLNGQGT FRFMSELFGY

951   RSDKLKAAES SEGTYTLAVN NTGNEPASLE QLTVVEGKDN KPLSENLNFT

1001   LQNEHVDAGA W......... .......... .......... ..........
                                  //
1151   .......... .......... .......... .......... .LDRVFAEDR

1201   RNAVWTSGIR DTKHYRSQDF RAYRQQTDLR QIGMQKNLGS GRVGILFSHN

1251   RTENTFDDGI GNSARLAHGA VFGQYGIDRF YIGISAGAGF SSGSLSDGIG

1301   XKXRRRVLHY GIQARYRAGF GGFGIEPHIG ATRYFVQKAD YRYENVNIAT

1351   PGLAFNRYRA GIKADYSFKP AQHISITPYL SLSYTDAASG KVRTRVNTAV

1401   LAQDFGKTRS AEWGVNAEIK GFTLSLHAAA AKGPQLEAQH SAGIKLGYRW

1451   *
```

Further sequencing analysis revealed the complete nucleotide sequence (SEQ ID NO: 649):

```
   1   ATGAAAACAA CCGACAAACG GACAACCGAA ACACACCGCA AAGCCCCGAA

51   AACCGGCCGC ATCCGCTTCT CGCCTGCTTA CTTAGCCATA TGCCTGTCGT

101   TCGGCATTCT TCCCCAAGCC TGGGCGGGAC ACACTTATTT CGGCATCAAC
```

-continued

```
 151 TACCAATACT ATCGCGACTT TGCCGAAAAT AAAGGCAAGT TTGCAGTCGG
 201 GGCGAAAGAT ATTGAGGTTT ACAACAAAAA AGGGGAGTTG GTCGGCAAAT
 251 CAATGACAAA AGCCCCGATG ATTGATTTTT CTGTGGTGTC GCGTAACGGC
 301 GTGGCGGCAT TGGTGGGCGA TCAATATATT GTGAGCGTGG CACATAACGG
 351 CGGCTATAAC AACGTTGATT TTGGTGCGGA AGGAAGAAAT CCCGATCAAC
 401 ATCGTTTTAC TTATAAAATT GTGAAACGGA ATAATTATAA AGCAGGGACT
 451 AAAGGCCATC CTTATGGCGG CGATTATCAT ATGCCGCGTT TGCATAAATT
 501 TGTCACAGAT GCAGAACCTG TTGAAATGAC CAGTTATATG GATGGGCGGA
 551 AATATATCGA TCAAAATAAT TACCCTGACC GTGTTCGTAT TGGGGCAGGC
 601 AGGCAATATT GGCGATCTGA TGAAGATGAG CCCAATAACC GCGAAAGTTC
 651 ATATCATATT GCAAGTGCGT ATTCTTGGCT CGTTGGTGGC AATACCTTTG
 701 CACAAAATGG ATCAGGTGGT GGCACAGTCA ACTTAGGTAG TGAAAAAATT
 751 AAACATAGCC CATATGGTTT TTACCAACA GGAGGCTCAT TTGGCGACAG
 801 TGGCTCACCA ATGTTTATCT ATGATGCCCA AAAGCAAAAG TGGTTAATTA
 851 ATGGGGTATT GCAAACGGGC AACCCCTATA TAGGAAAAAG CAATGGCTTC
 901 CAGCTGGTTC GTAAAGATTG GTTCTATGAT GAAATCTTTG CTGGAGATAC
 951 CCATTCAGTA TTCTACGAAC CACGTCAAAA TGGGAAATAC TCTTTTAACG
1001 ACGATAATAA TGGCACAGGA AAAATCAATG CCAAACATGA ACACAATTCT
1051 CTGCCTAATA GATTAAAAAC ACGAACCGTT CAATTGTTTA ATGTTTCTTT
1101 ATCCGAGACA GCAAGAGAAC CTGTTTATCA TGCTGCAGGT GGTGTCAACA
1151 GTTATCGACC CAGACTGAAT AATGGAGAAA ATATTTCCTT TATTGACGAA
1201 GGAAAAGGCG AATTGATACT TACCAGCAAC ATCAATCAAG GTGCTGGAGG
1251 ATTATATTTC CAAGGAGATT TTACGGTCTC GCCTGAAAAT AACGAAACTT
1301 GGCAAGGCGC GGGCGTTCAT ATCAGTGAAG ACAGTACCGT TACTTGGAAA
1351 GTAAACGGCG TGGCAAACGA CCGCCTGTCC AAAATCGGCA AAGGCACGCT
1401 GCACGTTCAA GCCAAAGGGG AAAACCAAGG CTCGATCAGC GTGGGCGACG
1451 GTACAGTCAT TTTGGATCAG CAGGCAGACG ATAAAGGCAA AAAACAAGCC
1501 TTTAGTGAAA TCGGCTTGGT CAGCGGCAGG GGTACGGTGC AACTGAATGC
1551 CGATAATCAG TTCAACCCCG ACAAACTCTA TTTCGGCTTT CGCGGCGGAC
1601 GTTTGGATTT AAACGGGCAT TCGCTTTCGT TCCACCGTAT TCAAAATACC
1651 GATGAAGGGG CGATGATTGT CAACCACAAT CAAGACAAAG AATCCACCGT
1701 TACCATTACA GGCAATAAAG ATATTGCTAC AACCGGCAAT AACAACAGCT
1751 TGGATAGCAA AAAAGAAATT GCCTACAACG GTTGGTTTGG CGAGAAAGAT
1801 ACGACCAAAA CGAACGGGCG GCTCAACCTT GTTTACCAGC CCGCCGCAGA
1851 AGACCGCACC CTGCTGCTTT CCGGCGGAAC AAATTTAAAC GGCAACATCA
1901 CGCAAACAAA CGGCAAACTG TTTTTCAGCG GCAGACCAAC ACCGCACGCC
1951 TACAATCATT TAAACGACCA TTGGTCGCAA AAAGAGGGCA TTCCTCGCGG
2001 GGAAATCGTG TGGGACAACG ACTGGATCAA CCGCACATTT AAAGCGGAAA
2051 ACTTCCAAAT TAAAGGCGGA CAGGCGGTGG TTTCCCGCAA TGTTGCCAAA
2101 GTGAAAGGCG ATTGGCATTT GAGCAATCAC GCCCAAGCAG TTTTTGGTGT
```

```
2151  CGCACCGCAT CAAAGCCACA CAATCTGTAC ACGTTCGGAC TGGACGGGTC

2201  TGACAAATTG TGTCGAAAAA ACCATTACCG ACGATAAAGT GATTGCTTCA

2251  TTGACTAAGA CCGACATCAG CGGCAATGTC GATCTTGCCG ATCACGCTCA

2301  TTTAAATCTC ACAGGGCTTG CCACACTCAA CGGCAATCTT AGTGCAAATG

2351  GCGATACACG TTATACAGTC AGCCACAACG CCACCCAAAA CGGCAACCTT

2401  AGCCTCGTGG GCAATGCCCA AGCAACATTT AATCAAGCCA CATTAAACGG

2451  CAACACATCG GCTTCGGGCA ATGCTTCATT TAATCTAAGC GACCACGCCG

2501  TACAAAACGG CAGTCTGACG CTTTCCGGCA ACGCTAAGGC AAACGTAAGC

2551  CATTCCGCAC TCAACGGTAA TGTCTCCCTA GCCGATAAGG CAGTATTCCA

2601  TTTTGAAAGC AGCCGCTTTA CCGGACAAAT CAGCGGCGGC AAGGATACGG

2651  CATTACACTT AAAAGACAGC GAATGGACGC TGCCGTCAGG CACGGAATTA

2701  GGCAATTTAA ACCTTGACAA CGCCACCATT ACACTCAATT CCGCCTATCG

2751  CCACGATGCG GCAGGGCGC AAACCGGCAG TGCGACAGAT GCGCCGCGCC

2801  GCCGTTCGCG CCGTTCGCGC CGTTCCCTAT TATCCGTTAC ACCGCCAACT

2851  TCGGTAGAAT CCCGTTTCAA CACGCTGACG GTAAACGGCA AATTGAACGG

2901  TCAGGGAACA TTCCGCTTTA TGTCGGAACT CTTCGGCTAC CGCAGCGACA

2951  AATTGAAGCT GGCGGAAAGT TCCGAAGGCA CTTACACCTT GGCGGTCAAC

3001  AATACCGGCA ACGAACCTGC AAGCCTCGAA CAATTGACGG TAGTGGAAGG

3051  AAAAGACAAC AAACCGCTGT CCGAAAACCT TAATTTCACC CTGCAAAACG

3101  AACACGTCGA TGCCGGCGCG TGGCGTTACC AACTCATCCG CAAAGACGGC

3151  GAGTTCCGCC TGCATAATCC GGTCAAAGAA CAAGAGCTTT CCGACAAACT

3201  CGGCAAGGCA GAAGCCAAAA ACAGGCGGA AAAAGACAAC GCGCAAAGCC

3251  TTGACGCGCT GATTGCGGCC GGGCGCGATG CCGTCGAAAA GACAGAAAGC

3301  GTTGCCGAAC CGGCCCGGCA GGCAGGCGGG GAAAATGTCG GCATTATGCA

3351  GGCGGAGGAA GAGAAAAAAC GGGTGCAGGC GGATAAAGAC ACCGCCTTGG

3401  CGAAACAGCG CGAAGCGGAA ACCCGGCCGG CTACCACCGC CTTCCCCCGC

3451  GCCCGCCGCG CCCGCCGGGA TTTGCCGCAA CTGCAACCCC AACCGCAGCC

3501  CCAACCGCAG CGCGACCTGA TCAGCCGTTA TGCCAATAGC GGTTTGAGTG

3551  AATTTTCCGC CACGCTCAAC AGCGTTTTCG CCGTACAGGA CGAATTAGAC

3601  CGCGTATTTG CCGAAGACCG CCGCAACGCC GTTTGGACAA GCGGCATCCG

3651  GGACACCAAA CACTACCGTT CGCAAGATTT CCGCGCCTAC CGCCAACAAA

3701  CCGACCTGCG CCAAATCGGT ATGCAGAAAA ACCTCGGCAG CGGGCGCGTC

3751  GGCATCCTGT TTTCGCACAA CCGGACCGAA AACACCTTCG ACGACGGCAT

3601  CGGCAACTCG GCACGGCTTG CCCACGGCGC CGTTTTCGGG CAATACGGCA

3651  TCGACAGGTT CTACATCGGC ATCAGCGCGG GCGCGGGTTT TAGCAGCGGC

3901  AGCCTTTCAG ACGGCATCGG AGGCAAAATC CGCCGCCGCG TGCTGCATTA

3951  CGGCATTCAG GCACGATACC GCGCCGGTTT CGGCGGATTC GGCATCGAAC

4001  CGCACATCGG CGCAACGCGC TATTTCGTCC AAAAAGCGGA TTACCGCTAC

4051  GAAAACGTCA ATATCGCCAC CCCCGGCCTT GCATTCAACC GCTACCGCGC

4101  GGGCATTAAG GCAGATTATT CATTCAAACC GGCGCAACAC ATTTCCATCA
```

```
                       -continued
4151   CGCCTTATTT GAGCCTGTCC TATACCGATG CCGCTTCGGG CAAAGTCCGA

4201   ACACGCGTCA ATACCGCCGT ATTGGCTCAG GATTTCGGCA AAACCCGCAG

4251   TGCGGAATGG GGCGTAAACG CCGAAATCAA AGGTTTCACG CTGTCCCTCC

4301   ACGCTGCCGC CGCCAAAGGC CCGCAACTGG AAGCGCAACA CAGCGCGGGC

4351   ATCAAATTAG GCTACCGCTG GTAA
```

This corresponds to the amino acid sequence (SEQ ID NO: 650; ORF1-1):

```
   1   MKTTDKRTTE THRKAPKTGR IRFSPAYLAI CLSFGILPQA WAGHTYFGIN

51   YQYYRDFAEN KGKFAVGAKD IEVYNKKGEL VGKSMTKAPM IDFSVVSRNG

101   VAALVGDQYI VSVAHNGGYN NVDFGAEGRN PDQHRFTYKI VKRNNYKAGT

151   KGHPYGGDYH MPRLHKFVTD AEPVEMTSYM DGRKYIDQNN YPDRVRIGAG

201   RQYWRSDEDE PNNRESSYHI ASAYSWLVGG NTFAQNGSGG GTVNLGSEKI

251   KHSPYGFLPT GGSFGDSGSP MFIYDAQKQK WLINGVLQTG NPYIGKSNGF

301   QLVRKDWFYD EIFAGDTHSV FYEPRQNGKY SFNDDNNGTG KINAKHEHNS

351   LPNRLKTRTV QLFNVSLSET AREPVYHAAG GVNSYRPRLN NGENISFIDE

401   GKGELILTSN INQGAGGLYF QGDFTVSPEN NETWQGAGVH ISEDSTVTWK

451   VNGVANDRLS KIGKGTLHVQ AKGENQGSIS VGDGTVILDQ QADDKGKKQA

501   FSEIGLVSGR GTVQLNADNQ FNPDKLYFGF RGGRLDLNGH SLSFHRIQNT

551   DEGAMIVNHN QDKESTVTIT GNKDIATTGN NNSLDSKKEI AYNGWFGEKD

601   TTKTNGRLNL VYQPAAEDRT LLLSGGTNLN GNITQTNGKL FFSGRPTPHA

651   YNHLNDHWSQ KEGIPRGEIV WDNDWINRTF KAENFQIKGG QAVVSRNVAK

701   VKGDWHLSNH AQAVFGVAPH QSHTICTRSD WTGLTNCVEK TITDDKVIAS

751   LTKTDISGNV DLADHAHLNL TGLATLNGNL SANGDTRYTV SHNATQNGNL

801   SLVGNAQATF NQATLNGNTS ASGNASFNLS DHAVQNGSLT LSGNAKANVS

851   HSALNGNVSL ADKAVFHFES SRFTGQISGG KDTALHLKDS EWTLPSGTEL

901   GNLNLDNATI TLNSAYRHDA AGAQTGSATD APRRRSRRSR RSLLSVTPPT

951   SVESRFNTLT VNGKLNGQGT FRFMSELFGY RSDKLKLAES SEGTYTLAVN

1001   NTGNEPASLE QLTVVEGKDN KPLSENLNFT LQNEHVDAGA WRYQLIRKDG

1051   EFRLHNPVKE QELSDKLGKA EAKKQAEKDN AQSLDALIAA GRDAVEKTES

1101   VAEPARQAGG ENVGIMQAEE EKKRVQADKD TALAKQREAE TRPATTAFPR

1151   ARRARRDLPQ LQPQPQPQPQ RDLISRYANS GLSEFSATLN SVFAVQDELD

1201   RVFAEDRRNA VWTSGIRDTK HYRSQDFRAY RQQTDLRQIG MQKNLGSGRV

1251   GILFSHNRTE NTFDDGIGNS ARLAHGAVFG QYGIDRFYIG ISAGAGFSSG

1301   SLSDGIGGKI RRRVLHYGIQ ARYRAGFGGF GIEPHIGATR YFVQKADYRY

1351   ENVNIATPGL AFNRYRAGIK ADYSFKPAQH ISITPYLSLS YTDAASGKVR

1401   TRVNTAVLAQ DFGKTRSAEW GVNAEIKGFT LSLHAAAAKG PQLEAQHSAG

1451   IKLGYRW*
```

ORF1 (SEQ ID NO: 648) shows 57.8% identity over a 1456aa overlap with an ORF (ORF1a) (SEQ ID NO: 652) from strain A of *N. meningitidis*:

```
                 10        20        30        40        50        60
orf1.pep MKTTDKRTTETHRKAPKTGRIRFXAAYLAICLSFGILPQAWAGHTYFGINYQYYRDFAEN
         ||||||||||||||||||||||| |||||||||||||||||||||||||||||||||||
orf1a    MKTTDKRTTETHRKAPKTGRIRFSPAYLAICLSFGILPQAWAGHTYFGINYQYYRDFAEN
                 10        20        30        40        50        60

70        80        90       100       110       120
orf1.pep KGKFAVGAKDIEVYNKKGELVGKSMTKAPMIDFSVVSRNGVAALVGVQYIVSVAHNGGYN
         |||||||||||||||||||||||||||||||||||||||||||||| |||||||||||||
orf1a    KGKFAVGAKDIEVYNKKGELVGKSMTKAPMIDFSVVSRNGVAALVGDQYIVSVAHNGGYN
                 70        80        90       100       110       120

130       140       150       160       170       180
orf1.pep NVDFGAEGXNIXDQXRXTYKIVKRNNYKAGTKGHPYGGDYHMPRLHKXVTDAEPVEMTSY
         ||||||||||  || | :|:||||||||  :: |||:|| ||||||| |||||||||||
orf1a    NVDFGAEGXN-PDQHRFSYQIVKRNNYKPDNS-HPYNGDXHMPRLHKFVTDAEPVEMTSD
                130        140       150        160       170

190       200       210
orf1.pep MDGRKYIDQNNYPDRVRIGAGRQYWRSDEDEP---------------------NN-----
         | |  | |:::||:|||||:|::||| |:|:                      ||
orf1a    MRGNTYSDKEKYPERVRIGSGHHYWRYDDDKHGDLSYSGAWLIGGNTHMQGWGNNGVXSL
        180       190       200       210       220       230

220                230       240       250       260
orf1.pep ----RESSYH----IA-----SGSPMFIYDAQKQKWLINGVLQTGNPYIGKSNGFQLVRK
             |::: :    ||     |||||||||  ::|||:||||||| || |: |||||:||
orf1a    SGDVRHANDYGPMPIAGAAGDSGSPMFIYDKTNHKWLLNGVLQTGYPYSGRENGFQLIRK
        240       250       260       270       280       290

270       280       290       300       310       320
orf1.pep DWFYDEIFAGDTHSVFYEPRQNGKYSFNDDNNGTGKINAKHEHNSLPNRLKTRTVQLFNV
         |||||:|: ||||:| :|||:||::||:::||||| ::  :|: | | :||::||:||:
orf1a    DWFYDDIYRGDTHTVXFEPRSNGHFSFTSNNNGTGTVTETNEKVSNP-KLKVQTVRLFDE
        300       310       320       330       340        350

330       340       350       360       370       380
orf1.pep SLSETAREPVAHAAGGVNSYRPRLNNGENISFIDEGKGELILTSNINQGAGGLYFQGDFT
         ||:|| :|||| ||||||:||||||||||:|||| |:|:|||::|||||||||||:||||
orf1a    SLNETDKEPVY-AAGGVNQYRPRLNNGENLSFIDYGNGKLILSNNINQGAGGLYFEGDFT
         360        370       380       390       400       410

390       400       410       420       430
orf1.pep VSPENNETWQGAGVHISEDSTVTWKVNGVANDRLSKIGKGTL------------------
         ||||||||||||||||||||||||||||||||||||||||||
orf1a    VSPENNETWQGAGVHISEDSTVTWKVNGVANDRLSKIGKGTLHVQAKGENQGSISVGDGT
          420       430       440       450       460       470
orf1.pep ------------------------------------------------------------
orf1a    VILDQQADDKGKKQAFSEIGLXSGRGTVQLNADNQFNPDKLYFGFRGGRLDLNGHSLSFH
          480       490       500       510       520       530 orf1.pep ------------------------------------------------------------
orf1a    RIQNTDEGAMIXXHNATTTSTVTITGNESITQPSGKNINRLNYSKEIAYNGWFGEKDTTK
          540       550       560       570       580       590 orf1.pep ------------------------------------------------------------
orf1a    TNGRLNLVYQPAAEDRTXLLSGGTNLNGNITQTNGKLFFSGRPTPHAYNHLGSGWSKMEG
          600       610       620       630       640       650 orf1.pep ------------------------------------------------------------
orf1a    IPQGEIVWDNDWIXRTFKAENFHIQGGQAVISRNVAKVEGDXHLSNHAQAVFGVAPHQSH
          660       670       680       690       700       710

440       450       460       470       480
orf1.pep ----------------XXXXXDKVTASLTKTDISGNVDLADHAHLNLTGLATLNGNLSAN
                    :    || : ||| ||||||| || | |       |:| |:| ||||||
orf1a    TICTRSDWTGLTNCVEXXITDDKVIASLTKTDXSGXVXLXXXXXXXLXGXAXLXGNLSAN
           720       730       740       750       760       770

490       500       510       520       530       540
orf1.pep GDTRYTVSHNATQNGNXSLVXNAQATFNQATLNGNTSASGNASFNLSDHAVQNGSLTLSG
         |||||||||||||||| ||| ||||||||||||||:| |||||||||::|:||||||||
orf1a    GDTRYTVSHNATQNGNLSLVGNAQATFNQATLNGNXSXSGNASFNLSNNAAQNGSLTLSD
          780       790       800       810       820       830
```

-continued

```
                 550       560       570       580       590       600
orf1.pep  NAKANVSHSALNGNVSLADKAVFHFESSRFTGQISGGKDTALHLKDSEWTLPSGXELGNL
          ||||||||||||||||||||||||||||||:||||||:||:| |||||||||||||||:||||
orf1a     NAKANVSHSALNGNVSLADKAVFHFENSRFTGQLSGSKXTALHLKDSEWTLPSGTELGNL
                 840       850       860       870       880       890

610       620       630       640       650       660
orf1.pep  NLDNATITLNSAYRHDAAGAQTGSATDAPRRRSRRSRRSLLXVTPPTSVESRFNTLTVNG
          ||||||||||||||||||||||||  ::|:|||||||||   |||||||||||||||||
orf1a     NLDNATITLNSAYRHDAAGAQTGXVSDTPRRRSRRS---LLSVTPPTSVESRFNTLTVNG
                 900       910       920       930       940       950

670       680       690       700       710       720
orf1.pep  KLNGQGTFRFMSELFGYRSDKLKLAESSEGTYTLAVNNTGNEPASLEQLTVVEGKDNKPL
          |||  |||||||||||||||||||||||||||||||||||||||:||:||||||||||||
orf1a     KLNXQGTFRFMSELFGYRSDKLKLAESSEGTYTLAVNNTGNEPVSLDQLTVVEGKDNKPL
                 960       970       980       990      1000      1010

730       740       750
orf1.pep  SENLNFTLQNEHVDAGAW------------------------------------------
          ||||||||||||||||||
orf1a     SENLNFTLQNEHVDAGAWRYQLIRKDGEFRLHNPVKEQELSDKLGKAEAKKQAEKDNAQS
                1020      1030      1040      1050      1060      1070 orf1.pep  ------------------------------------------------------------
orf1a     LDALIAAGRDAAEKTESVAEPARXAGGENVGIMQAEEEKKRVQADKDSALAKQREAETRP
                1080      1090      1100      1110      1120      1130

760
orf1.pep  ---------------------------------------------------------LDR
                                                                   |||
orf1a     XTTAFPRARXARRDLPQPQPQPQPQPQPQRDLXSRYANSGLSEFSATLNSVFAVQDELDR
                1140      1150      1160      1170      1180      1190

770       780       790       800       810       820
orf1.pep  VFAEDRRNAVWTSGIRDTKHYRSQDFRAYRQQTDLRQIGMQKNLGSGRVGILFSHNRTEN
          |||||||||||||| || ||||||||||||||||||||||||||||||||||||||||||
orf1a     VFAEDRRNAVWTSXIRXTKHYRSQDFRAYRQQTDLRQIGMQKNLGSGRVGILFSHNRTEN
                1200      1210      1220      1230      1240      1250

830       840       850       860       870       880
orf1.pep  TFDDGIGNSARLAHGAVFGQYGIDRFYIGISAGAGFSSGSLSDGIGXKXRRRVLHYGIQA
          :|||||||||||||||||||||| ||  ||||:|||||| |||||||  |||||||||||
orf1a     XFDDGIGNSARLAHGAVFGQYGIGRFDIGISTGAGFSSGXLSDGIGGKIRRRVLHYGIQA
                1260      1270      1280      1290      1300      1310

890       900       910       920       930       940
orf1.pep  RYRAGFGGFGIEPHIGATRYFVQKADYRYENVNIATPGLAFNRYRAGIKADYSFKPAQHI
          ||||||||||||||:|||||||||||||||||||||||||||||||||||||||||||||
orf1a     RYRAGFGGFGIEPYIGATRYFVQKADYRYENVNIATPGLAFNRYRAGIKADYSFKPAQHX
                1320      1330      1340      1350      1360      1370

950       960       970       980       990      1000
orf1.pep  SITPYLSLSYTDAASGKVRTRVNTAVLAQDFGKTRSAEWGVNAEIKGFTLSLHAAAAKGP
          |||||  ||||||||||||||||||||||||||||||||||||||||||| ||||||||
orf1a     SITPYXSLSYTDAASGKVRTRVNTAVLAQDFGKTRSAEWGVNAEIKGFTLSXHAAAAKGP
                1380      1390      1400      1410      1420      1430

1010      1020
orf1.pep  QLEAQHSAGIKLGYRWX
          |||||||||||||||||
orf1a     QLEAQHSAGIKLGYRWX
                1440      1450
```

The complete length ORF1a nucleotide sequence (SEQ ID NO: 651) is:

```
  1    ATGAAAACAA CCGACAAACG GACAACCGAA ACACACCGCA AAGCCCCGAA

51    AACCGGCCGC ATCCGCTTCT CGCCTGCTTA CTTAGCCATA TGCCTGTCGT

101    TCGGCATTCT TCCCCAAGCT TGGGCGGGAC ACACTTATTT CGGCATCAAC

151    TACCAATACT ATCGCGACTT TGCCGAAAAT AAAGGCAAGT TTGCAGTCGG

201    GGCGAAAGAT ATTGAGGTNT ACAACAAAAA AGGGGAGTTG GTCGGCAAAT
```

```
                    -continued
 251   CAATGACAAA AGCCCCGATG ATTGATTTTT CTGTGGTGTC GCGTAACGGC
 301   GTGGCGGCAT TGGTGGGCGA TCAATATATT GTGAGCGTGG CACATAACGG
 351   CGGCTATAAC AACGTTGATT TTGGTGCGGA AGGAAGNAAT CCCGATCAGC
 401   ACCGTTTTTC TTACCAAATT GTGAAAAGAA ATAATTATAA GCCTGACAAT
 451   TCACACCCTT ACAACGGCGA TTANCATATG CCGCGTTTGC ATAAATTTGT
 501   CACAGATGCA GAACCTGTCG AAATGACGAG TGACATGAGG GGGAATACCT
 551   ATTCCGATAA AGAAAAATAT CCCGAGCGTG TCCGCATCGG CTCAGGACAC
 601   CACTATTGGC GTTATGATGA TGACAAACAC GGCGATTTAT CCTACTCCGG
 651   CGCATGGTTA ATTGGCGGCA ATACACATAT GCAGGGTTGG GGAAATAATG
 701   GCGTANTTAG TTTGAGCGGC GATGTGCGCC ATGCCAACGA CTATGGCCCT
 751   ATGCCGATTG CAGGTGCGGC AGGCGACAGC GGTTCGCCAA TGTTTATTTA
 801   TGACAAAACA AACAATAAAT GGCTGCTCAA CGGAGTTTTA CAAACCGGCT
 851   ACCCTTATTC CGGCAGGGAA AACGGTTTCC AGCTGATACG CAAAGATTGG
 901   TTCTACGATG ACATTTACAG AGGCGATACA CATACCGTCT NTTTTGAACC
 951   GCGCAGTAAC GGACATTTTT CCTTTACATC CAACAACAAC GGTACGGGTA
1001   CGGTAACAGA AACCAACGAA AAGGTNTCCA ATCCAAAGCT TAAAGTACAG
1051   ACAGTCCGAC TGTTTGACGA ATCTTTGAAT GAAACTGATA AGAACCAGT
1101   TTACGCGGCA GGGGGTGTTA ATCAGTACCG TCCAAGGTTA AACAACGGTG
1151   AAAACCTTTC TTTTATCGAT TACGGCAACG GCAAACTCAT CTTATCAAAC
1201   AACATCAACC AAGGCGCGGG CGGTTTGTAT TTTGAAGGTG ATTTTACGGT
1251   CTCGCCTGAA AACAACGAAA CGTGGCAAGG CGCGGGCGTT CATATCAGTG
1301   AAGACAGTAC CGTTACTTGG AAAGTAAACG GCGTGGCAAA CGACCGCCTG
1351   TCCAAAATCG GCAAAGGCAC GCTGCACGTT CAAGCCAAAG GGAAAAACCA
1401   AGGCTCGATC AGCGTGGGCG ACGGTACAGT CATTTTGGAT CAGCAGGCAG
1451   ACGATAAAGG CAAAAAACAA GCCTTTAGTG AAATCGGCTT GNTCAGCGGC
1501   AGGGGTACGG TGCAACTGAA TGCCGATAAT CAGTTCAACC CCGACAAACT
1551   CTATTTCGGC TTTCGCGGCG GACGTTTGGA TTTAAACGGG CATTCGCTTT
1601   CGTTCCACCG TATTCAAAAT ACCGATGAAG GGGCGATGAT TGNCNATCAT
1651   AATGCCACAA CAACATCCAC CGTTACCATT ACAGGGAATG AAAGTATTAC
1701   ACAACCGAGT GGTAAGAATA TCAATAGACT TAATTACAGC AAAGAAATTG
1751   CCTACAACGG TTGGTTTGGC GAGAAAGATA CGACCAAAAC GAACGGGCGG
1801   CTCAACCTTG TTTACCAGCC CGCCGCAGAA GACCGCACCC NGCTGCTTTC
1851   CGGCGGAACA AATTTAAACG GCAACATCAC GCAAACAAAC GGCAAACTGT
1901   TTTTCAGCGG CAGACCGACA CCGCACGCCT ACAATCATTT AGGAAGCGGG
1951   TGGTCAAAAA TGGAAGGTAT CCCACAAGGA GAAATCGTGT GGGACAACGA
2001   CTGGATCNAC CGCACGTTTA AAGCGGAAAA TTTCCATATT CAGGGCGGGC
2051   AGGCGGTGAT TTCCCGCAAT GTTGCCAAAG TGGAAGGCGA TTGNCATTTG
2101   AGCAATCACG CCCAAGCAGT TTTTGGTGTC GCACCGCATC AAAGCCATAC
2151   AATCTGTACA CGTTCGGACT GGACNGGTCT GACAAATTGT GTCGAANAAA
2201   NCATTACCGA CGATAAAGTG ATTGCTTCAT TGACTAAGAC NGACNTNAGC
```

```
                    -continued
2251  GGCANTGTNA GNCTNNCCNA TNACGNTNNT TNAAANCTCN CNGGGCNTGC

2301  NNCACTNAAN GGCAATCTTA GTGCAAATGG CGATACACGT TATACAGTCA

2351  GCCACAACGC CACCCAAAAC GGCAACCTTA GCCTCGTGGG CAATGCCCAA

2401  GCAACATTTA ATCAAGCCAC ATTAAACGGC AACNCATCGG NTTCGGGCAA

2451  TGCTTCATTT AATCTAAGCA ACAACGCCGC ACAAAACGGC AGTCTGACGC

2501  TTTCCGACAA CGCTAAGGCA AACGTAAGCC ATTCCGCACT CAACGGCAAT

2551  GTCTCCCTAG CCGATAAGGC AGTATTCCAT TTTGAAAACA GCCGCTTTAC

2601  CGGACAACTC AGCGGCAGCA AGGANACAGC ATTACACTTA AAAGACAGCG

2651  AATGGACGCT GCCGTCAGGC ACGGAATTAG GCAATTTAAA CCTTGACAAC

2701  GCCACCATTA CACTCAATTC CGCCTATCGC CACGATGCTG CAGGCGCGCA

2751  AACCGGCAGN GTGTCAGACA CGCCGCGCCG CCGTTCGCGC CGTTCCCTAT

2801  TATCCGTTAC ACCGCCAACT TCGGTAGAAT CCCGTTTCAA CACGCTGACG

2851  GTAAACGGCA AATTGAACNG TCAAGGAACA TTCCGCTTTA TGTCGGAACT

2901  CTTCGGCTAC CGAAGCGACA AATTGAAGCT GGCGGAAAGT TCCGAAGGNA

2951  CTTACACCTT GGCGGTCAAC AATACCGGCA ACGAACCCGT AAGCCTCGAT

3001  CAATTGACGG TAGTGGAAGG GAAAGACAAC AAACCGCTGT CCGAAAACCT

3051  TAATTTCACC CTGCAAAACG AACACGTCGA TGCCGGCGCG TGGCGTTACC

3101  AACTCATCCG CAAAGACGGC GAGTTCCGCC TGCATAATCC GGTCAAAGAA

3151  CAAGAGCTTT CCGACAAACT CGGCAAGGCA GAAGCCAAAA AACAGGCGGA

3201  AAAAGACAAC GCGCAAAGCC TTGACGCGCT GATTGCGGCC GGGCGCGATG

3251  CCGCCGAAAA GACAGAAAGC GTTGCCGAAC CGGCCCGGCN GGCAGGCGGG

3301  GAAAATGTCG GCATTATGCA GGCGGAGGAA GAGAAAAAAC GGGTGCAGGC

3351  GGATAAAGAC AGCGCNTTGG CGAAACAGCG CGAAGCGGAA ACCCGGCCGG

3401  NTACCACCGC CTTCCCCCGC GCCCGCNGCG CCCGCCGGGA TTTGCCGCAA

3451  CCGCAGCCCC AACCGCAACC TCAACCCCAA CCGCAGCGCG ACCTGATNAG

3501  CCGTTATGCC AATAGCGGTT TGAGTGAATT TTCCGCCACG CTCAACAGCG

3551  TTTTCGCCGT ACAGGACGAA TTGGACCGCG TGTTTGCCGA AGACCGCCGC

3601  AACGCNGTTT GGACAAGCNG CATCCGGNAC ACCAAACACT ACCGTTCGCA

3651  AGATTTCCGC GCCTACCGCC AACAAACCGA CCTGCGCCAA ATCGGTATGC

3701  AGAAAAACCT CGGCAGCGGG CGCGTCGGCA TCCTGTTTTC GCACAACCGG

3751  ACCGAAAACA NCTTCGACGA CGGCATCGGC AACTCGGCAC GGCTTGCCCA

3801  CGGCGCCGTT TTCGGGCAAT ACGGCATCGG CAGGTTCGAC ATCGGCATCA

3851  GCACGGGCGC GGGTTTTAGC AGCGGCANTC TNTCAGACGG CATCGGAGGC

3901  AAAATCCGCC GCCGCGTGCT GCATTACGGC ATTCAGGCAC GATACCGCGC

3951  CGGTTTCGGC GGATTCGGCA TCGAACCGTA CATCGGCGCA ACGCGCTATT

4001  TCGTCCAAAA AGCGGATTAC CGCTACGAAA ACGTCAATAT CGCCACCCCC

4051  GGTCTTGCGT TCAACCGNTA CCGNGCGGGC ATTAAGGCAG ATTATTCATT

4101  CAAACCGGCG CAACACATNT CCATCACNCC TTATTTNAGC CTGTCCTATA

4151  CCGATGCCGC TTCGGGCAAA GTCCGAACAC GCGTCAATAC CGCNGTATTG

4201  GCTCAGGATT TCGGCAAAAC CCGCAGTGCG GAATGGGGCG TAAACGCCGA
```

```
4251 AATCAAAGGT TTCACGCTGT CCNTCCACGC TGCCGCCGCC AAAGGNCCGC
4301 AACTGGAAGC GCAACACAGC GCGGGCATCA AATTAGGCTA CCGCTGGTAA
```

This encodes a protein having amino acid sequence (SEQ ID NO: 652):

```
   1 MKTTDKRTTE THRKAPKTGR IRFSPAYLAI CLSFGILPQA WAGMTYFGIN
  51 YQYYRDFAEN KGKFAVGAKD IEVYNKKGEL VGKSMTKAPM IDFSVVSRNG
 101 VAALVGDQYI VSVAKNGGYN NVDFGAEGXN PDQHRFSYQI VKRNNYKPDN
 151 SHPYNGDXHM PRLHKFVTDA EPVEMTSDMR GNTYSDKEKY PERVRIGSGH
 201 MYWRYDDDKH GDLSYSGAWL IGGNTHMQGW GNNGVXSLSG DVRHANDYGP
 251 MPIAGAAGDS GSPMFIYDKT NNKWLLNGVL QTGYPYSGRE NGFQLIRKDW
 301 FYDDIYRGDT HTVXFEPRSN GHFSFTSNNN GTGTVTETNE KVSNPKLKVQ
 351 TVRLFDESLN ETDKEPVYAA GGVNQYRPRL NNGENLSFID YGNGKLILSN
 401 NINQGAGGLY FEGDFTVSPE NNETWQGAGV HISEDSTVTW KVNGVANDRL
 451 SKIGKGTLHV QAKGENQGSI SVGDGTVILD QQADDKGKKQ AFSEIGLXSG
 501 RGTVQLNADN QFNPDKLYFG FRGGRLDLNG HSLSFHRIQN TDEGAMIXXH
 551 NATTTSTVTI TGNESITQPS GKNINRLNYS KEIAYNGWFG EKDTTKTNGR
 601 LNLVYQPAAE DRTXLLSGGT NLNGNITQTN GKLFFSGRPT PHAYNHLGSG
 651 WSKMEGIPQG EIVWDNDWIX RTFKAENFHI QGGQAVISRN VAKVEGDXHL
 701 SNHAQAVFGV APHQSHTICT RSDWTGLTNC VEXXITDDKV IASLTKTDXS
 751 GXVXLXXXXX XXLXGXAXLX GNLSANGDTR YTVSHNATQN GNLSLVGNAQ
 801 ATFNQATLNG NXSXSGNASF NLSNNAAQNG SLTLSDNAKA NVSHSALNGN
 851 VSLADKAVFH FENSRFTGQL SGSKXTALHL KDSEWTLPSG TELGNLNLDN
 901 ATITLNSAYR HDAAGAQTGX VSDTPRRRSR RSLLSVTPPT SVESRFNTLT
 951 VNGKLNXQGT FRFMSELFGY RSDKLKLAES SEGTYTLAVN NTGNEPVSLD
1001 QLTVVEGKDN KPLSENLNFT LQNEHVDAGA WRYQLIRKDG EFRLHNPVKE
1051 QELSDKLGKA EAKKQAEKDN AQSLDALIAA GRDAAEKTES VAEPARXAGG
1101 ENVGIMQAEE EKKRVQADKD SALAKQREAE TRPXTTAFPR ARXARRDLPQ
1151 PQPQPQPQPQ PQRDLXSRYA NSGLSEFSAT LNSVFAVQDE LDRVFAEDRR
1201 NAVWTSXIRX TKHYRSQDFR AYRQQTDLRQ IGMQKNLGSG RVGILFSHNR
1251 TENXFDDGIG NSARLAHGAV FGQYGIGRFD IGISTGAGFS SGXLSDGIGG
1301 KIRRRVLHYG IQARYRAGFG GFGIEPYIGA TRYFVQKADY RYENVNIATP
1351 GLAFNRYRAG IKADYSFKPA QHXSITPYXS LSYTDAASGK VRTRVNTAVL
1401 AQDFGKTRSA EWGVNAEIKG FTLSXHAAAA KGPQLEAQHS AGIKLGYRW*
```

A transmembrane region is underlined.
ORF1-1 (SEQ ID NO: 650) shows 86.3% identity over a
1462aa overlap with ORF1a (SEQ ID NO: 652):

```
                    10         20         30         40         50         60
orf1a.pep   MKTTDKRTTETHRKAPKTGRIRFSPAYLAICLSFGILPQAWAGHTYFGINYQYYRDFAEN
            ||||||||||||||||||||||||||||||||||||||||||||||||||||||||||||
orf1-1      MKTTDKRTTETHRKAPKTGRIRFSPAYLAICLSFGILPQAWAGHTYFGINYQYYRDFAEN
                    10         20         30         40         50         60

70         80         90        100        110        120
orf1a.pep   KGKFAVGAKDIEVYNKKGELVGKSMTKAPMIDFSVVSRNGVAALVGDQYIVSVAHNGGYN
            ||||||||||||||||||||||||||||||||||||||||||||||||||||||||||||
orf1-1      KGKFAVGAKDIEVYNKKGELVGKSMTKAPMIDFSVVSRNGVAALVGDQYIVSVAHNGGYN
                    70         80         90        100        110        120

130        140        150        160        170        179
orf1a.pep   NVDFGAEGXNPDQHRFSYQIVKRNNYKPDNS-HPYNGDXHMPRLHKFVTDAEPVEMTSDM
            |||||||| ||||||| :|:|||||||||   :: |||:|| ||||||||||||||| |
orf1-1      NVDFGAEGRNPDQHRFTYKIVKRNNYKAGTKGHPYGGDYHMPRLHKFVTDAEPVEMTSYM
                   130        140        150        160        170        180

180        190        200        210        220        230
orf1a.pep   RGNTYSDKEKYPERVRIGSGHHYWRYDDDKHGDL--SYSGA----WLIGGNTHMQGWGNN
              |   |:::|:|||||:|::|||  |:|: ::    ||  |   ||:||||  |: :::
orf1-1      DGRKYIDQNNYPDRVRIGAGRQYWRSDEDEPNNRESSYHIASAYSWLVGGNTFAQNGSGG
                   190        200        210        220        230        240

240        250        260        270        280        290
orf1a.pep   GVXSLSGD-VRHANDYGPMPIAGAAGDSGSPMFIYDKTNNKWLLNGVLQTGYPYSGRENG
            |: :|:::  ::|:   || :| :|: ||||||||||  ::|||:||||||| ||  ||
orf1-1      GTVNLGSEKIKHS-PYGFLPTGGSFGDSGSPMFIYDAQKQKWLINGVLQTGNPYIGKSNG
                   250        260        270        280        290

300        310        320        330        340        350
orf1a.pep   FQLIRKDWFYDDIYRGDTHTVXFEPRSNGHFSFTSNNNGTGTVTETNEKVSNP-KLKVQT
            |||:|||||||:| ||||:| :|||:||:|||:::|||| ::  :|: | | :|||::|
orf1-1      FQLVRKDWFYDEIFAGDTHSVFYEPRQNGKYSFNDDNNGTGKINAKHEHNSLPNRLKTRT
                   300        310        320        330        340        350

360        370        380        390        400        410
orf1a.pep   VRLFDESLNETDKEPVY-AAGGVNQYRPRLNNGENLSFIDYGNGKLILSNNINQGAGGLY
            |:||: ||:|| :|||| ||||||:||||||||||:|||:|  |:|:|:|||||||||||
orf1-1      VQLFNVSLSETAREPVYHAAGGVNSYRPRLNNGENISFIDEGKGELILTSNINQGAGGLY
                   360        370        380        390        400        410

420        430        440        450        460        470
orf1a.pep   FEGDFTVSPENNETWQGAGVHISEDSTVTWKVNGVANDRLSKIGKGTLHVQAKGENQGSI
            |:||||||||||||||||||||||||||||||||||||||||||||||||||||||||||
orf1-1      FQGDFTVSPENNETWQGAGVHISEDSTVTWKVNGVANDRLSKIGKGTLHVQAKGENQGSI
                   420        430        440        450        460        470

480        490        500        510        520        530
orf1a.pep   SVGDTVILDQQADDKGKKQAFSEIGLXSGRGTVQLNADNQFNPDKLYFGFRGGRLDLNG
            |||||||||||||||||||||||||||| |||||||||||||||||||||||||||||||
orf1-1      SVGDTVILDQQADDKGKKQAFSEIGLVSGRGTVQLNADNQFNPDKLYFGFRGGRLDLNG
                   480        490        500        510        520        530

540        550        560        570        580        590
orf1a.pep   HSLSFHRIQNTDEGAMIXXHNATTTSTVTITGNESITQPSGKNINRLNYSKEIAYNGWFG
            |||||||||||||||||  ||   ||||||||||::|:  :|:|  | |: :||||||||
orf1-1      HSLSFHRIQNTDEGAMIVNHNQDKESTVTITGNKDIAT-TGNN-NSLDSKKEIAYNGWFG
                   540        550        560        570        580        590

600        610        620        630        640        650
orf1a.pep   EKDTTKTNGRLNLVYQPAAEDRTXLLSGGTNLNGNITQTNGKLFFSGRPTPHAYNHLGSG
            |||||||||||||||||||||||| ||||||||||||||||||||||||||:|||||  :
orf1-1      EKDTTKTNGRLNLVYQPAAEDRTLLLSGGTNLNGNITQTNGKLFFSGRPTPKAYNHLNDH
                   600        610        620        630        640        650

660        670        680        690        700        710
orf1a.pep   WSKMEGIPQGEIVWDNDWIXRTFKAENFHIQGGQAVISRNVAKVEGDXHLSNHAQAVFGV
            ||: ||||:|||||||||||||||||||||:|::||||:||||:| |||||||||||||||
orf1-1      WSQKEGTPRGEIVWDNDWINRTFKAENFQIKGGQAVVSRNVAKVKGDWHLSNHAQAVFGV
                   660        670        680        690        700        710
```

```
                   720       730       740       750       760       770
orf1a.pep  APHQSHTICTRSDWTGLTNCVEXXITDDKVIASLTKTDXSGXVXLXXXXXXXLXGXAXLX
           ||||||||||||||||||||||||:|||||||||||||| || |   |    |:| |:|
orf1-1     APHQSHTICTRSDWTGLTNCVEKTITDDKVIASLTKTDISGNVDLADHAHLNLTGLATLN
                   720       730       740       750       760       770

780       790       800       810       820       830
orf1a.pep  GNLSANGDTRYTVSHNATQNGNLSLVGNAQATFNQATLNGNXSXSGNASFNLSNNAAQNG
           ||||||||||||||||||||||||||||||||||||||||:| ||||||||||::|:|||
orf1-1     GNLSANGDTRYTVSHNATQNGNLSLVGNAQATFNQATLNGNTSASGNASFNLSDHAVQNG
                   780       790       800       810       820       830

840       850       860       870       880       890
orf1a.pep  SLTLSDNAKANVSHSALNGNVSLADKAVFHFENSRFTGQLSGSKXTALHLKDSEWTLPSG
           ||||| ||||||||||||||||||||||||||:|||||:||:| ||||||||||||||||
orf1-1     SLTLSGNAKANVSHSALNGNVSLADKAVFHFESSRFTGQISGGKDTALHLKDSEWTLPSG
                   840       850       860       870       880       890

900       910       920       930       940
orf1a.pep  TELGNLNLDNATITLNSAYRHDAAGAQTGXVSDTPRRRSRRS---LLSVTPPTSVESRFN
           ||||||||||||||||||||||||||||| ::|:|||||||||   ||||||||||||||
orf1-1     TELGNLNLDNATITLNSAYRHDAAGAQTGSATDAPRRRSRRSRRSLLSVTPPTSVESRFN
                   900       910       920       930       940       950

950       960       970       980       990      1000
orf1a.pep  TLTVNGKLNXQGTFPFWSELFGYRSDKLKLAESSEGTYTLAVNNTGNEPVSLDQLTVVEG
           ||||||||| ||||| ||||||||||||||||||||||||||||||||:||:|||||||
orf1-1     TLTVNGKLNGQGTFRFMSELFGYRSDKLKLAESSEGTYTLAVNNTGNEPASLEQLTVVEG
                   960       970       980       990      1000      1010

1010      1020      1030      1040      1050      1060
orf1a.pep  KDNKPLSENLNFTLQNEHVDAGAWRYQLIRKDGEFRLHNPVKEQELSDKLGKAEAKKQAE
           ||||||||||||||||||||||||||||||||||||||||||||||||||||||||||||
orf1-1     KDNKPLSENLNFTLQNEHVDAGAWRYQLIRKDGEFRLHNPVKEQELSDKLGKAEAKKQAE
                  1020      1030      1040      1050      1060      1070

1070      1080      1090      1100      1110      1120
orf1a.pep  KDNAQSLDALIAAGRDAAEKTESVAEPARXAGGENVGIMQAEEEKKRVQADEDSALAKQR
           |||||||||||||||||:|||||||||||| |||||||||||||||||||:| |||||||
orf1-1     KDNAQSLDALIAAGRDAVEKTESVAEPARQAGGENVGIMQAEEEKKRVQADKDTALAKQR
                  1080      1090      1100      1110      1120      1130

1130      1140      1150      1160      1170      1180
orf1a.pep  EAETRPXTTAFPRARXARRDLPQPQPQPQPQPQPQRDLXSRYANSGLSEFSATLNSVFAV
           |||||| ||||||||| |||||||| ||||||||  ||||:|||||||||||||||||||
orf1-1     EAETRPATTAFPRARRARRDLPQLQPQPQPQP--QRDLISRYANSGLSEFSATLNSVFAV
                  1140      1150      1160      1170      1180      1190

1190      1200      1210      1220      1230      1240
orf1a.pep  QDELDRVFAEDRRNAVWTSXIRXTKHYRSQDFRAYRQQTDLRQIGMQKNLGSGRVGILFS
           ||||||||||||||||||| || ||||||||||||||||||||||||||||||||||||
orf1-1     QDELDRVFAEDRRNAVWTSGIRDTKHYRSQDFRAYRQQTDLRQIGMQKNLGSGRVGILFS
                  1200      1210      1220      1230      1240      1250

1250      1260      1270      1280      1290      1300
orf1a.pep  HNRTENXFDDGIGNSARLAHGAVFGQYGIGRFDIGISTGAGFSSGXLSDGIGGKIRRRVL
           ||||||:|||||||||||||||||||||| ||||:|||||||||| ||||||||||||||
orf1-1     HNRTENTFDDGIGNSARLAHGAVFGQYGIDRFYIGISAGAGFSSGSLSDGIGGKIRRRVL
                  1260      1270      1280      1290      1300      1310

1310      1320      1330      1340      1350      1360
orf1a.pep  HYGIQARYRAGFGGFGIEPYIGATRYFVQKADYRYENVNIATPGLAFNRYRAGIKADYSF
           ||||||||||||||||||||:|||||||||||||||||||||||||||||||||||||||
orf1-1     HYGIQARYRAGFGGFGIEPHIGATRYFVQKADYRYENVNIATPGLAFNRYRAGIKADYSF
                  1320      1330      1340      1350      1360      1370

1370      1380      1390      1400      1410      1420
orf1a.pep  KPAQHXSITPYXSLSYTDAASGKVRTRVNTAVLAQDFGKTRSAEWGVNAEIKGFTLSXHA
           ||||| ||||| ||||||||||||||||||||||||||||||||||||||||||||| ||
orf1-1     KPAQHISITPYLSLSYTDAASGKVRTRVNTAVLAQDFGKTRSAEWGVNAEIKGFTLSLHA
                  1380      1390      1400      1410      1420      1430

1430      1440      1450
orf1a.pep  AAAKGPQLEAQHSAGIKLGYRWX
           |||||||||||||||||||||||
orf1-1     AAAKGPQLEAQHSAGIKLGYRWX
                  1440      1450
```

Homology with Adhesion and Penetration Protein Hap Precursor of *H.influenzae* (Accession Number P45387) (SEQ ID NO: 1153)

Amino acids 23–423 of ORF1 (SEQ ID NO: 648) show 59% aa identity with hap protein (SEQ ID NO: 1153) in 450aa overlap:

```
orf1    23 FXAAYLAICLSFGILPQAWAGHTYFGINYQYYRDFAENKGKFAVGAKDIEVYNKKGELVG    82
              F   +L  C+S GI  QAWAGHTYFGI+YQYYRDFAENKGKF VGAK+IEVYNK+G+LVG
hap      6 FRLNFLTACVSLGIASQAWAGHTYFGIDYQYYRDFAENKGKPTVGAKNIEVYNKEGQLYG    65 orf1    83 KSMTKAPMIDFSVVSRNGVAALVGVQYIVSVAHNGGYNNVDFGAEGXNIXDQXRXTYKIV   142
              SMTKAPMIDFSVVSRNGVAALVG QYIVSVAHNGGYN+VDFGAEG N  DQ R TY+IV
hap     66 TSMTKAPMIDFSVVSRNGVAALVGDQYIVSVAHNGGYNDVDFGAEGRN-PDQHRFTYQIV   124 orf1   143 KRNNYKAGTKGHPYGGDYHMPRLHKXVTDAEPVEMTSYMDGRKYIDQNNYPDRVRIGAGR   202
              KRNNY+A   +HPY GDYHMPRLHK VT+AEPV MT+MDG+Y D+NYP+RVRIG+GR
hap    125 KRNNYQAWERKHPYDGDYHMPRLHKFVTEAEPVGMTTNMDGKVYADRENYPERVRIGSGR   184 orf1   203 QYWRSDEDEPNNRESSYHIA----------------------------------------   222
              QYWR+D+DE   N   SSY+++
hap    185 QYWRTDKDEETNVHSSYYVSGAYRYLTAGNTHTQSGNGNGTVNLSGNVVSPHNYGPLPTG   244 orf1   223 -----SGSPMFIYDAQKQKWLINGVLQTGNPYIGKSNGFQLVRKDWFYDEIFAGDTHSVF   277
                   SGSPMFIYDA+K++WLIN VLQTG+P+ G+ NGFQL+R++WFY+E+  A DT SVF
hap    245 GSKGDSGSPMFIYDAKKKQWLINAVLQTGHPFFGRGNGFQLIREEWFYNEVLAVDTPSVF   304 orf1   278 --YEPRQNGKYSFNDDNNGTGKIN-AKHEHNSLPNRLKTRTVQLFNVSLSETAREPVYHA   334
                 Y P  NG YSF +N+GTGK+       +    + +  TV+LFN SL++TA+E V  A
hap    305 QRYIPPINGHYSFVSNNDGTGKLTLTRPSKDGSKAKSEVGTVKLFNPSLNQTAKEHV-KA   363 orf1   335 AGGVNSYRPRLNNGENISFIDEGKGELILTSNINQGAGGLYFQGDFTV-SPENNETWQGA   393
              A G N Y+PR+  G+NI   D+GKG L + +NINQGAGGLYF+G+F V   +NN TWQGA
hap    364 AAGYNIYQPRMEYGKNIYLGDQGKGTLTIENNINQGAGGLYFEGNFVVKGKQNNITWQGA   423 orf1   394 GVHISEDSTVTWKVNGVANDRLSKIGKGTL                                423
              GV  I  +D+TV WKV+   NDRLSKIG GTL
hap    424 GVSIGQDATVEWKVHNPENDRLSKIGIGTL                                453
```

Amino acids 715–1011 of ORF1 (SEQ ID NO: 648) show 50% aa identity with hap protein (SEQ ID NO: 1153) in 258aa overlap:

```
Orf1    41 DTRYTVSHNATQ-NGNXSLVXNAQATFNQ-ATLNGNTSASGNASFNLSDHAVQNGSLTLS    98
              DT+    S  TQ NG+ +L  NA   + A LNGN +    ++ F LS++A Q G++LS
hap    733 DTKVINSIPITQIWGSINLTNNATVNIHGLAKLNGNVTLIDHSQFTLSNNATQTGNIKLS   792 orf1    99 GNAKANVSHSALNGNVSLADKAVFHFESSRFTGQISGGKDTALHLKDSEWTLPSGXELGN   158
              +A A V+++LNGNV L D AF  ++S F  QI G KDT + L+++ WT+PS   L N
hap    793 NHANATVNNATLNGNVHLTDSAQFSLKNSHFWHQIQGDKDTTVTLENATWTMPSDTTLQN   852 orf1   159 LNLDNATITLNSAYRHDAAGAQTGSATDAPXXXXXXXXXXXLLXVTPPTSVESRFNTLTVN   218
              L L+N+T+TLNSAY          + S+ +AP          L   T PTS E RFNTLTVN
hap    853 LTLNNSTVTLNSAY--------SASSNNAPRHRRS-----LETETTPTSAEHRFNTLTVN   899 orf1   219 GKLNGQGTFRFMSELFGYRSDKLKLAESSEGTYTLAVNNTGNEPASLEQLTVVEGKDNKP   278
              GKL+GQGTF+F S LFGY+SDKLKL+  +EG YTL+V NTG EP +LEQLT++E  DNKP
hap    900 GKLSGQGTFQFTSSLFGYKSDKLKLSNDAEGDYTLSVRNTGKEPVTLEQLTLIESLDNKP   959 orf1   279 LSENLNFTLQNEHVDAGA                                            296
              LS+L FTL+N+HVDAGA
hap    960 LSDKLKFTLENDHVDAGA                                            977
```

Amino acids 1192–1450 of ORF1 (SEQ ID NO: 648) show 41% aa identity with hap protein (SEQ ID NO: 1153) in 259aa overlap:

```
Orf1      1 LDRVFAEDRRNAVWTSGIRDTKHYRSQDFRAYRQQTDLRQIGMQKNLGSGRVGILFSHNR    60
               LDR+F +   ++AVWT+  +D + Y S  FRAY+Q+T+LRQIG+QK L +GR+G +FSH+R
hap    1135 LDRLFVDQAQSAVWTNIAQDKRRYDSDAFRAYQQKTNLRQIGVQKALANGRIGAVFSHSR  1194 orf1     61 TENTFDDGIGNSARLAHGAVFGQYGIDRFYXXXXXXXXXXXXXXXXXXIGXKXRRRVLHYG   120
               ++NTFD+ +N A L   + F QY                         K   R+ ++YG
hap    1195 SDNTFDEQVKNHATLTMMSGFAQYQWGDLQFGVNVGTGISASKMAEEQSRKIHRKAINYG  1254
```

```
                            -continued
orf1    121 IQARYRAGFGGFGIEPHIGATRYFVQKADYRYENVNIATPGLAFNRYRAGIKADYSFKPA  180
            + A Y+    G  GI+P+G  RYF+++ +Y+E V + TP LAFNRY AGI+DY+F P
hap    1255 VNASYQFRLGQLGIQPYFGVNRYFIERENYQSEEVRVKTPSLAFNRYNAGIRVDYTFTPT 1314 orf1    181 QHISITPYLSLSYTDAASGKVRTRVNTAVLAQDFGKTRSAEWGVNAEIKGFTLSLHAAAA  240
            +IS+ PY  ++Y D ++  V+T VN  VL Q FG+     E G+AEI  F +S    + +
hap    1315 DNISVKPYFFVNYVDVSNANVQTTVNLTVLQQPFGRYWQKEVGLKAEILHFQISAFISKS 1374 orf1    241 KGPQLEAQHSAGIKLGYRW                                           259
            +G QL   Q +G+KLGYRW
hap    1375 QGSQLGKQQNVGVLLGYRW                                          1393
```

Homology with a Predicted ORF from *N.gonorrhoeae*

The blocks of ORF1 (SEQ ID NO: 648) show 83.5%, 88.3%, and 97.7% identities in 467, 298, and 259 aa overlap, respectively with a predicted ORF (ORF1ng) (SEQ ID NO: 654) from *N.gonorrhoeae*:

```
orf1.pep MKTTDKRTTETHRKAPKTGRIRFXAAYLAICLSFGILPQAWAGHTYFGINYQYYRDFAEN   60
         |||||||||||||||||||||||| ||||||||||||| |||||||||||||||||||||
orf1ng   MKTTDKRTTETHRKAPKTGRIRFSPAYLAICLSFGILPQARAGHTYFGINYQYYRDFAEN   60 orf1.pep KGKFAVGAKDIEVYNNKGELVGKSMTKAPMIDFSVVSRNGVAALVGVQYIVSVAHNGGYN  120
         ||||||||||||||||:|||||||||||||||||||||||||||:| |||||||||||||
orf1ng   KGKFAVGAKDIEVYNKKGELVGKSMTKAPMIDFSVVSRNGVAALAGDQYIVSVAHNGGYN  120 orf1.pep NVDFGAEGXNIXDQXRXTYKIVKRNNYKAGTKGHPYGGDYHMPRLHKXVTDAEPVEMTSY  180
         ||||||||  |  ||  :|:||||||||||||:|||||||||||||| ||||||||||||
orf1ng   NVDFGAEGSN-PDQHRFSYQIVKRNNYKAGTNGHPYGGDYHMPRLHKFVTDAEPVEMTSY  179 orf1.pep MDGRKYIDQNNYPDRVRIGAGRQYWRSDEDEPNNRESSYHIAS------------------  223
         ||| || | |:|||||||||||||||||||||||||||||||
orf1ng   MDGWKYADLNKYPDRVRIGAGRQYWRSDEDEPNNRESSYHIASAYSWLVGGNTFAQNGSG  239 orf1.pep ---------------------------GSPMFIYDAQKQKWLINGVLQTGNPYIGKSNG  255
                                    ||||||||||||||||||||||||||||||||
orf1ng   GGTVNLGSEKIKHSPYGFLPTGGSFGDSGSPMFIYDAQKQKWLINGVLQTGNPYIGKSNG  289 orf1.pep FQLVRKDWFYDEIFAGDTHSVFYEPRQNGKYSFNDDNNGTFKINAKHEHNSLPNRLKTRT  315
         |||||||||||||||||||||||||:||||   |||:||| ||:|||:| ||| ||||||
orf1ng   FQLVRKDWFYDEIFAGDTHSVFYEPHQNGKYFFNDNNNGAGKIDAKHKHYSLPYRLKTRT  359 orf1.pep VQLFNVSLSETAREPVYHAAGGVNSYRPRLNNGENISFIDEGKGELILTSNINQGAGGLY  375
         ||||||||||||||||||||||||||||||||||||||||:|||||||||||||||||||
orf1ng   VQLFNVSLSETAREPVYHAAGGVNSYRPRLNNGENISFIDKGKGELILTSNINQGAGGLY orf1.pep FQGDFTVSPENNETWQGAGVHISEDSTVTWKVNGVANDRLSKIGKGT               422
         |:|:|||||:||||||||||||||:  ||||||||||||||||||||
orf1ng   FEGNFTVSPKNNETWQGAGVHISDGSTVTWKVNGVANDRLSKIGKGTLLVQAKGENQGSV  479

// orf1.pep                           DKVTASLTKTDISGNVDLADHAHLNLTGLA  744
                                   ||||||:|||: |||:|||||||||||||
orf1ng   FGVAPHQSHTICTRSDWTGLTSCTEKTITDDKVIASLSKTDVRGNVSLADHANLNLTGLA  774 orf1.pep TLNGNLSANGDTR-YTVSHNATQNGNXSLVXNAQATFNQATLNGNTSASGNASFNLSDHA  803
         |:||||  ::::||    :  |||||| ||| |||||||||||||||||| |||||||::|
orf1ng   TFNGNL-VQAETRTIRLRANATQNGNLSLVGNAQATFNQATLNGNTSASDNASFNLSNNA  833 orf1.pep VQNGSLTLSGNAKANVSHSALNGNVSLADKAVFHFESSRFTGQISGGKDTALHLKDSEWT  863
         ||||||||||  ||||||||||||||||||||||||||:|||||:|||||||||||||||
orf1ng   VQNGSLTLSDNAKANVSHSALNGNVSLADKAVFHFENSRFTGKISGGKDTALHLKDSEWT  893 orf1.pep LPSGXELGNLNLDNATITLNSAYRHDAAGAQTGSATDAPRRRSRRSRRSLLXVTPPTSVE  923
         ||||:|||||||||||||||||||||||||||||:|||||||||||||   |||||||:|
orf1ng   LPSGTELGNLNLDNATITLNSAYRHDAAGAQTGSAADAPRRRSRRS---LLSVTPPTSAE  950 orf1.pep SRFNTLTVNGKLNGQGTPRFMSELFGYRSDKLKLAESSEGTYTLAVNNTGNEPASLEQLT  983
         |||||||||||||||||| |||||||||||:|||||||||||||||||||||||:||||
orf1ng   SRFNTLTVNGKLNGQGTFRFMSELFGYRSGKLKLAESSEGTYTLAVNNTGNEPVSLEQLT 1010
```

```
                                                                     -continued
orf1.pep VVEGKDNKPLSENLNFTLQNEHVDAGAW                                          1011
         |||||||  ||||||||||||||||||
orf1ng   VVEGKDNTPLSENLNFTLQNEHVDAGAWRYQLIRKDGEFRLMNPVKEQELSDKLGKAGET 1070

// orf1.pep                            LDRVFAEDRRNAVWTSGIRDTKHYRSQDFR 1211
                                    ||||||||||||||||||||||||||||||
orf1ng   PQRDLISRYANSGLSEFSATLNSVFAVQDELDRVFAEDRRNAVWTSGIRDTKHYRSQDFR 1239 orf1.pep AYRQQTDLRQIGMQKNLGSGRVGILFSHNRTENTFDDGIGNSARLAHGAVFGQYGIDRFY 1271
         |||||||||||||||||||||||||||||| ||||||||||||||||||||||||| ||
orf1ng   AYRQQTDLRQIGMQKNLGSGRVGILFSHNRTGNTFDDGIGNSARLAHGAVFGQYGIGRFD 1299 orf1.pep IGISAGAGFSSGSLSDGIGXKXRRRVLHYGIQARYRAGFGGFGIEPHIGATRYFVQKADY 1331
         |||||||||||||||||||  | ||||||||||||||||||||||||||||||||||||
orf1ng   IGISAGAGFSSGSLSDGIRGKIRRRVLHYGIQARYRAGFGGFGIEPHIGATRYFVQKADY 1359 orf1.pep RYENVNIATPGLAFNRYRAGIKADYSFKPAQHISITPYLSLSYTDAASGKVRTRVNTAVL 1391
         ||||||||||||||||||||||||||||||||||||||||||||||||||||||||||||
orf1ng   RYENVNIATPGLAFNRYRAGIKADYSFKPAQHISITPYLSLSYTDAASGKVRTRVNTAVL 1419 orf1.pep AQDFGKTRSAEWGVNAEIKGFTLSLHAAAKGPQLEAQHSAGIKLGYRW              1440
         ||||||||||||||||||||||||||||||||||||||||||||||||
orf1ng   AQDFGKTRSAEWGVNAEIKGFTLSLHAAAKGPQLEAQHSAGIKLGYRW              1468
```

The complete length ORF1ng nucleotide sequence was identified (SEQ ID NO: 653):

```
   1  ATGAAAACAA CCGACAAACG GACAACCGAA ACACACCGCA AAGCCCCTAA
  51  AACCGGCCGC ATCCGCTTCT CGCCCGCTTA CTTAGCCATA TGCCTGTCGT
 101  TCGGCATTCT GCCCCAAGCC CGGGCGGGAC ACACTTATTI CGGCATCAAC
 151  TACCAATACT ATCGCGACTT TGCCGAAAAT AAAGGCAAGT TTGCAGTCGG
 201  GGCGAAAGAT ATTGAGGTTT ACAACAAAAA AGGGGAGTTG GTCGGCAAAT
 251  CGATGACGAA AGCCCCGATG ATTGATTTTT CTGTGGTATC GCGTAACGGC
 301  GTGGCGGCAT TGGCGGGCGA TCAATATATT GTGAGCGTGG CACATAACGG
 351  CGGCTATAAC AATGTTGATT TTGGTGCGGA GGGAAGCAAT CCCGATCAGC
 401  ACCGCTTTTC TTACCAAATT GTGAAAAGAA ATAATTATAA AGCAGGGACT
 451  AACGGCCATC CTTATGGCGG CGATTATCAT ATGCCGCGTT TGCACAAATT
 501  TGTCACAGAT GCAGAACCTG TTGAGATGAC CAGTTATATG GATGGGTGGA
 551  AATACGCTGA TTTAAATAAA TACCCTGATC GTGTTCGAAT CGGAGCAGGC
 601  AGACAATATT GGCGGTCTGA TGAAGACGAA CCCAATAACC GCGAAAGTTC
 651  ATATCATATT GCAAGCGCAT ATTCTTGGCT CGTCGGTGGC AATACCTTTG
 701  CACAAAATGG ATCAGGTGGT GGCACAGTCA ACTTAGGTAG CGAAAAAATT
 751  AAACATAGCC CATATGGTTT TTTACCAACA GGAGGCTCAT TTGGCGACAG
 801  TGGCTCACCA ATGTTTATCT ATGATGCCCA AAAGCAAAAG TGGTTAATTA
 851  ATGGGTATT GCAAACAGGC AACCCCTATA TAGGAAAAAG CAATGGCTTC
 901  CAGCTAGTTC GTAAAGATTG GTTCTATGAT GAAATCTTTG CTGGAGATAC
 951  CCATTCAGTA TTCTACGAAC CACATCAAAA TGGGAAATAC TTTTTTAACG
1001  ACAATAATAA TGGCGCAGGA AAAATCGATG CCAAACATAA ACACTATTCT
1051  CTACCTTATA GATTAAAAAC ACGAACCGTT CAATTGTTTA ATGTTTCTTT
1101  ATCCGAGACA GCAAGAGAAC CTGTTTATCA TGCTGCAGGT GGGGTCAACA
```

```
                     -continued
1151    GTTATCGACC CAGACTGAAT AATGGAGAAA ATATTTCCTT TATTGACAAA

1201    GGAAAAGGTG AATTGATACT TACCAGCAAC ATCAACCAAG GCGCGGGCGG

1251    TTTGTATTTT GAGGGTAATT TTACGGTCTC GCCTAAAAAC AACGAAACGT

1301    GGCAAGGCGC GGGCGTTCAT ATCAGTGATG GCAGTACCGT TACTTGGAAA

1351    GTAAACGGCG TGGCAAACGA CCGCCTGTCC AAAATCGGCA AAGGCACGCT

1401    GCTGGTTCAA GCCAAAGGGG AAAACCAAGG CTCGGTCAGC GTGGGCGACG

1451    GTAAAGTCAT CTTAGATCAG CAGGCGGACG ATCAAGGCAA AAAACAAGCC

1501    TTTAGTGAAA TCGGCTTGGT CAGCGGCAGG GGGACGGTGC AACTGAATGC

1551    CGATAATCAG TTCAACCCCG ACAAACTCTA TTTCGGCTTT CGCGGCGGAC

1601    GTTTGGATTT GAACGGGCAT TCGCTTTCGT TCCACCGCAT TCAAAATACC

1651    GATGAAGGGG CGATGATTGT CAACCACAAT CAAGACAAAG AATCCACCGT

1701    TACCATTACA GGCAATAAAG ATATTACTAC AACCGGCAAT AACAACAACT

1751    TGGATAGCAA AAAAGAAATT GCCTACAACG GTTGGTTTGG CGAGAAAGAT

1801    GCAACCAAAA CGAACGGGCG GCTCAATCTG AATTACCAAC CGGAAGAAGC

1851    GGATCGCACT TTACTGCTTT CCGGCGGAAC AAATTTAAAC GGCAATATCA

1901    CGCAAACAAA CGGCAAACTG TTTTTCAGCG GCAGACCGAC ACCGCACGCC

1951    TACAATCATT TAGGAAGCGG GTGGTCAAAA ATGGAAGGTA TCCCACAAGG

2001    AGAAATCGTG TGGGACAACG ATTGGATCGA CCGCACATTT AAAGCGGAAA

2051    ACTTCCATAT TCAGGGCGGA CAAGCGGTGG TTTCCCGCAA TGTTGCCAAA

2101    GTGGAAGGCG ATTGGCATTT AAGCAATCAC GCCCAAGCAG TTTTCGGTGT

2151    CGCACCGCAT CAAAGCCACA CAATCTGTAC ACGTTCGGAC TGGACGGGTC

2201    TGACAAGTTG TACCGAAAAA ACCATTACCG ACGATAAAGT GATTGCTTCA

2251    TTGAGCAAGA CCGACATCAG AGGCAATGTC AGCCTTGCCG ATCACGCTCA

2301    TTTAAATCTC ACAGGACTTG CCACACTCAA CGGCAATCTT AGTGCAGGCG

2351    GAGACACGCA CTATACGGTT ACGCGCAACC CCACCCAAAA CGGCAACCTC

2401    AGCCTCGTGG GCAATGCCCA AGCAACATTT AATCAAGCCA CATTAAACGG

2451    CAACACATCG GCTTCGGACA ATGCTTCATT TAATCTAAGC AACAACGCCG

2503    TACAAAACGG CAGTCTGACG CTTTCCGACA ACGCTAAGGC AAACGTAAGC

2551    CATTCCGCAC TCAACGGCAA TGTCTCCCTA GCCGATAAGG CAGTATTCCA

2601    TTTTGAAAAC AGCCGCTTTA CCGGAAAAAT CAGCGGCGGC AAGGATACGG

2651    CATTACACTT AAAAGACAGC GAATGGACGC TGCCGTCGGG CACGGAATTA

2701    GGCAATTTAA ACCTTGACAA CGCCACCATT ACACTCAATT CCGCCTATCG

2751    ACACGATGCG GCAGGCGCGC AAACCGGCAG TGCGGCAGAT GCGCCGCGCC

2801    GCCGTTCGCG CCGTTCCCTA TTATCCGTTA CGCCGCCAAC TTCGGCAGAA

2851    TCCCGTTTCA ACACGCTGAC GGTAAACGGC AAATTGAACG GTCAGGGAAC

2901    ATTCCGCTTT ATGTCGGAAC TCTTCGGCTA CCGCAGCGGC AAATTGAAGC

2951    TGGCGGAAAG TTCCGAAGGC ACTTACACCT TGGCTGTCAA CAATACCGGC

3001    AACGAACCCG TAAGTCTCGA GCAATTGACG GTAGTGGAAG GAAAAGACAA

3051    CACACCGCTG TCCGAAAATC TTAATTTCAC CCTGCaaaAc gaacacgtcg 3101    atgccggcgc atggCGTTAT CAGCTTATCC gcaaagacgG CGAGTTCCgc
```

```
                    -continued
3151    CTGCATAATC CGGTCAAAGA ACAAGAGCTT TCCGACAAAC TCGGCAAGgc 3201    gggagaaACA GAggccgccT TGACGGCAAA ACAGGCacaA CTTGCCGCCA 3251    AAcaacaggc ggaaaAAGAC AACgcgcaaa gecttgAcgc gctgattgcg 3301    gCcgggcgca atgccaccga AAAGGCAgaa agtgttgccg aaccgGCCCG 3351    GCAGGCAGGC GGGGAAAAtg cCgGCATTAT GCAGGCGGAG GAAGAGAAAA

3401    AACGGGTGCA GGCGGATAAA GACACCGCCT TGGCGAAACA GCGCGAAGCG

3451    GAAACCCGGC CGGCTACCAC CGCCTTCCCC CGCGCCCGCC GCGCCCGCCG

3501    GGATTTGCCG CAACCGCAGC CCCAACCGCA ACCCCAACCG CAGCGCGACC

3551    TGATCAGCCG TTATGCCAAT AGCGGTTTGA GTGAATTTTC CGCCACGCTC

3601    AACAGCGTTT TCGCCGTACA GGACGAATTG GACCGCGTGT TTGCCGAAGA

3651    CCGCCGCAAC GCCGTTTGGA CAAGCGGCAT CCGGGACACC AAACACTACC

3701    GTTCGCAAGA TTTCGCGCC TACCGCCAAC AAACCGACCT GCGCCAAATC

3751    GGTATGCAGA AAAACCTCGG CAGCGGGCGC GTCGGCATCC TGTTTTCGCA

3801    CAACCGGACC GGAAACACCT TCGACGACGG CATCGGCAAC TCGGCACGGC

3851    TTGCCCACGG TGCCGTTTTC GGGCAATACG GCATCGGCAG GTTCGACATC

3901    GGCATCAGCG CGGGCGCGGG TTTTAGTAGC GGCAGCCTTT CAGACCGCAT

3951    CAGAGGCAAA ATCCGCCGCC GCGTGCTGCA TTACGGCATT CAGGCAAGAT

4001    ACCGCGCAGG TTTCGGCGGA TTCGGCATCG AACCGCACAT CGGCGCAACG

4051    CGCTATTTCG TCCAAAAAGC GGATTACCGA TACGAAAACG TCAATATCGC

4101    CACCCCGGGC CTTGCATTCA ACCGCTACCG CGCGGGCATT AAGGCAGATT

4151    ATTCATTCAA ACCGGCGCAA CACATTTCCA TCACGCCTTA TTTGAGCCTG

4201    TCCTATACCG ATGCCGCTTC CGGCAAAGTC CGAACGCGCG TCAATACCGC

4251    CGTATTGGCG CAGGATTTCG GCAAAACCCG CAGTGCGGAA TGGGGCGTAA

4301    ACGCCGAAAT CAAAGGTTTC ACGCTGTCCC TCCACGCTGC CGCCGCCAAG

4351    GGGCCGCAAT GGAAGCGCA GCACAGCGCG GGCATCAAAT TAGGCTACCG

4401    CTGGTAA
```

This is predicted to encode a protein having amino acid sequence (SEQ ID NO: 654):

```
  1    MKTTDKRTTE THRKAPKTGR IRFSPAYLAI CLSFGILPQA RAGHTYFGIN

51    YQYYRDFAEN KGKFAVGAKD IEVYNKKGEL VGKSMTKAPM IDFSVVSRNG

101    VAALAGDQYI VSVAHNGGYN NVDFGAEGSN PDQHRFSYQI VKRNNYKAGT

151    NGHPYGGDYH MPRLHKFVTD AEPVEMTSYM DGWKYADLNK YPDRVRIGAG

201    RQYWRSDEDE PNNRESSYHI ASAYSWLVGG NTFAQNGSGG GTVNLGSEKI

251    KHSPYGFLPT GGSFGDSGSP MFIYDAQKQK WLINGVLQTG NPYIGKSNGF

301    QLVPKDWFYD EIFAGDTHSV FYEPHQNGKY FFNDNNNGAG KIDAKHKHYS

351    LPYRLKTRTV QLFNVSLSET AREPVYRAAG GVNSYRPRLN NGENISFIDK

401    GKGELILTSN INQGAGGLYF EGNFTVSPKN NETWQGAGVH ISDGSTVTWK

451    VNGVANDRLS KIGKGTLLVQ AKGENQGSVS VGDGKVILDQ QADDQGKKQA

501    FSEIGLVSGR GTVQLNADNQ FNPDKLYFGF RGGRLDLNGM SLSFHRIQNT
```

-continued

```
 551   DEGAMIVNHN  QDKESTVTIT  GNKDITTTGN  NNNLDSKKEI  AYNGWFGEKD

601   ATKTNGGLNL  NYPPEEADRT  LLLSGGTNLN  GNITQTNGKL  FFSGRPTPHA

651   YNHLGSGWSK  MEGIPQGEIV  WDNDWIDRTF  KAENFHIQGG  QAVVSRNVAK

701   VEGDWHLSNH  AQAVFGVAPH  QSHTICTRSD  WTGLTSCTEK  TITDDKVIAS

751   LSKTDVRGNV  SLADHAHLNL  TGLATFNGNL  VQAETRTIRL  RANATQNGNL

801   SLVGNAQATF  NQATLNGNTS  ASDNASFNLS  NNAVQNGSLT  LSDNAKANVS

851   HSALNGNVSL  ADKAVFHFEN  SRFTGKISGG  KDTALHLKDS  EWTLPSGTEL

901   GNLNLDNATI  TLNSAYRMDA  AGAQTGSAAD  APRRRSRRSL  LSVTPPTSAE

951   SRFNTLTVNG  KLNGQGTFRF  MSELFGYRSG  KLKLAESSEG  TYTLAVNNTG

1001   NEPVSLEQLT  VVEGKDNTPL  SENLNFTLQN  EHVDAGAWRY  QLIRKDGEFR

1051   LHNPVKEQEL  SDKLGKAGET  EAALTAKQAQ  LAAKQQAEKD  NAQSLDALIA

1101   AGRNATEKAE  SVAEPARQAG  GENAGIMQAE  EEKKRVQADK  DTALAKQREA

1151   ETRPATTAFP  RARRARRDLP  QPQPQPQPQP  QRDLISRYAN  SGLSEFSATL

1201   NSVFAVQDEL  DRVFAEDRRN  AVWTSGIRDT  KHYRSQDFRA  YRQQTDLRQI

1251   GMQKNLGSGR  VGILFSHNRT  GNTFDDGIGN  SARLAHGAVF  GQYGIGRFDI

1301   GISAGAGFSS  GSLSDGIRGK  IRRRVLHYGI  QARYRAGFGG  FGIEPHIGAT

1351   RYFVQKADYR  YENVNIATPG  LAFNRYRAGI  KADYSFKPAQ  HISITPYLSL

1401   SYTDAASGKV  RTRVNTAVLA  QDFGKTRSAE  WGVNAEIKGF  TLSLHAAAAK

1451   GPQLEAQHSA  GIKLGYRW*
```

Underlined and double-underlined sequences represent the active site of a serine protease (trypsin family) and an ATP/GTP-binding site motif A (P-loop).

ORF1-1 (SEQ ID NO: 650) and ORF1ng (SEQ ID NO: 654) show 93.7% identity in 1471 aa overlap:

```
                    10         20         30         40         50         60
orf1-1.pep  MKTTDKRTTETHRKAPKTGRIRFSPQYLAICLSFGILPQAWAGHTYFGINYQYYRDFAEN
            |||||||||||||||||||||||||| |||||||||||| |||||||||||||||||||
orf1ng-1    MKTTDKRTTETHRKAPKTGRIRFSPAYLAICLSFGILPQARAGHTYFGINYQYYRDFAEN
                    10         20         30         40         50         60

70         80         90        100        110        120
orf1-1.pep  KGKFAVGAKDIEVYNKKGELVGKSMTKAPMIDFSVVSRNGVAALVGDQYIVSVAHNGGYN
            |||||||||||||||||||||||||||||||||||||||||||:||||||||||||||||
orf1ng-1    KGKFAVGAKDIEVYNKKGELVGKSMTKAPMIDFSVVSRNGVAALAGDQYIVSVAHNGGYN
                    70         80         90        100        110        120

130        140        150        160        170        180
orf1-1.pep  NVDFGAEGRNPDQHRFTYKIVKRNNYKAGTKGHPYGGDYHMPRLHKFVTDAEPVEMTSYM
            ||||||||| ||||||::|:|||||||||||:||||||||||||||::||||||||||||
orf1ng-1    NVDFGAEGSNPDQHRFSYQIVKRNNYKAGTNGHPYGGDYHMPRLHKVVTDAEPVEMTSYM
                   130        140        150        160        170        180

190        200        210        220        230        240
orf1-1.pep  DGRKYIDQNNYPDRVRIGAGRQYWRSDEDEPNNRESSYHIASAYSWLVGGNTPAQNGSGG
            || || | |:||||||||||||||||||||||||||||||||||||||||||||||||||
orf1ng-1    DGWKYADLNKYPDRVRIGAGRQYWRSDEDEPNNRESSYHIASAYSWLVGGNTPAQNGSGG
                   190        200        210        220        230        240

250        260        270        280        290        300
orf1-1.pep  GTVNLGSEKIKHSPYGFLPTGGSFGDSGSPMFIYDAQKQKWLINGVLQTGNPYIGKSNGF
            ||||||||||||||||||||||||||||||||||||||||||||||||||||||||||||
orf1ng-1    GTVNLGSEKIKHSPYGFLPTGGSFGDSGSPMFIYDAQKQKWLINGVLQTGNPYIGKSNGF
                   250        260        270        280        290        300
```

-continued

```
              310        320        330        340        350        360
orf1-1.pep    QLVRKDWFYDEIFAGDTHSVFYEPRQNGKYSFNDDNNGTGKINAKHEHNSLPNRLKTRTV
              ||||||||||||||||||||||||||:|||||||:|||:|||:||:||||||||||||||
orf1ng-1      QLVRKDWFYDEIFAGDTHSVFYEPMQNGKYFFNDNNNGAGKIDAKHKHYSLPYRLKTRTV
              310        320        330        340        350        360

370        380        390        400        410        420
orf1-1.pep    QLFNVSLSETAREPVYHAAGGVNSYRPRLNNGENISFIDEGKGELILTSNINQGAGGLYF
              |||||||||||||||||||||||||||||||||||:||||||||||||||||||||||||
orf1ng-1      QLFNVSLSETAREPVYHAAGGVNSYRPRLNNGENISFIDKGKGELILTSNINQGAGGLYF
              370        380        390        400        410        420

430        440        450        460        470        480
orf1-1.pep    QGDFTVSPENNETWQGAGVHISEDSTVTWKVNGVANDRLSKIGKGTLHVQAKGENQGSIS
              :|:|||||:|||||||||||||||:|||||||||||||||||||||||:|||||||||:|
orf1ng-1      EGNPTVSPKNNETWQGAGVHISDGSTVTWKVNGVANDRLSKIGKGTLLVQAKGENQGSVS
              430        440        450        460        470        480

490        500        510        520        530        540
orf1-1.pep    VGDGTVILDQQADDKGKKQAFSEIGLVSGRGTVQLNADNQFNPDKLYPGFRGGRLDLNGH
              ||||:||||||||||:||||||||||||||||||||||||||||||||:|||||||||||
orf1ng-1      VGDGKVILDQQADDQGKKQAFSEIGLVSGRGTVQLNADNQFNPDKLYFGFRGGRLDLNGH
              490        500        510        520        530        540

550        560        570        580        590        600
orf1-1.pep    SLSPHRIQNTDEGAMIVNHNQDKESTVTITGNKDIATTGNNNSLDSKKEIAYNGWFGEKD
              |||||||||||||||||||||||||||||||||||:||||:|||||||||||||||||||
orf1ng-1      SLSPHRIQNTDEGAMIVNHNQDKESTVTITGNKDITTTGNNNNLDSKKEIAYNGWFGEKD
              550        560        570        580        590        600

610        620        630        640        650        660
orf1-1.pep    TTKTNGRLNLVYQPAAEDRTLLLSGGTNLNGNITQTNGKLFFSGRPTPHAYNHLNDHWSQ
              :|||||||||||:|||:|||||||||||||||||||||||||||||||||||||||::||:
orf1ng-1      ATKTNGRLNLNYQPEEADRTLLLSGGTNLNGNITQTNGKLFFSGRPTPHAYNHLGSGWSK
              610        620        630        640        650        660

670        680        690        700        710        720
orf1-1.pep    KEGIPRGEIVWDNDWINRTFKAENFQIKGGQAVVSRNVAKVKGDWHLSNHAQAVFGVAPH
              ||||:|||||||||||:||||||||:|:|||||||||||||:||||||||||||||||||
orf1ng-1      MEGIPQGEIVWDNDWIDRTFKAENFHIQGGQAVVSRNVAKVEGDWHLSNHAQAVFGVAPH
              670        680        690        700        710        720

730        740        750        760        770        780
orf1-1.pep    QSHICGTRSDWTGLTNCVEKTITDDKVIASLTKTDISGNVDLADHAHLNLTGLATLNGNL
              ||||:|:|||||||||:|:|||||||||||:|||||:|||||||||||||||||||||||
orf1ng-1      QSHTICTRSDWTGLTSCTEKTITDDKVIASLSKTDIRGNVSLADHAHLNLTGLATLNGNL
              730        740        750        760        770        780

790        800        810        820        830        840
orf1-1.pep    SANGDTRYTVSHNATQNGNLSLVGNAQATFNQATLNGNTSASGNASFNLSDHAVQNGSLT
              ||:|||:|||:::||||||||||||||||||||||||||||:||||||||::|||:||||
orf1ng-1      SAGGDTHYTVTRNATQNGNLSLVGNAQATFNQATLNGNTSASDNASFNLSNNAVQNGSLT
              790        800        810        820        830        840

850        860        870        880        890        900
orf1-1.pep    LSGNAKAWVSHSALNGNVSIADKAVFHFESSRFTGQISGGKDTALHLKDSEWTLPSGTEL
              ||:||||||||||||||||:|||||||||:||||:|||||||||||||||||||||||||
orf1ng-1      LSDNAKAWVSHSALNGNVSLADKAVFHFENSRFTGKISGGKDTALHLKDSEWTLPSGTEL
              850        860        870        880        890        900

910        920        930        940        950        960
orf1-1.pep    GNLNLDNATITLNSAYRHDAAGAQTGSATDAPRRRSRRSRRSLLSVTPPTSVESRFNTLT
              ||||||||||||||||||||||||||:|||||||||||   ||||||||||:||||||||
orf1ng-1      GNLNLDNATITLNSAYRHDAAGAQTGSAADAPRRRSR---RSLLSVTPPTSAESRFNTLT
              910        920        930        940        950

970        980        990       1000       1010       1020
orf1-1.pep    VNGKLNGQGTFRFMSELFGYRSDKLKLAESSEGTYTLAVNNTGNEPASLEQLTVVEGKDN
              ||||||||||||||||||||||:|||||||||||||||||||||||:|||||||||||||
orf1ng-1      VNGKLNGQGTFRFMSELFGYRSGKLKLAESSEGTYTLAVNNTGNEPVSLEQLTVVEGKDN
              960        970        980        990       1000       1010

1030       1040       1050       1060       1070
orf1-1.pep    KPLSENLNFTLQNEHVDAGAWRYQLIRKDGEFRLHNPVKEQELSDKLGKA----------
              |||||||||||||||||||||||||||||||||||||||||||||||||
orf1ng-1      TPLSENLNFTLQNEHVDAGAWRYQLIRKDGEFRLHNPVKEQELSDKLGKAGETEAALTAK
              1020       1030       1040       1050       1060       1070
```

-continued

```
              1080      1090      1100      1110      1120
orf1-1.pep    ----EAKKQAEKDNAQSLDALIAAGRDAVEKTRSVAEPARQAGGRNVGXMQAEEEKKRVQ
                  ||:||||||||||||||||||:|:||:||||||||||||:||||||||||||
orf1ng-1      QAQLAAKQQAEKDNAQSLDALIAAGRNATEKAESVAEPARQAGGENAGXMQAEEEKKRVQ
              1080      1090      1100      1110      1120      1130

1130      1140      1150      1160      1170      1180
orf1-1.pep    ADKDTALAKQREAETRPATTAFPRARRARRDLPQLQPQPQPQPQRDLXSRYANSGLSEFS
              |||||||||||||||||||||||||||||||| ||||||||||||||||||||||||||
orf1ng-1      ADKDTALAKQREAETRPATTAFPRARRARRDLPQPQPQPQPQPQRDLXSRYANSGLSEFS
              1140      1150      1160      1170      1180      1190

1190      1200      1210      1220      1230      1240
orf1-1.pep    ATLNSVFAVQDELDRVFAEDRRNAVWTSGIRDTKHTRSQDFRAYRQQTDLRQICMQKNLG
              |||||||||||||||||||||||||||||||||| |||||||||||||||||||||||
orf1ng-1      ATLNSVFAVQDELDRVFAEDRRNAVWTSGIRDTKHYRSQDFRAYRQQTDLRQICMQKNLG
              1200      1210      1220      1230      1240      1250

1250      1260      1270      1280      1290      1300
orf1-1.pep    SGRVGILFSHNRTENTFDDGIGNSARLAHGAVFGQYGIDRFYIGISAGAGFSSGSLSDGI
              |||||||||||||| ||||||||||||||||||||| ||| |||||||||||||||||
orf1ng-1      SGRVGILFSHNRTGNTFDDGIGNSARLAHGAVFGQYGIGRFDIGISAGAGFSSGSLSDGI
              1260      1270      1280      1290      1300      1310

1310      1320      1330      1340      1350      1360
orf1-1.pep    GGKIRRRVLMYGIQARYRAGFGGFGIEPHIGATRYFVQKADYRYENVNIATPGLAFNRYR
               |||||||||||||||||||||||||||||||||||||||||||||||||||||||||
orf1ng-1      RGKIRRRVLMYGIQARYRAGFGGFGIEPHIGATRYFVQKADYRYENVNIATPGLAFNRYR
              1320      1330      1340      1350      1360      1370

1370      1380      1390      1400      1410      1420
orf1-1.pep    AGIKADYSFKPAQHISITPYLSLSYTDAASGKVRTRVNTAVLAQDFGKTRSAEWGVNAEI
              ||||||||||||||||||||||||||||||||||||||||||||||||||||||||||
orf1ng-1      AGIKADYSFKPAQHISITPYLSLSYTDAASGKVRTRVNTAVLAQDFGKTRSAEWGVNAEI
              1380      1390      1400      1410      1420      1430

1430      1440      1450
orf1-1.pep    KGFTLSLHAAAAKGPQLEAQHSAGIKLGYRWX
              ||||||||||||||||||||||||||||||||
orf1ng-1      KGFTLSLHAAAAKGPQLEAQHSAGIKLGYRWX
              1440      1450      1460
```

In addition, ORF1ng (SEQ ID NO: 654) shows 55.7% identity with hap protein (P45387) (SEQ ID NO: 1153) over a 1455aa overlap:

SCORES Init1: 1104 Initn: 4632 Opt: 2680
Smith-Waterman score: 5165; 55.7% identity in 1455 aa overlap

```
                     10        20        30        40        50        60
orf1ng-1.pep  MKTTDKRTTETHRKAPKTGRIRFSPAYLAICLSFGILPQARAGHTYFGINYQYYRDFAEN
              |    :|: |:|:||: ||  ||||||||||:||||||||
p45387              MKKTVFRLNFLTACISLGIVSQAWAGHTYFGIDYQYYRDFAEN
                           10        20        30        40

70        80        90       100       110       120
orf1ng-1.pep  KGKFAVGAKDIEVYNKKGELVGKSMTKAPMIDFSVVSRNGVAALAGDQYIVSVAHNGGYN
              ||||:||::|:||||:|| ||:|||||||||||||||||||| : |||||||||| ||:
p45387        KGKFTVGAQNIKVYNKQGQLVGTSMTKAPMIDFSVVSRNGVAALVENQYIVSVAHNVGYT
                    50        60        70        80        90       100

130       140       150       160       170       180
orf1ng-1.pep  NVDFGAEGSNPDQHRFSYQIVKRNNYKAGTNGHPYGGDYHMPRLHKFVTDAEPVEMTSYM
              :|||||||:||||||||:|:||||||| |   |||  || ||||||||:|::||| |
p45387        DVDFGAEGNNPDQHRFTYKIVKRNNYKD-NLHPYEDDYHNPRLHKFVTEAAPIDMTSNM
                   110       120       130       140       150       160

190       200       210       220       230       240
orf1ng-1.pep  DGWKYADLNKYPDRVRIGAGRQYWRSDEDEPNNRESSYHIASAYSWLVGGNTFAQNGSGG
              :|  |:|  :||||||||:||||||||:|:|:: :    ::|:||  |:::|||   |:
p45387        NGSTYSDRTKYPERVRIGSGRQFWRNDQDKGD------QVAGAYHYLTAGNTHNQRGAGN
                   170       180       190             200       210

250       260       270       280       290       300
orf1ng-1.pep  GTVNLGSEKIKHSPYGFLPTGGSFGDSGSPMFIYDAQKQKWLINGVLQTGNPYIGKSNGF
              |   ||::  | :|| || ||:||||||||||||:|||||||||:|: |||  ||||||
p45387        GYSYLGGDVRKAGEYGPLPIAGSKGDSGSPMFIYDAEKQKWLINGILREGNPFEGKENGF
                   220       230       240       250       260       270
```

```
                      -continued
               310        320        330        340        350        360
orf1ng-1.pep   QLVRKDWFYDEIFAGDTHSVFYEPHQNGKYFFNDNNNGAGKIDAKHKHYSLPYRLKTRTV
               ||||:|::|  ||||    |  |:  |     ||  |  |::  |:||   |:|    |          ::|   ::|   :
p45387         QLVRKSYF-DEIFERDLHTSLYTRAGNGVYTISGNDNGQGSITQKS---GIPSEIK---I
               280        290        300        310        320

370        380        390        400        410       419
orf1ng-1.pep   QLFNVSLSETAREPVYHAA-GGVNSYRPRLNNGENISFIDKGKGELILTSNINQGAGGLY
               | |:||       ::  |::     |  |   ||||||||::  |:|:  |||:||||||
p45387         TLANMSLPLKEKDKVHNPRYDGPNIYSPRLNNGETLYFMDQKQGSLIFASDINQGAGGLY
               330        340        350        360        370        380

420        430        440        450        460        470       479
orf1ng-1.pep   FEGNFTVSPKNNETQWGAGVHISDGSTVTWKVNGVANDRLSKIGKGTLLVQAKGENQGSV
               ||||||||||::|:|||||:|:::|||||||||||:|||||||||||:||||||||:||:
p45387         FEGNFTVSPNSNQTWQGAGTHVSENSTVTWKVNGVEHDRLSKIGKGTLHVQAKGENKGSI
               390        400        410        420        430        440

480        490        500        510        520        530       539
orf1ng-1.pep   SVGDGKVILDQQADDQGKKQAFSEIGLVSGRGTVQLNADNQFNPDKLYFGFRGGRLDLNG
               ||||||||||||||||||||:||||||||||||||||:||:|  ||:|||||||||||||
p45387         SVGDGKVILEQQADDQGNKQAFSEIGLVSGRGTVQLNDDKQFDTDKFYFGFRGGRLDLNG
               450        460        470        480        490        500

540        550        560        570        580        590
orf1ng-1.pep   HSLSFHRIQNTDEGAMIVNHNQDKESTVTITGNKDITT-TGNN-NNLDSKKEIAYNGWFG
               |||:|:||||||||||||||||::   |:::|||||:   :||     |:||   :|||||||||||
p45387         HSLTFKRIQNTDEGAMIVNHNTTQAANVTITGNESIVLPNGNNINKLDYRKEIAYNGWFG
               510        520        530        540        550        560

600        610        620        630        640        650
orf1ng-1.pep   EKDATKTNGRLNLNYQPEEADRTLLLSGGTNLNGNITQTNGKLFFSGRPTPHAYNHLGSG
               | | :|  ||||||  |:|   ||||||||||:|:|||:|||||||||||||||||||::
p45387         ETDKNKHNGRLNLIYKPTTEDRTLLLSGGTNLKGDITQTKGKLFFSGRPTPHAYNHLNKR
               570        580        590        600        610        620

660        670        680        690        700        710
orf1ng-1.pep   WSKMEGIPQGEIVWDNDWIDRTFKAENFHIQGGQAVVSRNVAKVEGDWHLSNHAQAVFGV
               ||:|||||||||||:|||||:||||||:||:|||:||||||||:::|:|:|    :||:|||:|||
p45387         WSEMEGIPQGEIVWDHDWINRTFKAENFQIKGGSAVVSRNVSSIEGNWTVSNNANATFGV
               630        640        650        660        670        680

720        730        740        750        760        770
orf1ng-1.pep   APHQSHTICTRSDWTGLTSCTEKTITDDKVIASLSKTDIRGNVSLADHAHLNLTGLATLN
               :|:|::||||||||||:|:|  :||  ||  |: ||:::|:|  |: ||| ||
p45387         VPNQQNTICTRSDWTGLTTCQKVDLTDTKVINSIPKTQINGSINLTDNATANVKGLAKLN
               690        700        710        720        730        740

780        790        800        810        820        830
orf1ng-1.pep   GNLSAGGDSWYTVTRNATQNGNLSLVGNAQATFNQATLNGNTSASDNASFNLSNNAVQNG
               ||:::                                      :::::|:||||:| |
p45387         GNVTL----------------------------------TNHSQFTLSNNATQIG
               750                                              760        770

840        850        860        870        880        890
orf1ng-1.pep   SLTLSDNAKANVSHSALNGNVSLADKAVFHFENSRFTGKISGGKDTALHLKDSEWTLPSG
               ::  ||||: |:|:::  |||||  |:|:|  | ::||:::  |:| |  |:: |::|||
p45387         NIRLSDNSTATVDNANLNGNVHLTDSAQFSLKNSHFSHQIQGDKGTTVVLENATWTMPSD
                         780        790        800        810        820        830

900        910        920        930        940        950
orf1ng-1.pep   TELGNLNLDNATITLNSAYRHDAAGAQTGSAADAPRRRSRRSLLSVTPPTSAESRFNTLT
               |  |  ||:|:|:||||||        ::|: ::|||||   |  :  ||||| ||||||
p45387         TTLQNLTLNNSTITLNSAY--------SASSNNTPRRRS---LETETTPTSAEHRFNTLT
                         840                 850        860        870

960        970        980        990        1000       1010
orf1ng-1.pep   VNGKLNGQGTFRFMSELFGYRSGKLKLAESSEGTYTLAVNNTGNEPVSLEQLTVVEGKDN
               |||||:||||||:|  ||||:|  ||||:::||  |:| |||:|   :|||:||||:|||
p45387         VNGKLSGQGTFQFTSSLFGYKSDKLKLSNDAEGDYILSVRNTGKEPETLEQLTLVESKDN
               880        890        900        910        920        930

1020       1030       1040       1050       1060       1070
orf1ng-1.pep   TPLSENLNFTLQNEHVDAGAWRYQLIRKDGEFRLMNPVKEQELSDKLGKAGETEAALTAK
               ||::|:|||:|||||||| |||:|:|:|||||||:|||:|||:|  :  | ::|  :| ||
p45387         QPLSDKLKFTLENDRVDAGALRYKLVKNDGEFRLHNPIKEQELHNDLVRAEQAERTLEAK
               940        950        960        970        980        990
```

-continued

```
                  1080      1090      1100      1110      1120      1130
orf1ng-1.pep    QAQLAAKQQAEKDNAQSLDALIAAGRNAT-EKAESVAEPARQAGGENAGIMQAEEEKKRV
                |:: :|| |: : :::|  |  ||  ::  :::   |  |:||   :|  :::: : |:|
p45387          QVEPTAKTQTGEPKVRSRRAARAAFPDTLPDQSLLNALEAKQAE-LTAETQKSKAKTKKV
              1000      1010      1020      1030      1040      1050

1140         1150      1160      1170      1180      1190
orf1ng-1.pep    QADK---DTALAKQREAETRPATTAFPRARRARRD-LPQPQPQPQPQPQRDLISRYANSG
                :: :    :  |  |      : |  ::   ::::| | | : : | : |:||||||:||:
p45387          RSKRAVFSDPLLDQSLFALEAALEVIDAPQQSEKDRLAQEEAEKQ-RKQKDLISRYSNSA
               1060      1070      1080      1090      1100      1110

1200      1210      1220      1230      1240      1250
orf1ng-1.pep    LSEFSATLNSVFAVQDELDRVFAEDRRNAVWTSGIRDTKHYRSQDFRAYRQQ-TDLRQIG
                |||:|||:||:::||||||:|::: ::||||:  :| ::| |: ||||:|| |:|||||
p45387          LSELSATVNSMLSVQDELDRLFVDQAQSAVWTNIAQDKRRYDSDAFRAYQQQKTNLRQIG
                  1120      1130      1140      1150      1160      1170

1260      1270      1280      1290      1300      1310
orf1ng-1.pep    MQKNLGSGRVGILFSHNRTGNTFDDGIGNSARLAHGAVFGQYGIGRFDIGISAGAGFSSG
                :|| |::||:| :|||:|: ||||: : | | |: : :|| | :::|:::|:|:|::
p45387          VQKALANGRIGAVFSHSRSDNTFDEQVKNHATLTMMSGFAQYQWGDLQFGVNVGTGISAS
                  1180      1190      1200      1210      1220      1230

1320      1330      1340      1350      1360      1370
orf1ng-1.pep    SLSDGIRGKIRRRVLHYGIQARYRAGFGGFGIEPHIGATRYFVQKADYRYENVNIATPGL
                ::::      ||:|::::||::| |:  :| :||:|::|::|||::: :|: |:| : ||:|
p45387          KMAEEQSRKIHRKAINYGVNASYQFRLGQLGIQPYFGVNRYFIERRNYQSEEVRVKTPSL
                  1240      1250      1260      1270      1280      1290

1380      1390      1400      1410      1420      1430
orf1ng-1.pep    AFNRYRAGIKADYSFKPAQHISITPYLSLSYTDAASGKVRTRVNTAVLAQDFGKTRSAEW
                ||||| |||::||:| |:::||: ||: ::|:|:::::|:| || :|| | ||:  : |
p45387          AFNRYNAGIRVDYTFTPTDNISVKPYFFVNYVDVSNANVQTTVNLTVLQQPFGRYWQKEV
                  1300      1310      1320      1330      1340      1350

1440      1450      1460      1469
orf1ng-1.pep    GVNAEIKGFTLSLHAAAAKGPQLEAQHSAGIKLGYRWX
                |::|||   | :|   : ::| ||  |:::|:|||||
p45387          GLKAEILHFQISAFISKSQGSQLGKQQNVGVKLGYRW
                  1360      1370      1380      1390
```

Based on this analysis, it is predicted that these proteins from *N.meningitidis* and *N.gonorrhoeae*, and their epitopes, could be useful antigens for vaccines or diagnostics, or for raising antibodies.

Example 78

The following partial DNA sequence was identified in *N.meningitidis* (SEQ ID NO: 655):

```
  1 ..AAGGTGTGGC AATTTGTCGA AGA.CCGCTG CGTGCCGTCG TGCCTGCCGA
 51 CAGTTTTGAA CCGACCGCGC AAAAATTGAA CCTGTTTAAG GCGGGTGCGG
101 CAACCATTTT GTTTTATGAA GATCAAAATG TCGTCAAAGG TTTGCAGGAG
151 CAGTTCCCTG CTTATGCCGC TAACTTCCCC GTTTGGGCGg ATCAGGCAAA
201 CGCGATGGTG CAGTATGCCG TTTGGACGAC ACTTGCCGCG GTCGGCGTAG
251 GTGCAAACCT GCAACATTAC AATCCCTTGC CCGATGCGGC GATTGCCAAA
301 GCGTGGAATA TCCCCGAAAA CTGGTTGTTG CGCGCACAAA TGGTTATCGG
351 CGGTATTGAA GGGGCGGCAG GTGAAAAGAC CTTTGAACCC GTTGCAGAAC
401 GTTTGAAAGT GTTCGGCGCA TAA
```

This corresponds to the amino acid sequence (SEQ ID NO: 656; ORF6):

```
  1 ..KVWQFVEXPL RAVVPADSFE PTAQKLNLFK AGAATILFYE DQNVVKGLQE
 51 QFPAYAANFP VWADQANAMV QYAVWTTLAA VGVGANLQHY NPLPDAAIAK
101 AWNIPENWLL RAQMVIGGIE GAAGEKTFEP VAERLKVFGA *
```

Further sequence analysis revealed a further partial DNA sequence (SEQ ID NO: 657):

```
1    ..CTGCGTGCCG TCGTGCCTGC CGACAGTTTT GAACCGACCG CGCAAAAATT
51   GAACCTGTTT AAGGCGGGTG CGGCAACCAT TTTGTTTTAT GAAGATCAAA
101  ATGTCGTCAA AGGTTTGCAG GAGCAGTTCC CTGCTTATGC CGCTAACTTC
151  CCCGTTTGGG CGGATCAGGC AAACGCGATG GTGCAGTATG CCGTTTGGAC
201  GACACTTGCC GCGGTCGGCG TAGGTGCAAA CCTGCAACAT TACAATCCCT
251  TGCCCGATGC GGCGATTGCC AAAGCGTGGA ATATCCCCGA AAACTGGTTG
301  TTGCGCGCAC AAATGGTTAT CGGCGGTATT GAAGGGGCGG CAGGTGAAAA
351  GACCTTTGAA CCCGTTGCAG AACGTTAGAA AGTGTTCGGC GCATAA
```

This corresponds to the amino acid sequence (SEQ ID NO: 658; ORF6-1):

```
1    ..LRAVVPADSF EPTAQKLNLF KAGAATILFY EDQNVVKGLQ EQFPAYAANF
51   PVWADQANAM VQYAVWTTLA AVGVGANLQH YNPLPDAAIA KAWNIPENWL
101  LRAQMVIGGI EGAAGEKTFE PVAERLPKVFG A*
```

Computer analysis of this amino acid sequence gave the following results:
Homology with a Predicted ORF from *N.meningitidis* (Strain A)

ORF6 (SEQ ID NO: 656) shows 98.6% identity over a 140aa overlap with an ORF (ORF6a) (SEQ ID NO: 660) from strain A of *N. meningitidis*:

```
                                          10         20         30
orf6.pep                             KVWQFVEXPLRAVVPADSFEPTAQKLNLFK
                                     |||||||  |||||||||||||||||||||
orf6a    QIVEHAVLHTPSSFNSQSARVVVLFGEEHDKVWQFVEDALRAVVPADSFEPTAQKLNLFK
                 40         50         60         70         80         90

40         50         60         70         80         90
orf6.pep AGAATILFYEDQNVVKGLQEQFPAYAANFPVWADQANAMVQYAVWTTLAAVGVGANLQHY
         ||||||||||||||||||||||||||||||||||||||||||||||||||||||||||||
orf6a    AGAATILFYEDQNVVKGLQEQFPAYAANFPVWADQANAMVQYAVWTTLAAVGVGANLQHY
                  100        110        120        130        140        150

100        110        120        130        140
orf6.pep NPLPDAAIAKAWNIPENWLLRAQMVIGGIEGAAGEKTFEPVAERLKVFGAX
         |||||||||||||||||||||||||||||||||||||||||||||||||||
orf6a    NPLPDAAIAKAWNIPENWLLRAQMVIGGIEGAAGEKTFEPVAERLKVFGAX
                  160        170        180        190        200
```

The complete length ORF6a nucleotide sequence (SEQ ID NO: 659) is:

```
1    ATGACCCGTC AATCTCTGCA ACAGGCTGCC CAAAGCCGCC GTTCCATTTA
51   TTCGTTAAAT AAAAATCTGC CCGTCGGCAA AGATGAAATC GTCCAAATCG
101  TCGAACACGC CGTTTTGCAC ACACCTTCTT CGTTCAATTC CCAATCTGCC
151  CGTGTGGTCG TGCTGTTTGG CGAAGAGCAT GATAAGGTGT GGCAATTTGT
201  CGAAGACGCG CTGCGTGCCG TCGTGCCTGC CGACAGTTTT GAACCGACCG
251  CGCAAAAATT GAACCTGTTT AAGGCGGGTG CGGCAACTAT TTTGTTTTAT
301  GAAGATCAAA ATGTCGTCAA AGGTTTGCAG GAGCAGTTCC CTGCTTATGC
351  CGCCAACTTT CCCGTTTGGG CGGACCAGGC GAACGCGATG GTGCAGTATG
```

-continued

```
401  CCGTTTGGAC GACACTTGCC GCGGTCGGCG TAGGTGCAAA CCTGCAACAT

451  TACAATCCCT TGCCCGATGC GGCGATTGCC AAAGCGTGGA ATATCCCCGA

501  AAACTGGTTG TTGCGCGCAC AAATGGTTAT CGGCGGTATT GAAGGGCGG

551  CAGGTGAAAA GACCTTTGAA CCAGTTGCAG AACGTTTGAA AGTGTTCGGC

601  GCATAA
```

This is predicted to encode a protein having amino acid sequence (SEQ ID NO: 660):

```
  1  MTRQSLQQAA ESRRSIYSLN KNLPVGKDEI VQIVEHAVLH TPSSFNSQSA

51  RVVVLFGEEH DKVWQFVEDA LRAVVPADSF EPTAQKLNLF KAGAATILFY

101  EDQNVVKGLQ EQFPAYAANF PVWADQANAM VQYAVWTTLA AVGVGANLQH

151  YNPLPDAAIA KAWNIPENWL LRAQMVIGGI EGAAGEKTFE PVAERLKVFG

201  A*
```

ORF6a (SEQ ID NO: 660) and ORF6-1 (SEQ ID NO: 658) show 100.0% identity in 131 aa overlap:

```
                  50         60         70         80         90        100
orf6a.pep  TPSSFNSQSARVVVLFGEEHDKVWQFVEDALRAVVPADSFEPTAQKLNLFKAGAATILFY
                                        ||||||||||||||||||||||||||||||
orf6-1                                  LRAVVPADSFEPTAQKLNLFKAGAATILFY
                                                10        20        30

110        120        130        140        150        160
orf6a.pep  EDQNVVKGLQEQFPAYAANFPVWADQANAMVQYAVWTTLAAVGVGANLQHYNPLPDAAIA
           ||||||||||||||||||||||||||||||||||||||||||||||||||||||||||||
orf6-1     EDQNVVKGLQEQFPAYAANFPVWADQANAMVQYAVWTTLAAVGVGANLQHYNPLPDAAIA
                    40        50        60        70        80        90

170        180        190        200
orf6a.pep  KAWNIPENWLLRAQMVIGGIEGAAGEKTFEPVAERLKVFGAX
           |||||||||||||||||||||||||||||||||||||||||
orf6-1     KAWNIPENWLLRAQMVIGGIEGAAGEKTFEPVAERLKVFGAX
                   100       110       120       130
```

Homology with a Predicted ORF from *N.gonorrhoeae*

ORF6 (SEQ ID NO: 656) shows 95.7% identity over a 140aa overlap with a predicted ORF (ORF6ng) (SEQ ID NO: 662) from *N.gonorrhoeae*:

```
orf6.pep                         KVWQFVEXPLRAVVPADSFEPTAQKLNLFK   30
                                 |||||||  |||||||||||||||||||:|||
orf6ng    SNVSLDMSNPTVLRMGLPLYIASLRRGAIYKVWQFVEDALRAVVPADSFEPTAQKLKLFK   54 orf6.pep  AGAATILFYEDQNVVKGLQEQFPAYAANFPVWADQANAMVQYAVWTTLAAVGVGANLQHY   90
          ||||||||||||||||||||||||||||||||||||||||||||||||||:||||||
orf6ng    AGAATILFYEDQNVVKGLQEQFPAYAANFPVWADQANAMVQYAVWTTLAAVGAGANLQHY  124 orf6.pep  NPLPDAAIAKAWNIPENWLLRAQMVIGGIEGAAGEKTFEPVAERLKVFGA           140
          |||||:|||||||||||||||||||||||||||||||:||||||||||||
orf6ng    NPLPDVAIAKAWNIPENWLLRAQMVIGGIEGAAGEKVFEPVAERLKVFGA           174
```

The complete length ORF6ng nucleotide sequence (SEQ ID NO: 661) was identified as:

```
  1  ATGGCCGTTG CGTCAAATGT CAGCTTGGAT ATGTCCAATC CTACGGTGTT

51  ACGCATGGGA TTACCCTTAT ATATTGCGTC CCTAAGAAGG GGCGCAATAT
```

-continued
```
101  ATAAGGTGTG GCAATTTGTC GAAGACGCGC TGCGTGCCGT CGTGCCTGCC

151  GACAGTTTTG AACCGACCGC GCAAAAATTG AAGCTGTTTA AGGCGGGCGC

201  GGCAACCATT TTGTTTTATG AAGATCAAAA TGTCGTCAAA GGTTTGCAGG

251  AGCAGTTCCC TGCTTATGCC GCCAACTTTC CCGTTTGGGC GGACCAGGCG

301  AACGCTATGG TACAGTATGC CGTCTGGACG ACACTTGCCG CGGTCGGTGC

351  AGGTGCAAAT CTGCAACATT ACAACCCCTT GCCCGATGTG GCGATTGCTA

401  AAGCGTGGAA TATTCCCGAA AACTGGCTGT TGCGCGCGCA AATGGTTATC

451  GGTGGTATTG AAGGGGcggc aggtgaaaaa gtctttgaac CCGTTGCgga 501  acgtttgAAA GTGTTCGGCG CATAA
```

This encodes a protein having amino acid sequence (SEQ ID NO: 662):

```
  1  MAVASNVSLD MSNPTVLRMG LPLYIASLRR GAIYKVWQFV EDALRAVVPA

51  DSFEPTAQKL KLFKAGAATI LFYEDQNVVK GLQEQFPAYA ANFPVWADQA

101  NAMVQYAVWT TLAAVGAGAN LQHYNPLPDV AIAKAWNIPE NWLLRAQMVI

151  GGIEGAAGEK VFEPVAERLK VFGA*
```

ORF6ng (SEQ ID NO: 662) and ORF6-1 (SEQ ID NO: 658) show 96.9% identity in 131 aa overlap:

```
                        10         20         30
orf6-1.pep              LRAVVPADSFEPTAQKLNLFKAGAATILFY
                        |||||||||||||||:|||||||||||||
orf6ng      PTVLRMGLPLYIASLRRGAIYKVWQFVEDALRAVVPADSFEPTAQKLKLFKAGAATILFY
                 20         20         30         50         60         70

40         50         60         70         80         90
orf6-1.pep  EDQNVVKGLQEQFPAYAANFPVWADQANAMVQYAVWTTLAAVGVGANLQHYNPLPDAAIA
            ||||||||||||||||||||||||||||||||||||||||||:|||||||||||:|||
orf6ng      EDQNVVKGLQEQFPAYAANFPVWADQANAMVQYAVWTTLAAVGAGANLQHYNPLPDVAIA
                 80         90        100        110        120        130

100        110        120        130
orf6-1.pep  KAWNIPENWLLRAQMVIGGIEGAAGEKTFEPVAERLKVFGAX
            |||||||||||||||||||||||||||:|||||||||||||
orf6ng      KAWNIPENWLLRAQMVIGGIEGAAGEKVFEPVAERLKVFGAX
                 140        150        160        170
```

It is predicted that the proteins from N.meningitidis and N.gonorrhoeae, and their epitopes, could be useful antigens for vaccines or diagnostics, or for raising antibodies.

Example 79

The following partial DNA sequence was identified in N.meningitidis (SEQ ID NO: 663)

```
  1..GGCTACAACT ACCTGTTCGC GCGCGGCAGC CGCATCGCCA ACTACCAAAT

51  CAACGGCATC CCCGTTGCCG ACGCGCTGGC CGATACGGGt CAATGCCAAC

101  ACCGCCGCCT ATGAGCGCGT AGAAGTCGTG CGCGGCGTGG CGGGGCTGCT

151  GGACGGCACG GGCGAGCCTT CCGCCACCGT CAATCTGGTG CGCAAACGCC

201  TGACCCGCAA GCCATTGTTT GAAGTCCGCG CCGAAGCgGG CAACCGcAAA

251  CATTTCGGGC TGGACGCGGA CGTATCGGGC AGCCTGAACA CCGAAG.crC 301  rCTGCGCgGC CGCCTGGTTT CCAcCTTCGG ACGCGGCGAC TCGTGGCGGC
```

-continued

```
351    GGCGCGAACG CAGCCGskAT GCCGAACTCT ACGGCATTTT GGAATACGAC
401    ATCGCACCGC AAACCCGCGT CCACGCArGC ATGGACTACC AGCAGGCGAA
451    AGAAACCGCC GACGCGCCGC TCAGcTACGC CGTGTACGAC AGCCAAGGTT
501    ATGCCACCGC CTTCGGCCCG AAAGACAACC CCGCCACAAA TTGGGCGAAC
551    AGCCACCACC GTGCGCTCAA CCTGTTCGCC GGCATCGAAC ACCGCTTCAA
601    CCAAGACTGG AAACTCAAAG CCGAATACGA CTAC..
```

This corresponds to the amino acid sequence (SEQ ID NO: 664; ORF23):

```
  1 ..GYNYLFARGS RIANYQINGI PVADALADTG NANTAAYERV EVVRGVAGLL
 51   DGTGEPSATV NLVRKRLTRK PLFEVRAEAG NRKHFGLDAD VSGSLNTEXX
101   LRGRLVSTFG RGDSWRRRER SRXAELYGIL EYDIAPQTRV HAXMDYQQAK
151   ETADAPLSYA VYDSQGYATA FGPKDNPATN WANSHHRALN LFAGIEHRFN
201   QDWKLKAEYD Y..
```

Further work revealed the complete nucleotide sequence (SEQ ID NO: 665):

```
   1    ATGACACGCT TCAAATATTC CCTGCTGTTT GCCGCCCTGT TGCCCGTGTA
  51    CGCGCAGGCC GATGTTTCTG TTTCAGACGA CCCCAAACCG CAGGAAAGCA
 101    CTGAATTGCC GACCATCACC GTTACCGCCG ACCGCACCGC GAGTTCCAAC
 151    GACGGCTACA CTGTTTCCGG CACGCACACC CCGCTCGGGC TGCCCATGAC
 201    CCTGCGCGAA ATCCCGCAGA GCGTCAGCGT CATCACATCG CAACAAATGC
 251    GCGACCAAAA CATCAAAACG CTCGACCGCG CCCTGTTGCA GGCGACCGGC
 301    ACCAGCCGCC AGATTTACGG CTCCGACCGC GCGGGCTACA ACTACCTGTT
 351    CGCGCGCGGC AGCCGCATCG CCAACTACCA AATCAACGGC ATCCCCGTTG
 401    CCGACGCGCT GGCCGATACG GGCAATGCCA ACACCGCCGC CTATGAGCGC
 451    GTAGAAGTCG TGCGCGGCGT GGCGTTGCTG CTGGACGGCA CGGGCGAGCC
 501    TTCCGCCACC GTCAATCTGG TGCGCAAACG CCTGACCCGC AAGCCATTGT
 551    TTGAAGTCCG CGCCGAAGCG GGCAACCGCA AACATTTCGG GCTGGACGCG
 601    GACGTATCGG GCAGCCTGAA CACCGAAGGC ACGCTGCGCG GCCGCCTGGT
 651    TTCCACCTTC GGACGCGGCG ACTCGTGGCG GCGGCGCGAA CGCAGCCGCG
 701    ATGCCGAACT CTACGGCATT TTGGAATACG ACATCGCACC GCAAACCCGC
 751    GTCCACGCAG GCATGGACTA CCAGCAGGCG AAAGAAACCG CCGACGCGCC
 801    GCTCAGCTAC GCCGTGTACG ACAGCCAAGG TTATGCCACC GCCTTCGGCC
 851    CGAAAGACAA CCCCGCCACA AATTGGGCGA ACAGCCGCCA CCGTGCGCTC
 901    AACCTGTTCG CCGGCATCGA ACACCGCTTC AACCAAGACT GGAAACTCAA
 951    AGCCGAATAC GACTACACCC GCAGCCGCTT CCGCCAGCCC TACGGCGTAG
1001    CAGGCGTGCT TTCCATCGAC CACAACACCG CCGCCACCGA CCTGATTCCC
1051    GGTTATTGGC ACGCCGACCC GCGCACCCAC AGCGCCAGCG TGTCATTGAT
1101    CGGCAAATAC CGCCTGTTCG CCGCGAACA CGATTTAATC GCGGGTATCA
```

```
-continued
1151 ACGGTTACAA ATACGCCAGC AACAAATACG GCGAACGCAG CATCATCCCC

1201 AACGCCATTC CCAACGCCTA CGAATTTTCC CGCACGGGTG CCTACCCGCA

1251 GCCTGCATCG TTTGCCCAAA CCATCCCGCA ATACGGCACC AGGCGGCAAA

1301 TCGGCGGCTA TCTCGCCACC CGTTTCCGCG CCGCCGACAA CCTTTCGCTG

1351 ATTTTGGGCG GACGATACAC CCGTTACCGC ACCGGCAGCT ACGACAGCCG

1401 CACACAAGGC ATGACCTATG TGTCCGCCAA CCGTTTCACC CCCTACACAG

1451 GCATCGTGTT CGACCTGACC GGCAACCTGT CTCTTTACGG CTCGTACAGC

1501 AGCCTGTTCG TCCCGCAATC GCAAAAAGAC GAACACGGCA GCTACCTGAA

1551 ACCCGTAACC GGCAACAATC TGGAAGCCGG CATCAAAGGC GAATGGCTTG

1601 AAGGCCGTCT GAACGCATCC GCCGCCGTGT ACCGCGCCCG TAAAAACAAC

1651 CTCGCCACCG CAGCAGGACG CGACCCGAGC GGCAACACCT ACTACCGCGC

1701 CGCCAACCAA GCCAAAACCC ACGGCTGGGA AATCGAAGTC GGCGGCCGCA

1751 TCACGCCCGA ATGGCAGATA CAGGCAGGTT ACAGCCAAAG CAAAACCCGC

1801 GACCAAGACG GCAGCCGCCT GAACCCCGAC AGCGTACCCG AACGCAGCTT

1851 CAAACTCTTC ACTGCCTACC ACTTTGCCCC CGAAGCCCCC AGCGGCTGGA

1901 CCATCGGCGC AGGCGTGCGC TGGCAGAGCG AAACCCACAC CGACCCTGCC

1951 ACGCTCCGCA TCCCCAACCC CGCCGCCAAA GCCCGCGCCG CCGACAACAG

2001 CCGCCAAAAA GCCTACGCCG TCGCCGACAT CATGCCGCGT TACCGCTTCA

2051 ATCCGCGCGC CGAACTGTCG CTGAACGTGG ACAATCTGTT CAACAAACAC

2101 TACCGCACCC AGCCCGACCG CCACAGCTAC GGCGCACTGC GGACAGTGAA

2151 CGCGGCGTTT ACCTATCGGT TTAAATAA
```

This corresponds to the amino acid sequence (SEQ ID NO: 666; ORF23-1):

```
  1    MTRFKYSLLF AALLPVYAQA DVSVSDDPKP QESTELPTIT VTADRTASSN

51    DGYTVSGTHT PLGLPMTLRE IPQSVSVITS QQMRDQNIKT LDRALLQATG

101    TSRQIYGSDR AGYNYLFARG SRIANYQING IPVADALADT GNANTAAYER

151    VEVVRGVAGL LDGTGEPSAT VNLVRKRLTR KPLFEVRAEA GNRKHFGLDA

201    DVSGSLNTEG TLRGRLVSTF GRGDSWRRRE RSRDAELYGI LEYDIAPQTR

251    VHAGMDYQQA KETADAPLSY AVYDSQGYAT AFGPKDNPAT NWANSRHRAL

301    NLFAGIEHRF NQDWKLKAEY DYTRSRFRQP YGVAGVLSID HNTAATDLIP

351    GYWHADPRTH SASVSLIGKY RLFGREHDLI AGINGYKYAS NKYGERSIIP

401    NAIPNAYEFS RTGAYPQPAS FAQTIPQYGT RRQIGGYLAT RFRAADNLSL

451    ILGGRYTRYR TGSYDSRTQG MTYVSANRFT PYTGIVFDLT GNLSLYGSYS

501    SLFVPQSQKD EHGSYLKPVT GNNLEAGIKG EWLEGRLNAS AAVYRARKNN

551    LATAAGRDPS GNTYYRAANQ AKTHGWEIEV GGRITPEWQI QAGYSQSKTR

601    DQDGSRLNPD SVPERSFKLF TAYHFAPEAP SGWTIGAGVR WQSETHTDPA

651    TLRIPNPAAK ARAADNSRQK AYAVADIMAR YRFNPRAELS LNVDNLFNKH

701    YRTQPDRHSY GALRTVNAAF TYRFK*
```

Computer analysis of this amino acid sequence gave the following results:

Homology with the Ferric-pseudobactin Receptor PupB of *Pseudomonas putida* (Accession Number P38047) (SEQ ID NO: 1154)

ORF23 (SEQ ID NO: 664) and PupB protein (SEQ ID NO: 1154) show 32% aa identity in 205aa overlap:

```
Orf23    6 FARGSRIANYQINGIPVADALADTGNANTAAYERVEVVRGVAGLLDGTGEPSATVNLVRK    65
           ++RG  I NY+++G+P +  L D  + + A ++RVE+VRG  GL+ G G PSAT+NL+RK
PupB   215 WSRGFAIQNYEVDGVPTSTRL-DNYSQSMAMFDRVEIVRGATGLISGMGNPSATINLIRK   273

Orf23   66 RLTRKPLFEVRAEAGNRKHFGLDADVSGSLNTEXXLRGRLVSTFXXXXXXXXXXXXXXXAE   125
           R T +   +  EAGN   +G   DVSG L     +RGR V+ +
PupB   274 RPTAEAQASITGEAGNWDRYGTGFDVSGPLTETGNIRGRFVADYKTEKAWIDRYNQQSQL   333

Orf23  126 LYGILEYDIAPQTRVHAXMDYQQAKETADAPLSYAVYD--SQGYATAFGPKDNPATNWAN   183
           +YGI E+D++  T +     Y  +   D+PL  +    S G  T      N A +W+
PupB   334 MYGITEFDLSEDTLLTVGFSY--LRSDIDSPLRSGLPTRFSTGERTNLKRSLNAAPDWSY   391

Orf23  184 SHHRALNLFAGIEHRFNQDWKLKAE                                      208
           + H   + F  IE +   W K E
PupB   392 NDHEQTSFFTSIEQQLGNGWSGKIE                                      416
```

Homology with a Predicted ORF from *N.meningitidis* (Strain A)

ORF23 (SEQ ID NO: 664) shows 95.7% identity over a 211 aa overlap with an ORF (ORF23a) (SEQ ID NO: 668) from strain A of *N. meningitidis*:

```
                                           10        20        30
orf23.pep                         GYNYLFARGSRIANYQINGIPVADALADTG
                                  ||||||||||||||||||||||||||||||
orf23a    QMRDQNIKALDRALLQATGTSRQIYGSDRAGYNYLFARGSRIANYQINGIPVADALADTG
                  90        100       110       120       130       140

40        50        60        70        80        90
orf23.pep NANTAAYERVEVVRGVAGLLDGTGEPSATVNLVRKRLTRKPLFEVRAEAGNRKHFGLDAD
          |||||||||||||||||||||||||||||||||||| ||||||||||||||||||||| ||
orf23a    NANTAAYERVEVVRGVAGLLDGTGEPSATVNLVRKRPTRKPLFEVRAEAGNRKHFGLGAD
                 150       160       170       180       190       200

100       110       120       130       140       150
orf23.pep VSGSLNTEXXLRGRLVSTFGRGDSWRRRERSRXAELYGILEYDIAPQTRVHAXMDYQQAK
          ||||||:| :|||||||||||||||:||||| |||||||||||||||||||| ||||||
orf23a    VSGSLNAEGTLRGRLVSTFGRGDSWRQRERSRDAELYGILEYDIAPQTRVHAGMDYQQAK
                 210       220       230       240       250       260

160       170       180       190       200       210
orf23.pep ETADAPLSYAVYDSQGYATAFGPKDNPATNWANSHHRALNLFAGIEHRFNQDWKLKAEYD
          ||||||||||||||||||||||||||||||||||:|||||||||||||||||||||||||
orf23a    ETADAPLSYAVYDSQGYATAFGPKDNPATNWANSRHRALNLFAGIEHRFNQDWKLKAEYD
                 270       280       290       300       310       320 orf23.pep Y
          |
orf23a    YTRSRFRQPYGVAGVLSIDHNTAATDLIPGYWHADPRTHSASVSLIGKYRLFGREHDLIA
                 330       340       350       360       370       380
```

The complete length ORF23a nucleotide sequence (SEQ ID NO: 667) is:

```
  1 ATGACACGCT TCAAATATTC CCTGCTGTTT GCCGCCCTGT TGCCCGTGTA

51 CGCGCAGGCC GATGTTTCTG TTTCAGACGA CCCAAAACCG CAGGAAAGCA

101 CTGAATTGCC GACCATCACC GTTACCGCCG ACCGCACCGC GAGTTCCAAC

151 GACGGCTACA CTGTTTCCGG CACGCACACC CCGCTCGGGC TGCCCATGAC

201 CCTGCGCGAA ATCCCGCAGA GCGTCAGCGT CATCACATCG CAACAAATGC
```

-continued

```
 251   GCGACCAAAA CATCAAAGCG CTCGACCGCG CCCTGTTGCA GGCGACCGGC
 301   ACCAGCCGCC AGATTTACGG CTCCGACCGC GCGGGCTACA ACTACCTGTT
 351   CGCGCGCGGC AGCCGCATCG CCAACTACCA AATCAACGGC ATCCCCGTTG
 401   CCGACGCGCT GGCCGATACG GGCAATGCCA ACACCGCCGC CTATGAGCGC
 451   GTAGAAGTCG TGCGCGGCGT GGCGGGGCTG CTGGACGGCA CGGGCGAGCC
 501   TTCCGCCACC GTCAATCTGG TGCGCAAACG CCCGACCCGC AAGCCATTGT
 551   TTGAAGTCCG CGCCGAAGCG GGCAACCGCA AACATTTCGG GCTGGGCGCG
 601   GACGTATCGG GCAGCCTGAA TGCCGAAGGC ACGCTGCGCG GCCGCCTGGT
 651   TTCCACCTTC GGACGCGGCG ACTCGTGGCG GCAGCGCGAA CGCAGCCGCG
 701   ATGCCGAACT CTACGGCATT TTGGAATACG ACATCGCACC GCAAACCCGC
 751   GTCCACGCAG GCATGGACTA CCAGCAGGCG AAAGAAACCG CCGACGCGCC
 801   GCTCAGCTAC GCCGTGTACG ACAGCCAAGG TTATGCCACC GCCTTCGGCC
 851   CGAAAGACAA CCCCGCCACA AATTGGGCGA ACAGCCGCCA CCGTGCGCTC
 901   AACCTGTTCG CCGGCATCGA ACACCGCTTC AACCAAGACT GGAAACTCAA
 951   AGCCGAATAC GACTACACCC GCAGCCGCTT CCGCCAGCCC TACGGCGTAG
1001   CAGGCGTGCT TTCCATCGAC CACAACACCG CCGCCACCGA CCTGATTCCC
1051   GGTTATTGGC ACGCCGACCC GCGCACCCAC AGCGCCAGCG TGTCATTAAT
1101   CGGCAAATAC CGCCTGTTCG GCCGCGAACA CGATTTAATC GCGGGTATCA
1151   ACGGTTACAA ATACGCCAGC AACAAATACG GCGAACGCAG CATCATCCCC
1201   AACGCCATTC CCAACGCCTA CGAATTTTCC CGCACGGGTG CCTACCCGCA
1251   GCCTGCATCG TTTGCCCAAA CCATCCCGCA ATACGGCACC AGGCGGCAAA
1301   TCGGCGGCTA TCTCGCCACC CGTTTCCGCG CCGCCGACAA CCTTTCGCTG
1351   ATACTCGGCG GCAGATACAG CCGTTACCGC ACCGGCAGCT ACGACAGCCG
1401   CACACAAGGC ATGACCTATG TGTCCGCCAA CCGTTTCACC CCCTACACAG
1451   GCATCGTGTT CGACCTGACC GGCAACCTGT CGCTTTACGG CTCGTACAGC
1501   AGCCTGTTCG TCCCGCAATC GCAAAAAGAC GAACACGGCA GCTACCTGAA
1551   ACCCGTAACC GGCAACAATC TGGAAGCCGG CATCCAAGGC GAATGGCTTG
1601   AAGGCCGTCT GAACGCATCC GCCGCCGTGT ACCGCGCCCG TAAAAACAAC
1651   CTCGCCACCG CAGCAGGACG CGACCCGAGC GGCAACACCT ACTACCGCGC
1701   CGCCAACCAA GCCAAAACCC ACGGCTGGGA AATCGAAGTC GGCGGCCGCA
1751   TCACGCCCGA ATGGCAGATA CAGGCAGGTT ACAGCCAAAG CAAAACCCGC
1801   GACCAAGACG GCAGCCGCCT GAACCCCGAC AGCGTACCCG AACGCAGCTT
1851   CAAACTCTTC ACTGCCTACC ACTTTGCCCC CGAAGCCCCC AGCGGCTGGA
1901   CCATCGGCGC AGGCGTGCGC TGGCAGAGCG AAACCCACAC CGACCCTGCC
1951   ACGCTCCGCA TCCCCAACCC CGCCGCCAAA GCCCGCGCCG CCGACAACAG
2001   CCGCCAAAAA GCCTACGCCG TCGCCGACAT CATGGCGCGT TACCGCTTCA
2051   ATCCGCGCGC CGAACTGTCG CTGAACGTGG ACAATCTGTT CAACAAACAC
2101   TACCGCACCC AGCCCGACCG CCACAGCTAC GGCGCACTGC GGACAGTGAA
2151   CGCGGCGTTT ACCTATCGGT TTAAATAA
```

This encodes a protein having amino acid sequence (SEQ ID NO: 668):

```
  1  MTRFKYSLLF AALLPVYAQA DVSVSDDPKP QESTELPTIT VTADRTASSN

51  DGYTVSGTHT PLGLPMTLRE IPQSVSVITS QQMRDQNIKA LDRALLQATG

101  TSRQIYGSDR AGYNYLFARG SRIANYQING IPVADALADT GNANTAAYER

151  VEVVRGVAGL LDGTGEPSAT VNLVRKRPTR KPLFEVRAEA GNRKHFGLGA

201  DVSGSLNAEG TLRGRLVSTF GRGDSWRQRE RSRDAELYGI LEYDIAPQTR

251  VHAGMDYQQA KETADAPLSY AVYDSQGYAT AFGPKDNPAT NWANSRHRAL

301  NLFAGIEHRF NQDWKLKAEY DYTRSRFRQP YGVAGVLSID HNTAATDLIP

351  GYWHADPRTH SASVSLIGKY RLFGREHDLI AGINGYKYAS NKYGERSIIP

401  NAIPNAYEFS RTGAYPQPAS FAQTIPQYGT RRQIGGYLAT RFRAADNLSL

451  ILGGRYSRYR TGSYDSRTQG MTYVSANRFT PYTGIVFDLT GNLSLYGSYS

501  SLFVPQSQKD EHGSYLKPVT GNNLEAGIKG EWLEGRLNAS AAVYRARKNN

551  LATAAGRDPS GNTYYRAANQ AKTHGWEIEV GGRITPEWQI QAGYSQSKTR

601  DQDGSRLNPD SVPERSFKLF TAYHFAPEAP SGWTIGAGVR WQSETHTDPA

651  TLRIPNPAAK ARAADNSRQK AYAVADIMAR YRFNPRAELS LNVDNLFNKH

701  YRTQPDRHSY GALRTVNAAF TYRFK*
```

ORF23a (SEQ ID NO: 668) and ORF23-1 (SEQ ID NO: 666) show 99.2% identity in 725 aa overlap:

```
                 10         20         30         40         50         60
orf23a.pep  MTRFKYSLLFAALLPVYAQADVSVSDDPKPQESTELPTITVTADRTASSNDGYTVSGTHT
            ||||||||||||||||||||||||||||||||||||||||||||||||||||||||||||
orf23-1     MTRFKYSLLFAALLPVYAQADVSVSDDPKPQESTELPTITVTADRTASSNDGYTVSGTHT
                 10         20         30         40         50         60

70         80         90        100        110        120
orf23a.pep  PLGLPMTLREIPQSVSVITSQQMRDQNIKALDRALLQATGTSRQIYGSDRAGYNYLFARG
            |||||||||||||||||||||||||||||||:||||||||||||||||||||||||||||
orf23-1     PLGLPMTLREIPQSVSVITSQQMRDQNIKTLDRALLQATGTSRQIYGSDRAGYNYLFARG
                 70         80         90        100        110        120

130        140        150        160        170        180
orf23a.pep  SRIANYQINGIPVADALADTGNANTAAYERVEVVRGVAGLLDGTGEPSATVNLVRKRPTR
            |||||||||||||||||||||||||||||||||||||||||||||||||||||||| ||
orf23-1     SRIANYQINGIPVADALADTGNANTAAYERVEVVRGVAGLLDGTGEPSATVNLVRKRLTR
                130        140        150        160        170        180

190        200        210        220        230        240
orf23a.pep  KPLFEVRAEAGNRKHFGLGADVSGSLNAEGTLRGRLVSTFGRGDSWRQRERSRDAELYGI
            ||||||||||||||||||| ||||||||:|||||||||||||||||||:|||||||||
orf23-1     KPLFEVRAEAGNRKHFGLDADVSGSLNTEGTLRGRLVSTFGRGDSWRRRERSRDAELYGI
                190        200        210        220        230        240

250        260        270        280        290        300
orf23a.pep  LEYDIAPQTRVRAGMDYQQAKETADAPLSYAVYDSQGYATAFGPKDNPATNWANSRHRAL
            ||||||||||||||||||||||||||||||||||||||||||||||||||||||||||||
orf23-1     LEYDIAPQTRVRAGMDYQQAKETADAPLSYAVYDSQGYATAFGPKDNPATNWANSRHRAL
                250        260        270        280        290        300

310        320        330        340        350        360
orf23a.pep  NLFAGIEHRFNQDWKLKAEYDYTRSRFRQPYGVAGVLSIDHNTAATDLIPGYWHADPRTH
            ||||||||||||||||||||||||||||||||||||||||||||||||||||||||||||
orf23-1     NLFAGIEHRFNQDWKLKAEYDYTRSRFRQPYGVAGVLSIDHNTAATDLIPGYWHADPRTH
                310        320        330        340        350        360

370        380        390        400        410        420
orf23a.pep  SASVSLIGKYRLFGREHDLIAGINGYKYASNKYGERSIIPNAIPNAYEFSRTGAYPQPAS
            ||||||||||||||||||||||||||||||||||||||||||||||||||||||||||||
orf23-1     SASVSLIGKYRLFGREHDLIAGINGYKYASNKYGERSIIPNAIPNAYEFSRTGAYPQPAS
                370        380        390        400        410        420
```

```
                     430       440       450       460       470       480
orf23a.pep  FAQTIPQYGTRRQIGGYLATRFRAADNLSLILGGRYSRYRTGSYDSRTQGMTYVSANRFT
            ||||||||||||||||||||||||||||||||||||:|||||||||||||||||||||||
orf23-1     FAQTIPQYGTRRQIGGYLATRFRAADNLSLILGGRYTRYRTGSYDSRTQGMTYVSANRFT
                     430       440       450       460       470       480

490       500       510       520       530       540
orf23a.pep  PYTGIVFDLTGNLSLYGSYSSLFVPQSQKDEHGSYLKPVTGNNLEAGIKGEWLEGRLNAS
            ||||||||||||||||||||||||||||||||||||||||||||||||||||||||||||
orf23-1     PYTGIVFDLTGNLSLYGSYSSLFVPQSQKDEHGSYLKPVTGNNLEAGIKGEWLEGRLNAS
                     490       500       510       520       530       540

550       560       570       580       590       600
orf23a.pep  AAVYRARKNNLATAAGRDPSGNTYYRAANQAKTHGWEIEVGGRITPEWQIQAGYSQSKTR
            ||||||||||||||||||||||||||||||||||||||||||||||||||||||||||||
orf23-1     AAVYRARKNNLATAAGRDPSGNTYYRAANQAKTHGWEIEVGGRITPEWQIQAGYSQSKTR
                     550       560       570       580       590       600

610       620       630       640       650       660
orf23a.pep  DQDGSRLNPDSVPERSFKLFTAYHFAPEAPSGWTIGAGVRWQSETHTDPATLRIPNPAAK
            ||||||||||||||||||||||||||||||||||||||||||||||||||||||||||||
orf23-1     DQDGSRLNPDSVPERSFKLFTAYHFAPEAPSGWTIGAGVRWQSETHTDPATLRIPNPAAK
                     610       620       630       640       650       660

670       680       690       700       710       720
orf23a.pep  ARAADNSRQKAYAVADIMARYRFNPRAELSLNVDNLFNKHYRTQPDRHSYGALRTVNAAF
            ||||||||||||||||||||||||||||||||||||||||||||||||||||||||||||
orf23-1     ARAADNSRQKAYAVADIMARYRFNPRAELSLNVDNLFNKHYRTQPDRHSYGALRTVNAAF
                     670       680       690       700       710       720 orf23a.pep  TYRFKX
            ||||||
orf23-1     TYRFKX
```

Homology with a Predicted ORF from N.gonorrhoeae

ORF23 (SEQ ID NO: 664) shows 93.4% identity over a 211aa overlap with a predicted ORF (ORF23.ng) (SEQ ID NO: 670) from N. gonorrhoeae:

```
orf23.pep        GYNYLFARGSRIANYQINGIPVADALADTGNANTAAYERVEVVRGVAGLLD   51
            ||||||||||||||||||||||||||||||||||||||||||||||||| |
orf23ng     SAVDACRIPGYNYLFARGSRIANYQINGIPVADALADTGNANTAAYERVEVVRGVAGLPD   60 orf23.pep   GTGEPSATVNLVRKRLTRKPLFEVRAEAGNRKHFGLDADVSGSLNTEXXLRGRLVSTFGR  111
            ||||||||||||:||||||||||||||||||||| ||||||||:|  :||||||||||||
orf23ng     GTGEPSATVNLVRKHPTRKPLFEVRAEAGNRKHFGLGADVSGSLNAEGTLRGRLVSTFGR   120 orf23.pep   GDSWRRRERSRXAELYGILEYDIAPQTRVHAXMDYQQAKETADAPLSYAVYDSQGYATAF  171
            |||||:|||| |||||||||||||||||||| |||||||||||||||||||||||||||
orf23ng     GDSWRQLERSRDAELYGILEYDIAPQTRVHAGMDYQQAKETADAPLSYAVYDSQGYATAF   180 orf23.pep   GPKDNPATNWANSHHRALNLFAGIEHRFNQDWKLKAEYDY                      211
            ||||||||||:||::|||||||||||||||||||||||||
orf23ng     GPKDNPATNWSNSRNRALNLFAGIEHRFNQDWKLKAEYDYTRSRFRQPYGVAGVLSIDHS  240
```

The ORF23ng nucleotide sequence (SEQ ID NO: 669) is predicted to encode a protein comprising amino acid sequence (SEQ ID NO: 670):

```
  1  SAVDACRIPG YNYLFARGSR IANYQINGIP VADALADTGN ANTAAYERVE

51  VVRGVAGLPD GTGEPSATVN LVRKHPTRKP LFEVRAEAGN RKHFGLGADV

101  SGSLNAEGTL RGRLVSTFGR GDSWRQLERS RDAELYGILE YDIAPQTRVH

151  AGMDYQQAKE TADAPLSYAV YDSQGYATAF GPKDNPATNW SNSRNRALNL

201  FAGIEHRFNQ DWKLKAEYDY TRSRFRQPYG VAGVLSIDHS TAATDLIPGY

251  WHADPRTHSA SMSLTGKYRL FGREHDLIAG INGYKYASNK YGERSIIPNA

301  IPNAYEFSRT GAYPQPSSFA QTIPQYDTRR QIGGYLATRF RAADNLSLIL
```

-continued
```
351  GGRYSRYRAG  SYNSRTQGMT  YVSANRFTPY  TGIVFDLTGN  LSLYGSYSSL

401  FVPQLQKDEH  GSYLKPVTGN  NLEADIKGEW  LEGRLNASAA  VYRARKNNLA

451  TAAGRDQSGN  TYYRAANQAK  THGWEIEVGG  RITPEWQIQA  GYSQSKPRDQ

501  DGSRLNPDSV  PERSFKLFTA  YHLAPEAPSG  RTIGAGVRRQ  GETHTDPAAL

551  RIPNPAAKAR  AVANSRQKAY  AVADIMARYR  FNPRTELSLN  VDNLFNKHYR

601  TQPDRHSYGA  LRTVNAAFTY  RFK*
```

Further work revealed the complete nucleotide sequence (SEQ ID NO: 671):

```
   1  ATGACACGCT  TCAAATACTC  CCTGCTTTTT  GCCGCCCTGC  TACCCGTGTA

51  CGCGCAGGCC  GATGTTTCTG  TTTCAGACGA  CCCCAAACCG  CAGGAAAGCA

101  CCGAATTGCC  GACCATCACC  GTTACCGCCG  ACCGCACCGC  GAGTTCCAAC

151  GACGGCTACA  CCGTTTCCGG  CACGCACACC  CCGTTCGGGC  TGCCCATGAC

201  CCTGCGCGAA  ATCCCGCAGA  GCGTCAGCGT  CATCACATCG  CAACAAATGC

251  GCGACCAAAA  CATCAAAACG  CTCGACCGCG  CCCTGTTGCA  GGCGACCGGC

301  ACCAGCCGCC  AGATTTACGG  CTCCGACCGC  GCGGGCTACA  ACTACCTGTT

351  CGCGCGCGGC  AGCCGCATCG  CCAACTACCA  AATCAACGGC  ATCCCCGTTG

401  CCGACGCGCT  GGCCGATACG  GGCAATGCCA  ACACCGCCGC  CTATGAGCGC

451  GTAGAAGTCG  TGCGCGGCGT  GGCGGGGCTG  CCGGACGGCA  CGGGCGAGCC

501  TTCTGCCACC  GTCAATCTGG  TACGCAAACA  CCCGACCCGC  AAGCCATTGT

551  TTGAAGTCCG  CGCCGAAGCC  GGCAACCGCA  AACATTTCGG  GCTGGGCGCG

601  GACGTATCGG  GCAGCCTGAA  CGCCGAAGGC  ACGCTGCGCG  GCCGCCTGGT

651  TTCCACCTTC  GGACGCGGCG  ACTCGTGGCG  GCAGCTCGAA  CGCAGCCGCG

701  ATGCCGAACT  CTACGGCATT  TTGGAATACG  ACATCGCACC  GCAAACCCGC

751  GTCCACGCAG  GCATGGACTA  CCAGCAGGCG  AAAGAAACCG  CAGACGCGCC

801  GCTCAGCTAC  GCCGTGTACG  ACAGCCAAGG  TTATGCCACC  GCCTTCGGCC

851  CAAAAGACAA  CCCCGCCACA  AATTGGTCGA  ACAGCCGCAA  CCGTGCGCTC

901  AACCTGTTCG  CCGGCATAGA  ACACCGCTTC  AACCAAGACT  GGAAACTCAA

951  AGCCGAATAC  GACTACACCC  GTAGCCGCTT  CCGCCAGCCC  TACGGTGTGG

1001  CAGGCGTACT  TTCCATCGAC  CACAGCACTG  CCGCCACCGA  CCTGATTCCC

1051  GGTTATTGGC  ACGCcgatcc  GCGCACCCAC  AGCGCCAGCA  TGTCATTGAC

1101  CGGGAAATAC  CgcctGTTCG  GCCGCGAGCA  CGATTTAATC  GCGGGTATCA

1151  ACGGCTACAA  ATACGCCAGC  AACAAATACG  GCGAACGCAG  CATCATTCCC

1201  AACGCCATTC  CCAACGCCTA  CGAATTTTCC  CGCACGGGCG  CCTATCCGCA

1251  GCCATCATCG  TTTGCCCAAA  CCATCCCGCA  ATACGACACC  AGGCGGCAAA

1301  TCGGCGGCTA  CTCGCCACCG  GTTTCCGCG  CCGCCGACAA  CCTTTCGCTG

1351  ATACTCGGCG  GCAGATACAG  CCGCTACCGC  GCAGGCAGCT  ACAACAGCCG

1401  CACACAAGGC  ATGACCTATG  TGTCCGCCAA  CCGTTTCACC  CCCTACACAG

1451  GCATCGTGTT  CGATCTGACC  GGCAACCTGT  CGCTTTACGG  CTCGTACAGC

1501  AGCCTGTTCG  TCCCGCAATT  GCAAAAAGAC  GAACACGGCA  GCTACCTGAA
```

-continued

```
1551  ACCCGTAACC GGCAACAATC TGGAAGCCGA CATCAAAGGC GAATGGCTTG

1601  AAGGGCGTCT GAACGCATCC GCCGCCGTGT ACCGCGCCCG TAAAAACAAC

1651  CTCGCCACCG CAGCAGGACG CGACCAGAGC GGCAACACCT ACTATCGCGC

1701  CGCCAACCAA GCCAAAACCC ACGGCTGGGA AATCGAAGTC GGCGGCCGCA

1751  TCACGCCCGA ATGGCAGATA CAGGCAGGCT ACAGCCAAAG CAAACCCCGC

1801  GACCAAGACG GCAGCCGCCT GAACCCCGAC AGCGTACCCG AACGCAGCTT

1851  CAAACTCTTC ACCGCCTACC ACTTAGCCCC CGAAGCCCCC AGCGGCCGGA

1901  CCATcggTGC GGGTGTGCGC CGGCAGGGCG AAACCCACAC CGACCCAGCC

1951  GCGCTCCGCA TCCCCAACCC CGCCGCCAAA GCCCGCGCCG TCGCCAACAG

2001  CCGCCAGAAA GCCTACGCCG TCGCCGACAT CATGGCGCGT TACCGCTTCA

2051  ATCCGCGCAC CGAACTGTCG CTGAACGTGG ACAACCTGTT CAACAAACAC

2101  TACCGCACCC AGCCCGACCG CCACAGCTAC GGCGCACTGC GGACAGTGAA

2151  CGCGGCGTTT ACCTATCGGT TTAAATAA
```

This corresponds to the amino acid sequence (SEQ ID NO: 672; ORF23ng-1):

```
  1  MTRFKYSLLF AALLPVYAQA DVSVSDDPKP QESTELPTIT VTADRTASSN

51  DGYTVSGTHT PFGLPMTLRE IPQSVSVITS QQMRDQNIKT LDRALLQATG

101  TSRQIYGSDR AGYNYLFARG SRIANYQING IPVADALADT GNANTAAYER

151  VEVVRGVAGL PDGTGEPSAT VNLVRKHPTR KPLFEVRAEA GNRKHFGLGA

201  DVSGSLNAEG TLRGRLVSTF GRGDSWRQLE RSRDAELYGI LEYDIAPQTR

251  VHAGMDYQQA KETADAPLSY AVYDSQGYAT AFGPKDNPAT NWSNSRNRAL

301  NLFAGIEHRF NQDWKLKAEY DYTRSRFRQP YGVAGVLSID HSTAATDLIP

351  GYWHADPRTH SASMSLTGKY RLFGREHDLI AGINGYKYAS NKYGERSIIP

401  NAIPNAYEFS RTGAYPQPSS FAQTIPQYDT RRQIGGYLAT RFRAADNLSL

451  ILGGRYSRYR AGSYNSRTQG MTYVSANRFT PYTGIVFDLT GNLSLYGSYS

501  SLFVPQLQKD EHGSYLKPVT GNNLEADIKG EWLEGRLNAS AAVYRARKNN

551  LATAAGRDQS GNTYYRAANQ AKTHGWEIEV GGRITPEWQI QAGYSQSKPR

601  DQDGSRLNPD SVPERSFKLF TAYHLAPEAP SGRTIGAGVR RQGETHTDPA

651  ALRIPNPAAK ARAVANSRQK AYAVADIMAR YRFNPRTELS LNVDNLFNKH

701  YRTQPDRHSY GALRTVNAAF TYRFK*
```

ORF23ng-1 (SEQ ID NO: 672) and ORF23-1 (SEQ ID NO: 666) show 95.9% identity in 725 aa overlap:

```
                    10         20         30         40         50         60
orf23-1.pep MTRFKYSLLFAALLPVYAQADVSVSDDPKPQESTELPTITVTADRTASSNDGYTVSGTHT
            ||||||||||||||||||||||||||||||||||||||||||||||||||||||||||||
orf23ng-1   MTRFKYSLLFAALLPVYAQADVSVSDDPKPQESTELPTITVTADRTASSNDGYTVSGTHT
                    10         20         30         40         50         60

70         80         90        100        110        120
orf23-1.pep PLGLPMTLREIPQSVSVITSQQMRDQNIKTLDRALLQATGTSRQIYGSDRAGYNYLFARG
            |:||||||||||||||||||||||||||||||||||||||||||||||||||||||||||
orf23ng-1   PFGLPMTLREIPQSVSVITSQQMRDQNIKTLDRALLQATGTSRQIYGSDRAGYNYLFARG
                    70         80         90        100        110        120
```

```
              130       140       150       160       170       180
orf23-1.pep SRIANYQINGIPVADALADTGNANTAAYERVEVVRGVAGLLDGTEPSATVNLVRKRLTR
            ||||||||||||||||||||||||||||||||||||| |||||||||||||||:||
orf23ng-1   SRIANYQINGIPVADALADTGNANTAAYERVEVVRGVAGLPDGTEPSATVNLVRKHPTR
              130       140       150       160       170       180

190       200       210       220       230       240
orf231.pep  KPLFEVRAEAGNRHFPGLDADVSGSLNTEGTLRGRLVSTFGRGDSWRRRERSRDAELYGI
            ||||||||||||||:|||||||||||||:|||||||||||||||||||:|||||||||||
orf23ng-1   KPLFEVRAEAGNRKHFGLGADVSGSLNAEGTLRGRLVSTFGRGDSWRQLERSRDAELYGI
              190       200       210       220       230       240

250       260       270       280       290       300
orf23-1.pep LEYDIAPQTRVHAGMDYQQAKETADAPLSYAVYDSQGYATAFGPKDNPATWWANSRHRAL
            ||||||||||||||||||||||||||||||||||||||||||||||||||:|||:|||
orf23ng-1   LEYDIAPQTRVHAGMDYQQAKETADAPLSYAVYDSQGYATAFGPKDNPATNWSNSRNRAL
              250       260       270       280       290       300

310       320       330       340       350       360
orf231.pep  NLFAGIEHRFNQDWKLKAEYDYTRSRFRQPYGVAGVLSIDHNTAATDLIPGYWHADPRTH
            |||||||||||||||||||||||||||||||||||||||||:||||||||||||||||||
orf23ng-1   NLFAGIEHRFNQDWKLKAEYDYTRSRFRQPYGVAGVLSIDHSTAATDLIPGYWHADPRTH
              310       320       330       340       350       360

370       380       390       400       410       420
orf23-1.pep SASVSLIGKYRLFGREHDLIAGINGYKYASNKYGERSIIPNAIPNAYEFSRTGAYPQPAS
            |||:||||||||||||||||||||||||||||||||||||||||||||||||||||||:|
orf23ng-1   SASMSLTGKYRLFGREHDLIAGINGYKYASNKYGERSIIPNAIPNAYEFSRTGAYPQPSS
              370       380       390       400       410       420

430       440       450       460       470       480
orf23-1.pep FAQTIPQYGTRRQIGGYLATRFRAADNLSLILGGRYTRYRTGSYDSRTQGMTYVSANRFT
            ||||||||| |||||||||||||||||||||||||:|||:|||:||||||||||||||||
orf23ng-1   FAQTIPQYDTRRQIGGYLATRFRAADNLSLILGGRYSRYRAGSYNSRTQGMTYVSANRFT
              430       440       450       460       470       480

490       500       510       520       530       540
orf23-1.pep PYTGIVFDLTGNLSLYGSYSSLFVPQSQKDEHGSYLKPVTGNNLEAGIKGEWLEGRLNAS
            ||||||||||||||||||||||||||| ||||||||||||||||| ||||||||||||||
orf23ng-1   PYTGIVFDLTGNLSLYGSYSSLFVPQLQKDEHGSYLKPVTGNNLEADIKGEWLEGRLNAS
              490       500       510       520       530       540

550       560       570       580       590       600
orf23-1.pep AAVYRARKNNLATAAGRDPSGNTYYRAANQAKTHGWEIEVGGRITPEWQIQAGYSQSKTR
            |||||||||||||||||| |||||||||||||||||||||||||||||||||||||||:|
orf23ng-1   AAVYRARKNNLATAAGRDQSGNTYYRAANQAKTHGWEIEVGGRITPEWQIQAGYSQSKPR
              550       560       570       580       590       600

610       620       630       640       650       660
orf23-1.pep DQDGSRLNPDSVPERSFKLFTAYHFAPEAPSGWTIGAGVRWQSETHTDPATLRIPNPAAK
            |||||||||||||||||||||||||:|||||||| |||||||:|||||||||:|||||||
orf23ng-1   DQDGSRLNPDSVPERSFKLFTAYHLAPEAPSGRTIGAGVRRQGETHTDPAALRIPNPAAK
              610       620       630       640       650       660

670       680       690       700       710       720
orf23-1.pep ARAADNSRQKAYAVADIMARYRFNPRAELSLNVDNLFNKHYRTQPDRHSYGALRTVNAAF
            |||:||||||||||||||||||||||:|||||||||||||||||||||||||||||||||
orf23ng-1   ARAVANSRQKAYAVADIMARYRFNPRTELSLNVDNLFNKHYRTQPDRHSYGALRTVNAAF
              670       680       690       700       710       720 orf23-1.pep TYRFKX
            ||||||
orf23ng-1   TYRFKX
```

In addition, ORF23ng-1 (SEQ ID NO: 672) shows significant homology with an OMP (SEQ ID NO: 1155) from *E.coli*:

sp|P16869|FHUE_ECOLI OUTER-MEMBRANE RECEPTOR FOR FE(III)-COPROGEN, FE(III)-FERRIOXAMINE B AND FE(III)-RHODOTRULIC ACID PRECURSOR)gi|1651542|gnl|PID|d1015403 (D90745) Outer membrane protein FhuE precursor [*Escherichia coli*]) gi|651545|gnl|PID|d105405 (D90746) Outer membrane protein FhUE precursor [*Escherichia coli*])gi|1787344

(AE000210) outer-membrane receptor for Fe(III)-coprogen, Fe(III)-ferrioxamine B and Fe(III)-rhodotrulic acid precursor
[*Escherichia coli*] Length=729
Score=332 bits (843), Expect=3e-90
Identities=228/717 (31%), Positives=350/717 (48%), Gaps= 60/717 (8%)

```
Query:  38 TITVTADRTASSN--DGYTVSGTHTPFGLPMTLREIPQSVSVITSQQMRDQNIKTLDRAL   95
           T+ V    TA  +  + Y+V+ T     + MT R+IPQSV++++ Q+M DQ ++TL    +
Sbjct:  43 TVIVEGSATAPDDGENDYSVTSTSAGTKMQMTQRDIPQSVTIVSQQRMEDQQLQTLGEVM  102

Query:  96 LQATGTSRQIYGSDRAGYNYLFARGSRIANYQINGIP--------VADALADTGNANTAA  147
              G S+      SDRA Y    ++RG +I NY ++GIP        +DAL+D      A
Sbjct: 103 ENTLGISKSQADSDRALY---YSRGFQIDNYMVDGIPTYFESRWNLGDALSDM-----AL  154

Query: 148 YERVEVVRGVAGLPDGTGEPSATVNLVRKHPTRKPLF-EVRAEAGNRKHFGLGADVSGSL  206
           +ERVEVVRG    GL  GTG PSA +N+VRKH T +    +V AE G+       AD+   L
Sbjct: 155 FERVEVVRGATGLMTGTGNPSAAINMVRKHATSREFKGDVSAEYGSWNKERYVADLQSPL  214

Query: 207 NAEGTLRGRLVSTFGRGDSWRQLERSRDAELYGILEYDIAPQTRVHAGMDYQQAKETADA  266
              +G +R R+V +    DSW     S        GI++ D+    T + AG +YQ+     +
Sbjct: 215 TEDGKIRARIVGGYQNNDSWLDRYNSEKTFFSGIVDADLGDLTTLSAGYEYQRIDVNSPT  274

Query: 267 PLSYAVYDSQGYATAFGPKDNPATNWSNSRNRALNLFAGIEHRFNQDWKLKAEYDYTRSR  326
              +++ G + ++    + A +W+ +       +F ++ +F    W+       ++
Sbjct: 275 WGGLPRWNTDGSSNSYDRARSTAPDWAYNDKEINKVFMTLKQQFADTWQATLNATHSEVE  334

Query: 327 F--RQPYGVAGVLSIDHSTAA--TDLIPGY--------WHADPRTHSA-SMSLTGKYRLFG  374
           F  +  Y A V   D     ++ PG+         W++  R  A  +   G Y LFG
Sbjct: 335 FDSKMMYVDAYVNKADGMLVGPYSNYGPGFDYVGGTGWNSGKRKVDALDLFADGSYELFG  394

Query: 375 REHDLIAGINGYKYASNKYGER--SIIPNAIPNAYEFSRTGAYPQPSSFAQTIPQYDTRR  432
           R+H+L+ G    Y    +N+Y    +I P+ I + Y F+  G +PQ     Q++  Q DT
Sbjct: 395 RQHNLMFG-GSYSKQNNRYFSSWANIFPDEIGSFYNFN--GNFPQTDWSPQSLAQDDTTH  451

Query: 433 QIGGYLATRFRAADNLSLILGGRYSRYRAGSYNSRTQGMTY-VSANRFTPYTGIVFDXXX  491
              Y ATR   AD L LILG RY+ +R  +        +TY + N  TPY G+VFD
Sbjct: 452 MKSLYAATRVTLADPLHLILGARYTNWRVDT-------LTYSMEKNHTTPYAGLVFDIND  504

Query: 492 XXXXXXXXXXXXFVPQLQKDEHGSYLKPVTGNNLEADIKGEWLEGRLNASAAVYRARKNNL  551
                       F PQ  +D  G YL P+TGNN E  +K +W+  RL   +A++R  ++N+
Sbjct: 505 NWSTYASYTSIFQPQNDRDSSGKYLAPITGNNYELGLKSDWMNSRLTTTLAIFRIEQDNV  564

Query: 552 ATAAGR---DQSGNTYYRAANQAKTHGWEIEVGGRITPEWQIQAGYSQSKPRDQDGSRLN  608
           A + G       +G T Y+A +   + G E E+G IT  WQ+  G ++     D +G+ +N
Sbjct: 565 AQSTGTPIPGSNGETAYKAVDGTVSKGVEFELNGAITDNWQLTFGATRYIAEDNEGNAVN  624

Query: 609 PDSVPERSFKLFTAYHLAPEAPSGRTIGAGVRRQGETHTDPAALRIPNPAAKARAVANSR  668
           P ++P  +K+FT+Y L P  P     T+G GV  Q    +TD        P    RA
Sbjct: 625 P-NLPRTTVKMFTSYRL-PVMPE-LTVGGGVNWQNRVYTDTV-----TPYGTFRA----E  672

Query: 669 QKAYAVADIMARYRFNPRTELSLNVDNLFNKHYRTQPDRH-SYGALRTVNAAFTYRF     724
              Q +YA+ D+  RY+        L NV+NLF+K Y T  +     YG R  +   TY+F
Sbjct: 673 QGSYALVDLFTRYQVTKNFSLQGNVNNLFDKTYDTNVEGSIVYGTPRNFSITGTYQF     729
```

Based on this analysis, it was predicted that these proteins from *N.meningitidis* and *N.gonorrhoeae*, and their epitopes, could be useful antigens for vaccines or diagnostics, or for raising antibodies.

ORF23-1 (SEQ ID NO: 666) (77.5 kDa) was cloned in pET and pGex vectors and expressed in *E.coli*, as described above. The products of protein expression and purification were analyzed by SDS-PAGE. FIG. 15A shows the results of affinity purification of the His-fusion protein, and FIG. 15B shows the results of expression of the GST-fusion in *E.coli*.

Purified His-fusion protein was used to immunise mice, whose sera were used for Western blot (FIG. 15C) and for ELISA (positive result). These experiments confirm that ORF23-1 (SEQ ID NO: 666) is a surface-exposed protein, and that it is a useful immunogen.

Example 80

The following partial DNA sequence was identified in *N.meningitidis* (SEQ ID NO: 673):

```
  1  ATGCGCACGG CAGTGGTTTT GCTGTTGATC ATGCCGATGG CGGCTTCGTC
 51  GGCAATGATG CCGGAAATGG TGTGCGCGGG CGTGTCGCCG GGAACGGCAA
101  TCATATCCAA GCCGACCGAA CAAACGGCGG TCATGGCTTC GAGTTTGTCC
```

```
-continued
151 AGCGTCAgcA CGCCTGCTTC GGCGgcGgCa ATCATACCTT CGTCTTCGGA

201 AACGGGATA  AACGcGCCAC TCAAACCCCC GACCGCGCTG GAAGCCATCA

251 TGCCGCCTTT TTTCACGGCA TCGTTCAGCA ATGCCAAAGC TGCTGTTGTG

301 CCGTGCGTAC CGCAGACGCT CAAGCCCATT TnTTCAAGAA TGCGTGCCAC

351 TnAGTCGCCG ACGGGG..
```

This corresponds to the amino acid sequence (SEQ ID NO: 674; ORF24):

```
  1 MRTAVVLLLI MPMAASSAMM PEMVCAGVSP GTAIISKPTE QTAVMASSLS

51 SVSTPASAAA IIPSSSETGI NAPLKPPTAL EAIMPPFFTA SFSNAKAAVV

101 PCVPQTLKPI XSRMRATXSP TG..
```

Further work revealed the complete nucleotide sequence (SEQ ID NO: 675):

```
  1 ATGCGCACGG CAGTGGTTTT GCTGTTGATC ATGCCGATGG CGGCTTCGTC

51 GGCAATGATG CCGGAAATGG TGTGCGCGGG CGTGTCGCCG GGAACGGCAA

101 TCATATCCAA GCCGACCGAA CAAACGGCGG TCATGGCTTC GAGTTTGTCC

151 AGCGTCAGCA CGCCTGCTTC GGCGGCGGCA ATCATACCTT CGTCTTCGGA

201 AACGGGGATA AACGCGCCAC TCAAACCCCC GACCGCGCTG GAAGCCATCA

251 TGCCGCCTTT TTTCACGGCA TCGTTCAGCA ATGCCAAAGC TGCTGTTGTG

301 CCGTGCGTAC CGCAGACGCT CAAGCCCATT TCTTCAAGAA TGCGTGCCAC

351 TGAGTCGCCG ACGGCGGGGG TCGGCGCCAG CGACAAGTCG AGAATACCAA

401 ACGGGATATT CAGCATTTTT GAGGCTTCGC GGCCGATGAG TTCGCCCACG

451 CGGGTAATTT TGAAAGCAGT TTTCTTCACT ACTTCCGCAA CTTCGGTCAA

501 TGTCGTTGCA TCTGAATTTT CCAACGCGGC TTTTACGACA CCTGGGCCGG

551 ATACGCCGAC ATTGATAACG GCATCCGCTT CGCCCGAACC ATGAAACGCG

601 CCCGCCATAA ACGGGTTGTC TTCCACCGCG TTGCAGAACA CGACAATTTT

651 AGCGCAGCCG AAACCTTCGG GCGTGATTTC CGCCGTGCGT TTGACGGTTT

701 CGCCCGCCAG CTTGACCGCA TCCATATTGA TACCGGCACG CGTACTGCCG

751 ATATTGATGG AGCTGCACAC AATATCGGTA GTCTTCATCG CTTCGGGAAT

801 GGAGCGGATT AACACCTCAT CCGAAGGCGA CATCCCTTTT TGCACCAACG

851 CGGAAAAACC GCCGATAAAA GACACACCGA TGGCTTTGGC AGCTTTATCC

901 AAAGTTTGCG CCACGCTGAC GTAA
```

This corresponds to the amino acid sequence (SEQ ID NO: 676; ORF24-1):

```
  1 MRTAVVLLLI MPMAASSAMM PEMVCAGVSP GTAIISKPTE QTAVMASSLS

51 SVSTPASAAA IIPSSSETGI NAPLKPPTAL EAIMPPFFTA SFSNAKAAVV

101 PCVPQTLKPI SSRMRATESP TAGVGASDKS RIPNGIFSIF EASRPMSSPT
```

-continued

```
151 RVILKAVFFT TSATSVNVVA SEFSNAAFTT PGPDTPTLIT ASASPEP*NA

201 PAINGLSSTA LQNTTILAQP KPSGVISAVR LTVSPASLTA SILIPARVLP

251 ILMELHTISV VFIASGMERI NTSSEGDIPF CTNAEKPPIK DTPMALAALS

301 KVCATLT*
```

Computer analysis of this amino acid sequence gave the following results:
Homology with a Predicted ORF from N.meningitidis (Strain A)

ORF24 (SEQ ID NO: 674) shows 96.4% identity over a 307 aa overlap with an ORF (ORF24a) (SEQ ID NO: 678) from strain A of N. meningitidis:

```
                       10         20         30         40         50         60
orf24a.pep  MRTAVVLLLIMPMAASSAMMPEMVCAGVSPGTAIISXPTEQTAVIASSLSNVSTPASAAA
            |||||||||||||||||||||||||||||||||||| ||||||||:|||||:||||||||
orf24       MRTAVVLLLIMPMAASSAMMPEMVCAGVSPGTAIISKPTEQTAVMASSLSSVSTPASAAA
                       10         20         30         40         50         60

70         80         90        100        110        120
orf24a.pep  IIPSSSXTGINAPLKPPTALEAIMPPFFTASFSNAKAAVVPCVPQTLKPISSRMRATESP
            ||||||  ||||||||||||||||||||||||||||||||||||||||||||||||||||
orf24       IIPSSSETGINAPLKPPTALEAIMPPFFTASFSNAKAAVVPCVPQTLKPISSRMRATESP
                       70         80         90        100        110        120

130        140        150        160        170        180
orf24a.pep  TAGVGASDKSRTPNGTFSIFEASRPMSSPTRVILKAVFFTTSATSVNVVASEFSNAAFTT
            ||||||||||||||||||||||||||||||||||||||||||||||||||||||||||||
orf24       TAGVGASDKSRIPNGIFSIFEASRPMSSPTRVILKAVFFTTSATSVNVVASEFSNAAFTT
                      130        140        150        160        170        180

190        200        210        220        230        240
orf24a.pep  PGPDTPTLITASASPEPXNAPAIXGLSSXALQNTTILAQPKPSSVISXVRLMVSPASLTA
            ||||||||||||||||||:|||||||||||||||||||:|||:|||  |||  |||||||
orf24       PGPDTPTLITASASPEPXMAPAINGLSSTALQNTTILAQPKPSGVISAVRLTVSPASLTA
                      190        200        210        220        230        240

250        260        270        280        290        300
orf24a.pep  SILIPARVLPILMELHTISVVFIASGMERNNTSSEGDIPFCTSAEKPPIKDTPMALAALS
            ||||||||||||||||||||||||||||||:||||||||||| ||| ||||||||||||
orf24       SILIPARVLPILMELHTISVVFIASGMERINTSSEGDIPFCTNAEKPPTKDTPMALAALS
                      250        260        270        280        290        300 orf24a.pep  KVCATLTX
            ||||||||
orf24       KVCATLTX
```

The complete length ORF24a nucleotide sequence (SEQ ID NO: 677) is:

```
  1 ATGCGCACGG CAGTGGTTTT GCTGTTGATC ATGCCGATGG CGGCTTCGTC

51 GGCAATGATG CCGGAAATGG TGTGCGCGGG TGTGTCGCCG GGAACGGCAA

101 TCATATCCAA NCCGACCGAA CAAACGGCGG TCATCGCTTC GAGTTTATCC

151 AACGTCAGCA CGCCTGCTTC GGCGGCGGCA ATCATACCTT CGTCTTCGGA

201 NACGGGGATA AACGCGCCAC TCAAACCGCC AACCGCGCTC GAAGCCATCA

251 TGCCGCCCTT TTTCACGGCA TCGTTCAGCA ATGCCAAAGC TGCTGTTGTG

301 CCGTGCGTAC CGCAGACGCT CAAACCCATT TCTTCAAGAA TGCGCGCCAC

351 CGAGTCGCCG ACGGCAGGGG TCGGTGCCAG CGACAAGTCG AGAATACCAA

401 ACGGGATATT CAGCATTTTT GAGGCTTCGC GGCCGATGAG TTCGCCCACG

451 CGGGTAATTT TGAAGGCGGT TTTCTTCACA ACTTCGGCAA CTTCGGTCAA

501 TGTCGTTGCA TCCGAATTTT CCAACGCGGC TTTTACGACA CCCGGGCCGG
```

```
551 ATACGCCGAC ATTAATCACA GCATCCGCTT CGCCTGAGCC GTGAAACGCG

601 CCCGCCATAN ACGGGTTGTC TTCCNCCGCG TTGCAGAACA CGACGATTTT

651 GGCGCAGCCG AAACCTTCTA GTGTGATTTC ANCCGTGCGT TTGATGGTTT

701 CGCCCGCCAG TCTGACCGCG TCCATATTGA TACCGGCGCG CGTACTGCCG

751 ATATTGATGG AGCTGCACAC GATATCAGTA GTCTTCATCG CTTCGGGAAT

801 GGAACGGATN AACACCTCGT CAGAAGGCGA CATACCTTTT TGCACCAGCG

851 CGGAAAAGCC GCCAATAAAA GACACGCCGA TGGCTTTGGC AGCCTTATCC

901 AAAGTTTGCG CCACGCTGAC GTAA
```

This encodes a protein having amino acid sequence (SEQ ID NO: 678):

```
  1 MRTAVVLLLI MPMAASSAMM PEMVCAGVSP GTAIISXPTE QTAVIASSLS

51 NVSTPASAAA IIPSSSXTGI NAPLKPPTAL EAIMPPFFTA SFSNAKAAVV

101 PCVPQTLKPI SSRMRATESP TAGVGASDKS RIPNGIFSIF EASRPMSSPT

151 RVILKAVFFT TSATSVNVVA SEFSNAAFTT PGPDTPTLIT ASASPEP*NA

201 PAIXGLSSXA LQNTTILAQP KPSSVISXVR LMVSPASLTA SILIPARVLP

251 ILMELHTISV VFIASGMERX NTSSEGDIPF CTSAEKPPIK DTPMALAALS

301 KVCATLT*
```

It should be noted that this protein includes a stop codon at position 198.

ORF24a (SEQ ID NO: 678) and ORF24-1 (SEQ ID NO: 676) show 96.4% identity in 307 aa overlap:

```
                      10         20         30         40         50         60
orf24a.pep   MRTAVVLLLIMPMAASSAMMPEMVCAGVSPGTAIISXPTEQTAVIASSLSNVSTPASAAA
             |||||||||||||||||||||||||||||||||||| |||||||:|||||:|||||||||
orf24-1      MRTAVVLLLIMPMAASSAMMPEMVCAGVSPGTAIISKPTEQTAVMASSLSSVSTPASAAA
                      10         20         30         40         50         60

70         80         90        100        110        120
orf24a.pep   IIPSSSXTGINAPLKPPTALEAIMPPFFTASFSNAKAAVVPCVPQTLKPISSRMRATESP
             ||||||  ||||||||||||||||||||||||||||||||||||||||||||||||||||
orf24-1      IIPSSSETGINAPLKPPTALEAIMPPFFTASFSNAKAAVVPCVPQTLKPISSRMRATESP
                      70         80         90        100        110        120

130        140        150        160        170        180
orf24a.pep   TAGVGASDKSRIPNGIFSIFEASRPMSSPTRVILKAVFFTTSATSVNVVASEFSNAAFTT
             ||||||||||||||||||||||||||||||||||||||||||||||||||||||||||||
orf24-1      TAGVGASDKSRIPNGIFSIFEASRPMSSPTRVILKAVFFTTSATSVNVVASEFSNAAFTT
                     130        140        150        160        170        180

190        200        210        220        230        240
orf24a.pep   PGPDTPTLITASASPEPXNAPAIXGLSSXALQNTTILAQPKPSSVISXVRLMVSPASLTA
             |||||||||||||||||:||||  ||||:|||||||||||||:||| ||| |||||||||
orf24-1      PGPDTPTLITASASPEPXNAPAINGLSSTALQNTTILAQPKPSGVISAVRLTVSPASLTA
                     190        200        210        220        230        240

250        260        270        280        290        300
orf24a.pep   SILIPARVLPILHELMTISVVFIASGMERXNTSSEGDIPFCTSAEKPPIKDTPMALAALS
             |||||||||||:||||||||||||||||| ||||||||||||:|||||||||||||||||
orf24        SILIPARVLPILMELHTISVVFIASGMERINTSSEGDIPFCTNAEKPPIKDTPMALAALS
                     250        260        270        280        290        300 orf24a.pep   KVCATLTX
             ||||||||
orf24        KVCATLTX
```

Homology with a Predicted ORF from N.gonorrhoeae
ORF24 (SEQ ID NO: 674) shows 96.7% identity over a
121 aa overlap with a predicted ORF (ORF24ng) (SEQ ID
NO: 680) from N.gonorrhoeae:

```
orf24.pep  MRTAVVLLLIMPMAASSAMMPEMVCAGVSPGTAIISKPTEQTAVMASSLSSVSTPASAAA   60
           ||||||||||||||||||||||||||||||||:||||||||||||||||||:|||||||
orf24ng    MRTAVVLLLIMPMAASSAMMPEMVCAGVSPGTAIMSKPTEQTAVMASSLSSVNTPASAAA   60 orf24.pep  IIPSSSETGINAPLKPPTALEAIMPPFFTASFSNAKAAVVPCVPQTLKPIXSRMRATXSP  120
           ||||||||||||||||||||||||||||||||||||||||||||||||||| |||||| ||
orf24ng    IIPSSSETGINAPLKPPTALEAIMPPFFTASFSNAKAAVVPCVPQTLKPISSRMRATESP  120 orf24.pep  TG                                                            122
           |:
orf24ng    TAGVGASDKSRMPNGIFSIFEASRPMSSPTRVILKAVFFTTSATSVRLTASEFSSAALTT  180
```

The complete length ORF24ng nucleotide sequence (SEQ
ID NO: 679) is:

```
  1  ATGCGCACGG CGGTGGTTTT GCTGTTGATC ATGCCGATGG CGGCTTCGTC
 51  GGCGATGATG CCGGAAATGG TGTGCGCGGG CGTGTCGCCG GGAACGGCAA
101  TCATGTCCAA ACCAACGGAG CAGACGGCGG TCATGGCTTC GAGTTTGTCC
151  AGCGTCAACA CGCCTGCCTC GGCGGCGGCA ATCATACCTT CGTCTTCGGA
201  AACGGGGATA AACGCGCCGC TCAAACCGCC GACCGCGCTG AAGCCATCA
251  TGCCGCCCTT TTTCACGGCA TCGTTCAGCA ATGCCAAAGC TGCTGTTGTG
301  CCGTGCGTAC CGCAGACGCT CAAGCCCATT TCTTCAAGAA TGCGCGCCAC
351  CGAGTCGCCG ACGGCGGGGG TCGGTGCCAG CGACAAATCG AGAATGCCGA
401  ACGGGATATT CAGCATTTTT GAGGCTTCGC GACCGATGAG TTCGCCCACG
451  CGGGTGATTT TGAAAGCGGT TTTCTTCACG ACTTCGGCGA CCTCGGTCAG
501  GCTGACCGCG TCCGAATTTT CCAGCGCGGC TTTGACCACG CCTGGACCGG
551  ATACGCCGAC ATTAATCACA GCATCCGCTT CGCCCGAGCC GTGGAACGCA
601  CCCGCCATAA ACGGATTGTC TTCCACCGCG TTGCAGAACA CGACGATTTT
651  GGCGCAGCCG AAACCTTCGG GTGTGATTTC AGCCGTGCGT TTGATGGTTT
701  CGCCTGCCAG CTTGACCGCA TCCATATTGA TACCGGCACG CGTGCTGCCG
751  ATATTGATGG AGCTGCACAC GATATCGGTA GTTTTCATCG CTTCGGGAAC
801  GGAACGGATC AACACCTCAT CCGAAGGCGA CATACCTTTT TGCACCAGCG
851  CGGAAAAGCC GCCGATAAAG GACACGCCGA TGGCTTTGGC TGCCTTGTCC
901  AAAGTCTGCG CCACGCTGAC ATAA
```

This encodes a protein having amino acid sequence (SEQ
ID NO: 680):

```
  1  MRTAVVLLLI MPMAASSAMM PEMVCAGVSP GTAIMSKPTE QTAVMASSLS
 51  SVNTPASAAA IIPSSSETGI NAPLKPPTAL EAIMPPFFTA SFSNAKAAVV
101  PCVPQTLKPI SSRMRATESP TAGVGASDKS RMPNGIFSIF EASRPMSSPT
151  RVILKAVFFT TSATSVRLTA SEFSSAALTT PGPDTPTLIT ASASPEPWNA
201  PAINGLSSTA LQNTTILAQP KPSGVSAVR LMVSPASLTA SILIPARVLP
251  ILMELHTTSV VFIASGTERI NTSSEGDIPF CTSAEKPPIK DTPMALAALS
301  KVCATLT*
```

ORF24ng (SEQ ID NO: 680) and ORF24-1 (SEQ ID NO: 676) show 96.1% identity in 307 aa overlap:

```
                    10        20        30        40        50        60
orf24-1.pep MRTAVVLLLIMPMAASSAMMPEMVCAGVSPGTAIISKPTEQTAVMASSLSSVSTPASAAA
            |||||||||||||||||||||||||||||||:||||||||||||||||||:|||||||
orf24ng     MRTAVVLLLIMPMAASSAMMPEMVCAGVSPGTAIMSKPTEQTAVMASSLSSVNTPASAAA
                    10        20        30        40        50        60

70        80        90       100       110       120
orf24-1.pep IIPSSSETGINAPLKPPTALEAIMPPFFTASFSNAKAAVVPCVPQTLKPISSRMRATESP
            ||||||||||||||||||||||||||||||||||||||||||||||||||||||||||||
orf24ng     IIPSSSETGINAPLKPPTALEAIMPPFFTASFSNAKAAVVPCVPQTLKPISSRMRATESP
                    70        80        90       100       110       120

130       140       150       160       170       180
orf24-1.pep TAGVGASDKSRIPNGIFSIFEASRPMSSPTRVILKAVFFTTSATSVNVVASEFSNAAFTT
            ||||||||||:||||||||||||||||||||||||||||||||||  ::||||||:||:||
orf24ng     TAGVGASDKSRMPNGIFSIFEASRPMSSPTRVILKAVFFTTSATSVRLTASEFSSAALTT
                   130       140       150       160       170       180

190       200       210       220       230       240
orf24-1.pep PGPDTPTLITASASPEPXNAPAINGLSSTALQNTTILAQPKPSGVISAVRLTVSPASLTA
            |||||||||||||||||||  |||||||||||||||||||||||||||||||  |||||||
orf24ng     PGPDTPTLITASASPEPWNAPAINGLSSTALQNTTILAQPKPSGVISAVRLMVSPASLTA
                   190       200       210       220       230       240

250       260       270       280       290       300
orf24-1.pep STLTPARVLPILMELHTISVVFIASGMERINTSSEGDIPFCTNAEKPPIKDTPMALAALS
            |||||||||||||||||||||||||||:|||||||||||||||:||||||||||||||||
orf24ng     STLTPARVLPILMELHTISVVFIASGTERINTSSEGDIPFCTSAEKPPIKDTPMAAAALS
                   250       260       270       280       290       300 orf24-1.pep KVCATLTX
            ||||||||
orf24ng     KVCATLTX
```

Based on this analysis, including the presence of a putative leader sequence (first 18 aa—double-underlined) and putative transmembrane domains (single-underlined) in the gonococcal protein, it is predicted that the proteins from N.meningitidis and N.gonorrhoeae, and their epitopes, could be useful antigens for vaccines or diagnostics, or for raising antibodies.

Example 81

The following partial DNA sequence was identified in N.meningitidis (SEQ ID NO: 681):

```
  1   ..ACCGACGTGC AAAAAGAGTT GGTCGGCGAA CAACGAAAGT GGGCGCAGGA
 51     AAAAATCAGC AACTGCCGAC AAGCCGCCGC GCAGGCAGAC CGGCAGGAAT
101     ACGCCGAATA CCTCAAGCTG CAATGCGACA CGCGGATGAC GCGCGAACGG
151     ATACAGTATC TTCGCGGCTA TTCCATCGAT TAG
```

This corresponds to the amino acid sequence (SEQ ID NO: 682; ORF25):

```
  1   ..TDVQKELVGE QRKWAQEKIS NCRQAAAQAD RQEYAEYLKL QCDTRMTRER
 51     IQYLRGYSID *
```

Further revealed the complete nucleotide sequence (SEQ ID NO: 683):

```
  1   ATGTATCGGA AACTCATTGC GCTGCCGTTT GCCCTGCTGC TTGCCGCTTG
 51   CGGCAGGGAA GAACCGCCCA AGGCATTGGA ATGCGCCAAC CCCGCCGTGT
101   TGCAAGGCAT ACGCGGCAAT ATTCAGGAAA CGCTCACGCA GGAAGCGCGT
```

-continued

```
 151   TCTTTCGCGC GCGAAGACGG CAGGCAGTTT GTCGATGCCG ACAAAATTAT
 201   CGCCGCCGCC TACGGTTTGG CGTTTTCTTT GGAACACGCT TCGGAAACGC
 251   AGGAAGGCGG GCGCACGTTC TGTATCGCCG ATTTGAACAT TACCGTGCCG
 301   TCTGAAACGC TTGCCGATGC CAAGGCAAAC AGCCCCCTGT TGTACGGGGA
 351   AACTGCTTTG TCGGATATTG TGCGGCAGAA GACGGGCGGC AATGTCGAGT
 401   TTAAAGACGG CGTATTGACG GCAGCCGTCC GCTTCCTGCC CGTCAAAGAC
 451   GGTCAGACGG CATTTGTCGA CAACACGGTC GGTATGGCGG CGCAAACGCT
 501   GTCTGCCGCG CTGCTGCCTT ACGGCGTGAA GAGCATCGTG ATGATAGACG
 551   GCAAGGCGGT GAAAAAAGAA GACGCGGTCA GGATTTTGAG CGGAAAAGCC
 601   CGTGAAGAAG AACCGTCCAA ACCCACGCCC GAAGACATTT TGGAACACAA
 651   TGCCGCCGGC GGCGATGCGG GCGTACCCCA AGCCGCAGAA GGCGCGCCCG
 701   AACCGGAAAT CCTGCATCCT GACGACGGCG AGCGTGCCGA TACCGTTACC
 751   GTATCACGGG GCGAAGTGGA AGAGGCGCGC GTACAAAACC AGCGTGCGGA
 801   ATCCGAAATT ACCAAACTTT GGGGAGGACT CGATACCGAC GTGCAAAAAG
 851   AGTTGGTCGG CGAACAACGC AAGTGGGCGC AGGAAAAAAT CAGCAACTGC
 901   CGACAAGCCG CCGCGCAGGC AGACCGGCAG GAATACGCCG AATACCTCAA
 951   GCTGCAATGC GACACGCGGA TGACGCGCGA ACGGATACAG TATCTTCGCG
1001   GCTATTCCAT CGATTAG
```

This corresponds to the amino acid sequence (SEQ ID NO: 684; ORF25-1):

```
  1    MYRKLIALPF ALLLAACGRE EPPKALECAN PAVLQGIRGN IQETLTQEAR
 51    SFAREDGRQF VDADKIIAAA YGLAFSLEHA SETQEGGRTF CIADLNITVP
101    SETLADAKAN SPLLYGETAL SDIVRQKTGG NVEFKDGVLT AAVRFLPVKD
151    GQTAFVDNTV GMAAQTLSAA LLPYGVKSIV MIDGKAVKKE DAVRILSGKA
201    REEEPSKPTP EDILEHNAAG GDAGVPOAAE GAPEPEILHP DDGERADTVT
251    VSRGEVEEAR VQNQRAESEI TKLWGGLDTD VQKELVGEQR KWAQEKISNC
301    RQAAAQADRQ EYAEYLKLQC DTRMTRERIQ YLRGYSID*
```

Computer analysis of this amino acid sequence gave the following results:
Homology with a Predicted ORF from *N.meningitidis* (Strain A)

ORF25 (SEQ ID NO: 682) shows 98.3% identity over a 60aa overlap with an ORF (ORF25a) (SEQ ID NO: 686) from strain A of *N. meningitidis*:

```
                                      10         20         30
orf25.pep                      TDVQKELVGEQRKWAQEKISNCRQAAAQAD
                               |||||||||| ||||||||||||||||||
orf25a    VTVSRGEVEEARVQNQRAESEITKLWGGLDTDVQKELVGEXRKWAQEKISNCRQAAAQAD
                250       260       270       280       290       300

40         50         60
orf25.pep  RQEYAEYLKLQCDTRMTRERIQYLRGYSIDX
           |||||||||||||||||||||||||||||||
orf25a     RQEYAEYLKLQCDTRMTRERIQYLRGYSIDX
              310       320       330
```

The complete length ORF25a nucleotide sequence (SEQ ID NO: 685) is:

```
   1  ATGTATCGGA AACTCATTGC GCTGCCGTTT GCCCTGCTGC TTGCCGCTTG
  51  CGGCAGGGAA GAACCGCCCA AGGCATTGGA ATGCGCCAAC CCCGCCGTGT
 101  TGCAANGCAT ACGCNGCAAT ATTCAGGAAA CGCTCACGCA GGAAGCGCGT
 151  TCTTTCGCGC GCGAAGACNG CANGCAGTTT GTCGATGCCG ACNAAATTAT
 201  CGCCGCCGCC TANGNTNNGN NGNTNTCTTT GGAACACGCT TCGGAAACGC
 251  AGGAAGGCGG GCGCACGTTC TGTNTCGCCG ATTTGAACAT TACCGTGCCG
 301  TCTGAAACGC TTGCCGATGC CAAGAAAAAC AGCCCCCTGC TGTACGGGGA
 351  AACCGCTTTG TCGGATATTG TGCGGCAGAA GACGGGCGGC AATGTCGAGT
 401  TTAAAGACGG CGTATTGACG GCAGCCGTCC GCTTCCTACC CGTCAAAGAC
 451  GGTCAGANGG CATTTGTCGA CAACACGGTC GGTATGGCGG CGCAAACGCT
 501  GTCTGCCGCG TTGCTGCCTT ACGGCGTGAA GAGCATCGTG ATGATAGACG
 551  GCAAGGCGGT AAAAAAGAA GACGCGGTCA GGATTNTGAG CNGANAAGCC
 601  CGTGAANAAG AACCGTCCAA ANCCNNGCCC GAAGACATTT TGGAACATAA
 651  TGCCGCCGGA GGGGATGCAG ACGTACCCCA AGCCGGAGAA GACGCGCCCG
 701  AACCGCAAAT CCTGCATCCT GACGACGGCG AGCGTGCCGA TACCGTTACC
 751  GTATCACGGG GCGAAGTGGA ACAGGCGCGN GTACAAAACC AGCGTGCCGA
 801  ATCCGAAATT ACCAAACTTT GGGGAGGACT CGATACCGAC GTGCAAAAAG
 851  AGTTGGTCGG CGAANAACGC AAGTGGGCGC AGGAAAAAAT CAGCAACTGC
 901  CGACAAGCCG CCGCGCAGGC AGACCGGCAG GAATACGCCG AATACCTCAA
 951  GCTGCAATGC GACACGCGGA TGACGCGCGA ACGGATACAG TATCTTCGCG
1001  GCTATTCCAT CGATTAG
```

This encodes a protein having amino acid sequence (SEQ ID NO: 686):

```
  1  MYRKLIALPF ALLLAACGRE RPPKALECAN PAVLQXIRXN IQETLTQEAR
 51  SFAREDXXQF VDADXIIAAA XXXXXSLEHA SETQEGGRTP CXADLNITVP
101  SETLADAKAN SPLLYGETAL SDIVRQKTGG NVEFKDGVLT AAVRFLPVKD
151  GQXAFVDNTV GMAAQTLSAA LLPYGVKSIV MIDGKAVKKE DAVRIXSXXA
201  REXEPSXXXP EDILEHNAAG GDADVPQAGE DAPEPEZLHP DDGERADTVT
251  VSRGEVEEAR VQNQPAESEI TKLWGGLTTD VQKELVGEXR KWAQEKISNC
301  RQAAAQADRQ EYAEYLKLQC DTRMTRERIO YLRGYSID*
```

ORF25a (SEQ ID NO: 686) and ORF25-1 (SEQ ID NO: 684) show 93.5% identity in 338 aa overlap:

```
                    10         20         30         40         50         60
orf25a.pep  MYRKLIALPFALLLAACGREEPPKALECANPAVLQXIRXNIQETLTQEARSFAREDXXQF
            ||||||||||||||||||||||||||||||||||||   ||  ||||||||||||||.||
orf25-1     MYRKLIALPFALLLAACGREEPPKALECANPAVLQGIRGNIQETLTQEARSFAREDGRQF
                    10         20         30         40         50         60
```

```
                   70        80        90       100       110       120
orf25a.pep  VDADXIIAAAXXXXXSLEHASETQEGGRTFCXADLNITVPSETLADAKANSPLLYGETAL
            ||||  |||||     ||||||||||||||| ||||||||||||||||||||||||||||
orf25-1     VDADKIIAAAYGLAESLEHASETQEGGRTFCIADLNITVPSETLADAKANSPLLYGETAL
                   70        80        90       100       110       120

130       140       150       160       170       180
orf25a.pep  SDIVRQKTGGNVEFKDGVLTAAVRFLPVKDGQXAFVDNTVGMAAQTLSAALLPYGVKSIV
            |||||||||||||||||||||||||||||||:|||||||||||||||||||||||||||
orf25-1     SDIVRQKTGGNVEFKDGVLTAAVRFLPVKDGQTAFVDNTVGMAAQTLSAALLPYGVKSIV
                  130       140       150       160       170       180

190       200       210       220       230       240
orf25a.pep  MIDGKAVKKEDAVRIXSXXAREXEPSKXXXPEDILEHNAAGGDADVPQAGEDAPEPEILHP
            ||||||||||||||  |  ||| ||||:  ||||||||||||| |||| :|||||||||
orf25-1     MIDGKAVKKEDAVRILSGKAREEEPSKPTPEDILEHNAAGGDAGVPQAAEGAPEPEILHP
                  190       200       210       220       230       240

250       260       270       280       290       300
orf25a.pep  DDGERADTVTVSRGEVEEARVQNQRAESEITKLWGGLDTDVQKELVGEXRKWAQEKISNC
            |||||||||||||||||||||||||||||||||||||||||||||||| ||||||||||
orf25-1     DDGERADTVTVSRGEVEEARVQNQRAESEXTKLWGGLDTDVQKELVGEQRKWAQEKISNC
                  250       260       270       280       290       300

310       320       330    339
orf25a.pep  RQAAAQADRQEYAEYLKLQCDTRMTRERIQYLRGYSIDX
            |||||||||||||||||||||||||||||||||||||||
orf25-1     RQAAAQADRQEYAEYLKLQCDTRMTRERIQYLRGYSIDX
                  310       320       330
```

Homology with a Predicted ORF from *N.gonorrhoeae*

ORF25 (SEQ ID NO: 682) shows 100% identity over a 60aa overlap with a predicted ORF (ORF25ng) (SEQ ID NO: 688) from *N.gonorrhoeae*:

```
orf25.pep                         TDVQKELVGEQRKWAQEKISNCRQAAAQAD   30
                                  ||||||||||||||||||||||||||||||
orf25ng    VTVSRGEVEEARVQNQRAESEITKLWGGLDTDVQKELVGEQRKWAQEKISNCRQAAAQAD  308 orf25.pep  RQEYAEYLKLQCDTRMTRERIQYLRGYSID                                60
           ||||||||||||||||||||||||||||||
orf25ng    RQEYAEYLKLQCDTRMTRERIQYLRGYSID                               338
```

The complete length ORF25ng nucleotide sequence (SEQ ID NO: 687) is:

```
  1   ATGTATCGGA AACTCATTGC GCTGCCGTTT GCCCTGCTGC TTGCAGCGTG

51   CGGCAGGGAA GAACCGCCCA AGGCGTTGGA ATGCGCCAAC CCCGCCGTGT

101   TGCAGGACAT ACGCGGCAGT ATTCAGGAAA CGCTCACGCA GGAAGCGCGT

151   TCTTTCGCGC GCGAAGACGG CAGGCAGTTT GTCGATGCCG ACAAAATTAT

201   CGCCGCCGCC TACGGTTTGG CGTTTTCTTT GGAACACGCT TCGGAAACGC

251   AGGAAGGCGG GCGCACGTTC TGTATCGCCG ATTTGAACAT TACCGTGCCG

301   TCTCAAACGC TTGCCGATGC CGAGGCAAAC AGCCCCCTGC TGTATGGGGA

351   AACGTCTTTG GCAGACATCG TGCAGCAGAA GACGGGCGGC AATGTCGAGT

401   TTAAAGACGG CGTATTGACG GCAGCCGTCC GCTTCCTGCC CGCCAAAGAC

451   GCTCGGACGG CATTTATCGA CAACACGGTC GGTATGGCGA CGCAAACGCT

501   GTCTGCCGCG TTGCTGCCTT ACGGCGTGAA GAGCATCGTG ATGATAGACG

551   GCAAGGCGGT GACAAAAGAA GACGCGGTCA GGGTTTTGAG CGGCAAAGCC

601   CGTGAAGAAG AACCGTCCAA ACCCACCCCC GAAGACATTT TGGAACACAA
```

```
                              -continued
 651    TGCCGCCGGC GGCGATGCGG GCGTACCCCA AGCCGCAGAA GGCGCACCCG

701    AACCCGAAAT CCTGCATCCC GACGACGTCG AGCGTGCCGA TACCGTTACC

751    GTATCACGGG GCGAAGTGGA AGAGGCGCGC GTACAAAACC AACGTGCGGA

801    ATCCGAAATT ACCAAACTTT GGGGAGGACT CGATACCGAC GTGCAAAAAG

851    AGTTGGTCGG CGAACAGCGC AAGTGGGCGC AGGAAAAAAT CAGcaactgc 901    cgACAAGCCG CCGCGCAGGC AGACCGGCAG GAATACGCCG AATACCTCAA 951    GCTCCAATGC GACACGCGGA TGACGCGCGA ACggaTACAG TATCTTCGCG

1001    GCTATTCCAT CGATTAG
```

This encodes a protein having amino acid sequence (SEQ ID NO: 688):

```
  1    MYRKLIALPF ALLLAACGRE EPPKALECAN PAVLQDIRGS IQETLTQEAR

51    SFAREDGRQF VDADKIIAAA YGLAFSLEHA SETQEGGRTF CIADLNITVP

101    SETLADAEAN SPLLYGETSL ADIVQQKTGG NVEFKDGVLT AAVRFLPAKD

151    ARTAFIDNTV GMATQTLSAA LLPYGVKSIV MIDGKAVTKE DAVRVLSGKA

201    REEEPSKPTP FDILEHNAAG GDAGVPQAAE GAPEPEILHP DDVERADTVT

251    VSRGEVEEAR VQNQRAESEI TKLWGSLDTD VQKELVGEQR KWAQEKISNC

301    RQAAAQADRQ EYAEYLKLQC DTRMTRERIQ YLRGYSID*
```

ORF25ng (SEQ ID NO: 688) and ORF25-1 (SEQ ID NO: 684) show 95.9% identity in 338 aa overlap:

```
                  10         20         30         40         50         60
orf25-1.pep MYRKLIALPFALLLAACGREEPPKALECANPAVLQGIRGNIQETLTQEARSFAREDGRQF
            ||||||||||||||||||||||||||||||||||| |||:||||||||||||||||||||
orf25ng     MYRKLIALPFALLLAACGREEPPKALECANPAVLQDIRGSIQETLTQEARSFAREDGRQF
                  10         20         30         40         50         60

70         80         90        100        110        120
orf25-1.pep VDADKIIAAAYGLAFSLEHASETQEGGRTFCIADLNITVPSETLADAKANSPLLYGETAL
            |||||||||||||||||||||||||||||||||||||||||||||:||||||||||||:|
orf25ng     VDADKIIAAAYGLAFSLEHASETQEGGRTFCIADLNITVPSETLADAKANSPLLYGETSL
                  70         80         90        100        110        120

130        140        150        160        170        180
orf25-1.pep SDXVRQKTGGNVEFKDGVLTAAVRFLPVKDGQTAFVDNTVGMAAQTLSAALLPYGVKSIV
            :|||:||||||||||||||||||:||::|||:||||||:|||||||||||||||||||||
orf25ng     ADIVQQKTGGNVEFKDGVLTAAVRFLPAKDARTAFIDNTVGMATQTLSAALLPYGVKSIV
                 130        140        150        160        170        180

190        200        210        220        230        240
orf25-1.pep MIDGKAVKKEDAVRILSGKAREEEPSKPTPEDILEHNAAGGDAGVPQAAEGAPEPEILHP
            ||||||| |||||| :|||||||||||||||||||||||||||||||||||||||||||
orf25ng     MIDGKAVTKEDAVRVLSGKAREEEPSKPTPEDILEHNAAGGDAGVPQAAEGAPEPEILHP
                 190        200        210        220        230        240

250        260        270        280        290        300
orf25-1.pep DDGERADTVTVSRGEVEEARVQNQRAESEITKLWGGLDTDVQKELVGEQRKWAQEKISNC
            || ||||||||||||||||||||||||||||||||| |||||||||||||||||||||||
orf25ng     DDVERADTVTVSRGEVEEARVQNQRAESEITKLWGGLDTDVQKELVGEQRKWAQEKISNC
                 250        260        270        280        290        300

310        320        330        339
orf25-1.pep RQAAAQADRQEYAEYLKLQCDTRMTRERIQYLRGYSIDX
            |||||||||||||||||||||||||||||||||||||||
orf25ng     RQAAAQADRQEYAEYLKLQCDTRMTRERIQYLRGYSIDX
                 310        320        330
```

Based on this analysis, including the presence of a predicted prokaryotic membrane lipoprotein lipid attachment site (underlined) in the gonococcal protein, it was predicted that the proteins from *N.meningitidis* and *N.gonorrhoeae*, and their epitopes, could be useful antigens for vaccines or diagnostics, or for raising antibodies.

ORF25-1 (SEQ ID NO: 684) (37 kDa) was cloned in pET and pGex vectors and expressed in *E.coli*, as described above. The products of protein expression and purification were analyzed by SDS-PAGE. FIG. 16A shows the results of affinity purification of the GST-fusion protein, and FIG. 16B shows the results of expression of the His-fusion in *E.coli*.

Purified His-fusion protein was used to immunise mice, whose sera were used for Western blot (FIG. 16C), ELISA (positive result), and FACS analysis (FIG. 16D). These experiments confirm that ORF25-1 (SEQ ID NO: 684) is a surface-exposed protein, and that it is a useful immunogen.

Figure 16E:
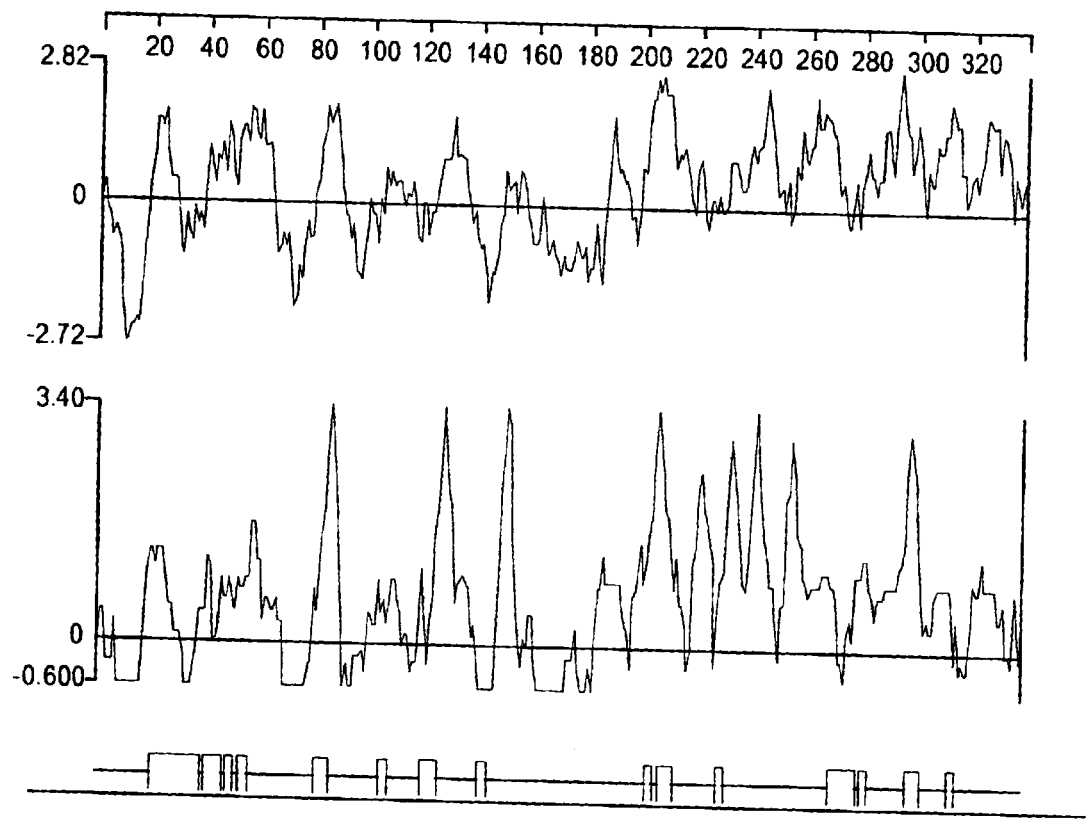

FIG. 16E shows plots of hydrophilicity, antigenic index, and AMPHI regions for ORF25-1 (SEQ ID NO: 684).

Example 82

The following partial DNA sequence was identified in *N.meningitidis* (SEQ ID NO: 689)

```
   1 ATGCAGCTGA TCGACTATTC ACATTCATTT TTCTCGGTTG TGCCACCCTT
  51 TTTGGCACTG GCACTTGCCG TCATTACCCG CCGCGTACTG CTGTCTTTAG
 101 GCATCGGTAT TCTGGwysGC GTTGCCTTTT TGGTCGGCGG CAACCCCGTC
 151 GACGGTCTGA CACACCTGAA AGACATGGTC GTCGGCTTGG CTTGGTCAGA
 201 CGsyGATTGG TCGCTGGGCA AACCAAAAAT CTTGGTTTTC CkGATACTTT
 251 TGGGTATTTT TACTTCCCTG CTGACCTACT CCGGCAGCAA T.........
                                     //
 851 .......... .......... .......... ........AC TTCGCTGGTA
 901 TTCGGCGGCA CTTGCGGCGT CTTTGCCGTC GTTCTCTGCA CGCTCGGCAC
 951 GATTAAAACC GCCGACTATC CCAAAGCCGT TTGGCAGGGT GCGAAATCTA
1001 TGTTCGGCGC AATCGCCATT TTAATCCTCG CTTGGCTCAT CAGTACGGTT
1051 GTCGGCGAAA TGCACACCGG CGATTACCTC TCCACACTGG TTGCGGGCAA
1101 CATCCATCCC GGCTTCCTGC CCGTCATCCT CTTCCTGCTC GCCAGCGTGA
1151 TGGCGTTTGC CACAGGCACA AGCTGGGGGA CGTTCGGCAT TATGCTGCCG
1201 ATTGCCGCCG CCATGGCGGT CAAAGTCGAA CCCGCGCTGA TTATCCCGTG
1251 TATGTCCGCA GTAATGGCGG GGGCGGTATG CGGCGACCAC TGCTCGCCCA
1301 TTTCCGACAC GACCATCCTG TCGTCCACCG GCGCGCGCTG CAACCACATC
1351 GACCACGTTA CCTCGCAACT GCCTTACGCC TTAACCGTTG CCGCCGCCGC
1401 CGCATCGGGC TACCTCGCAT TGGGTCTGAC AAAATCCGCG CTGTTGGGCT
1451 TTGGCACGAC AGGCATTGTA TTGGCGGTGC TGATTTTTCT GTTGAAAGAT
1501 AAAAAA..
```

This corresponds to the amino acid sequence (SEQ ID NO: 690; ORF26):

```
   1 MQLIDYSHSF FSVVPPFLAL ALAVITRRVL LSLGIGILXX VAFLVGGNPV
  51 DGLTHLKDMV VGLAWSDXDW SLGKPKILVF XILLGIFTSL LTYSGSN...
                                     //
 251 .......... .......... .......... .......... ......TSLV
 301 FGGTCGVFAV VLCTLGTIKT ADYPKAVWQG AKSMFGAIAI LILAWLISTV
 351 VGEMHTGDYL STLVAGNIHP GFLPVILFLL ASVMAFATGT SWGTFGIMLP
 401 IAAAMAVKVE PALIIPCMSA VMAGAVCGDH CSPISDTTIL SSTGARCNHI
 451 DHVTSQLPYA LTVAAAAASG YLALGLTKSA LLGFGTTGIV LAVLIFLLKD
 501 KK..
```

Further work revealed the complete nucleotide sequence (SEQ D) NO: 691):

```
   1  ATGCAGCTGA TCGACTATTC ACATTCATTT TTCTCGGTTG TGCCACCCTT
  51  TTTGGCACTG GCACTTGCCG TCATTACCCG CCGCGTACTG CTGTCTTTAG
 101  GCATCGGTAT TCTGGTCGGC GTTGCCTTTT TGGTCGGCGG CAACCCCGTC
 151  GACGGTCTGA CACACCTGAA AGACATGGTC GTCGGCTTGG CTTGGTCAGA
 201  CGGCGATTGG TCGCTGGGCA AACCAAAAAT CTTGGTTTTC CTGATACTTT
 251  TGGGTATTTT TACTTCCCTG CTGACCTACT CCGGCAGCAA TCAGGCGTTT
 301  GCCGACTGGG CAAAACGGCA CATTAAAAAC CGGCGCGGCG CGAAAATGCT
 351  GACCGCCTGC CTCGTGTTCG TAACCTTTAT CGACGACTAT TTCCACAGTC
 401  TCGCCGTCGG TGCGATTGCC CGCCCCGTTA CCGACAAGTT TAAAGTTTCC
 451  CGCACCAAAC TCGCCTACAT CCTCGACTCC ACTGCCGCTC CTATGTGCGT
 501  GCTGATGCCC GTTTCAAGCT GGGGCGCGTC GATTATCGCC ACGCTTGCCG
 551  GACTGCTCGT TACCTACAAA ATCACCGAAT ACACGCCGAT GGGGACGTTT
 601  GTCGCCATGA GCCTGATGAA CTATTACGCA CTGTTTGCCC TGATTATGGT
 651  GTTCGTCGTC GCATGGTTTT CCTTCGACAT CGGCTCGATG GCACGTTTCG
 701  AACAAGCCGC GTTGAACGAA GCCCACGATG AAACTGCCGT TCAGACGCT
 751  ACCAAAGGTC GTGTTTACGC ACTGATTATT CCCGTTTTGG CCTTAATCGC
 801  CTCAACGGTT TCCGCCATGA TCTACACCGG CGCGCAGGCA AGCGAAACCT
 851  TCAGCATTTT GGGGGCATTT GAAAACACGG ACGTAAACAC TTCGCTGGTA
 901  TTCGGCGGCA CTTGCGGCGT CCTTGCCGTC GTTCTCTGCA CGCTCGGCAC
 951  GATTAAAACC GCCGACTATC CCAAAGCCGT TTGGCAGGGT GCGAAATCTA
1001  TGTTCGGCGC AATCGCCATT TTAATCCTCG CTTGGCTCAT CAGTACGGTT
1051  GTCGGCGAAA TGCACACCGG CGATTACCTC TCCACACTGG TTGCGGGCAA
1101  CATCCATCCC GGCTTCCTGC CCGTCATCCT CTTCCTGCTC GCCAGCGTGA
1151  TGGCGTTTGC CACAGGCACA AGCTGGGGGA CGTTCGGCAT TATGCTGCCG
1201  ATTGCCGCCG CCATGGCGGT CAAAGTCGAA CCCGCGCTGA TTATCCCGTG
1251  TATGTCCGCA GTAATGGCGG GGGCGGTATG CGGCGACCAC TGCTCGCCCA
1301  TTTCCGACAC GACCATCCTG TCGTCCACCG GCGCGCGCTG CAACCACATC
1351  GACCACGTTA CCTCGCAACT GCCTTACGCC TTAACCGTTG CCGCCGCCGC
1401  CGCATCGGGC TACCTCGCAT GGGTCTGAC AAAATCCGCG CTGTTGGGCT
1451  TTGGCACGAC AGGCATTGTA TTGGCGGTGC TGATTTTTCT GTTGAAAGAT
1501  AAAAAACGCG CCAACGCCTG A
```

This corresponds to the amino acid sequence (SEQ ED NO: 692; ORF26-1):

```
   1  MQLIDYSHSF FSVVPPFLAL ALAVITRRVL LSLGIGILVG VAFLVGGNPV
  51  DGLTHLKDMV VGLAWSDGDW SLGKPKILVF LILLGIFTSL LTYSGSNQAF
 101  ADWAKRHIKN RRGAKMLTAC LVFVTFIDDY FHSLAVGAIA RPVTDKFKVS
 151  RTKLAYILDS TAAPMCVLMP VSSWGASIIA TLAGLLVTYK ITEYTPMGTF
```

-continued

```
201 VAMSLMNYYA LFALIMVFVV AWFSFDIGSM ARFEQAALNE AHDETAVSDA

251 TKGRVYALII PVLALIASTV SAMIYTGAQA SETFSILGAF ENTDVNTSLV

301 FGGTCGVLAV VLCTLGTIKT ADYPKAVWQG AKSMFGAIAI LILAWLISTV

351 VGEMMTGDYL STLVAGNIHP GFLPVILFLL ASVMAFATGT SWGTFGIMLP

401 IAAAMAVKVE PALIIPCMSA VMAGAVCGDH CSPISDTTIL SSTGARCNHI

451 DHVTSQLPYA LTVAAAAASG YLALGLTKSA LLGFGTTGIV LAVLIFLLKD

501 KKRANA*
```

Computer analysis of this amino acid sequence gave the following results:

Homology with the Hypothetical Transmembrane Protein HI1586 (SEQ ID NO: 1156) of *H.influenzae* (Accession Number P44263)

ORF26 (SEQ ID NO: 690) and HI1586 (SEQ ID NO: 1156) show 53% and 49% amino acid identity in 97 and 221 aa overlap at the N-terminus and C-terminus, respectively:

```
Orf26     1 MQLIDYSHSFFSVVPPFLALALAVITRRVXXXXXXXXXXXXVAFLVGGNPVDGLTHLKDMV   60
            M+LID+S S +S+VP  LA+ LA+ TRRV               L        +L    V
HI1586   14 MELIDFSSSVWSIVPALLAIILAIATRRVLVSLSAGIIIGSLMLSDWQIGSAFNYLVKNV   73

Orf26    61 VGLAWSDXDWSLGKPKILVFXILLGIFTSLLTYSGSN                          97
            V L ++D + +     I++F +LLG+ T+LLT SGSN
HI1586   74 VSLVYADGEIN-SNMNIVLFLLLLGVLTALLTVSGSN                         109

//

Orf26    86 IFTSLLTYSGS--NTSLVFGGTCGVFAVVLCTL--GTIKTADYPKAVWQGAKSMFGXXXX  141
            +F+ L T+   +     TSLV GG C +    L  +     +Y ++   G KSM G
HI1586  299 VFSVLGTFENTVVGTSLVVGGFCSIIISTLLIILDRQVSVPEYVRSWIVGIKSMSGAIAI  358

Orf26   142 XXXXXXXSTVVGEMHTGDYLSTLVAGNIHPGFLPVILFLLASVMAFATGTSWGTFGIMLP  201
                   + +VG+M TG YLS+LV+GNI    FLPVILF+L + MAF+TGTSWGTFGIMLP
HI1586  359 LFFAWTINKIVGDMQTGKYLSSLVSGNIPMQFLPVILFVLGAAMAFSTGTSWGTFGIMLP  418

Orf26   202 IAAAMAVKVEPALIIPCMSAVMAGAVCGDHCSPISDTTILSSTGARCNHIDHVTSQXXXX  261
            IAAAMA    P L++PC+SAVMAGAVCGDHCSP+SDTTILSSTGA+CNHIDHVT+Q
HI1586  419 IAAAMAANAAPELLLPCLSAVMAGAVCGDCSPVSDTTILSSTGAKCNHIDHVTTQLPYA  478
Orf26   262 XXXXXXXXXXXXXXXXXKSALLGFGTTGIVLAVLIFLLKDK                    302
                              S L GF  T + L V+IF +K +
HI1586  479 ATVATATSIGYIVVGFTYSGLAGFAATAVSLIVIIFAVKKR                   519
```

Homology with a Predicted ORF from *N.meningitidis* (Strain A)

ORF26 (SEQ ID NO: 690) shows 58.2% identity over a 502aa overlap with an ORF (ORF26a) (SEQ ID NO: 694) from strain A of *N. meningitidis*:

```
                    10        20        30        40        50        60
orf26.pep  MQLIDYSHSFFSVVPPFLALALAVITRRVLLSLGIGILXXVAFLVGGNPVDGLTHLKDMV
           |||||||||||||||||||||||||||||||||||||  |||||||||||||||||||||
orf26a     MQLIDYSHSFFSVVPPFLALALAVITRRVLLSLGIGILVGVAFLVGGNPVDGLTHLKDMV
                    10        20        30        40        50        60

70        80        90      99
orf26.pep  VGLAWSDXDWSLGKPKILVFXILLGIFTSLLTYSGSNXX---------------------
           |||||||  |||||||| ||| ||||||||||||||||
orf26a     VGLAWSDGDWSLGKPKXLVFLILLGIFTSLLTYSGSNQAFADWAKRHIKNRRGAKMLTAC
                    70        80        90       100       110       120 orf26.pep  ------------------------------------------------------------ orf26a     LVFVTFIDDYFHSLAVGAXARPVTDKFKVSRAKLAYILDSTAAPMCVLMPVSSWGASIIA
                   130       140       150       160       170       180
```

-continued

```
orf26.pep  ---------------------------------------------------------------- orf26a     TLAGLLVTYKITEYTPMGTFVAMSLMNYYALFALIMVFVVAWFSFDIGSMARFEQAALNE
                190       200       210       220       230       240

100       110
orf26.pep  ------------------------------------------------------TSLV
                                                                 ||||
orf26a     AHDETAVSDGSWGRVYALIIPVLALIASTVSAMIYTGAQASETFSILGAFENTDVNTSLV
                250       260       270       280       290       300

120       130       140       150       160       170
orf26.pep  FGGTCGVFAVVLCTLGTIKTADYPKAVWQGAKSMFGAIAILILAWLISTVVGEMHTGDYL
           |||||||:|||||||||||| ||||||||||||||||||||||||||||||||||||||
orf26a     FGGTCGVLAVVLCTLGTIKIADYPKAVWQGAKSMFGAIAILILAWLISTVVGEMHTGDYL
                310       320       330       340       350       360

180       190       200       210       220       230
orf26.pep  STLVAGNIHPGFLPVILFLLASVMAFATGTSWGTFGIMLPIAAAMAVKVEPALIIPCMSA
           ||||||||||||| ||||||||||||||||||||||||||||||||||:|:||||||||
orf26a     STLVAGNIHPGFLXVILFLLASVMAFATGTSWGTFGIMLPIAAAMAVKVDPSLIIPCMSA
                370       380       390       400       410       420

240       250       260       270       280       290
orf26.pep  VMAGAVCGDHCSPISDTTILSSTGARCNHIDHVTSQLPYALTVAAAAASGYLALGLTKSA
           ||||||||||||||||||||||||||||||||||||||||||||||||||||||||||||
orf26a     VMAGAVCGDHCSPISDTTILSSTGARCNHIDHVTSQLPYALTVAAAAASGYLALGLTKSA
                430       440       450       460       470       480

300       310
orf26.pep  LLGFGTTGIVLAVLIFLLKDKK
           |||||:||||||||||||||||
orf26a     LLGFGXTGIVLAVLIFLLKDKKRANAX
                490       500
```

The complete length ORF26a nucleotide sequence (SEQ ID NO: 693) is:

```
  1   ATGCAGCTGA TCGACTATTC ACATTCATTT TTCTCGGTTG TGCCACCCTT

51   TTTGGCACTG GCACTTGCCG TCATTACCCG CCGCGTACTG CTGTCTTTAG

101   GCATCGGTAT TCTGGTCGGC GTTGCCTTTT TGGTCGGCGG CAACCCCGTC

151   GACGGTCTGA CACACCTGAA AGACATGGTC GTCGGCTTGG CTTGGTCAGA

201   CGGCGATTGG TCGCTGGGCA AACCAAAANT CTTGGTTTTC CTGATACTTT

251   TGGGTATTTT TACTTCCCTG CTGACCTACT CCGGCAGCAA TCAGGCGTTT

301   GCCGACTGGG CAAAACGGCA CATTAAAAAC CGGCGCGGCG CGAAAATGCT

351   GACCGCCTGC CTCGTGTTCG TAACCTTTAT CGACGACTAT TTCCACAGTC

401   TCGCCGTCGG TGCGNTTGCC CGCCCCGTTA CCGACAAGTT TAAAGTTTCC

451   CGCGCCAAAC TCGCCTACAT CCTCGACTCC ACTGCCGCGC CTATGTGCGT

501   GCTGATGCCC GTTTCAAGCT GGGGCGCGTC GATTATCGCC ACGCTTGCCG

551   GACTGCTCGT TACCTACAAA ATCACCGAAT ACACGCCGAT GGGGACGTTT

601   GTCGCCATGA GCCTGATGAA CTATTACGCA CTGTTTGCCC TGATTATGGT

651   GTTCGTCGTC GCATGGTTCT CCTTCGACAT CGGCTCGATG GCACGTTTCG

701   AACAAGCCGC GTTGAACGAA GCCCACGATG AAACTGCCGT TTCAGACGGC

751   AGCTGGGGCA GGGTTTACGC ATTGATTATT CCCGTTTTGG CCTTAATCGC

801   CTCAACGGTT TCCGCCATGA TCTACACCGG TGCACAGGCA AGCGAAACCT

851   TCAGCATTTT GGGTGCATTT GAAAATACGG ACGTGAACAC TTCGCTGGTA

901   TTCGGCGGCA CTTGCGGCGT GCTTGCCGTC GTCCTCTGCA CGCTCGGCAC
```

```
                           -continued
  951    GATTAAAATC GCCGATTATC CCAAAGCCGT TTGGCAGGGT GCGAAATCCA

1001    TGTTCGGCGC AATCGCCATT TTAATCCTTG CCTGGCTCAT CAGTACGGTT

1051    GTCGGCGAAA TGCACACAGG CGACTACCTC TCCACGCTGG TTGCGGGCAA

1101    CATCCATCCC GGCTTCCTGN CCGTCATCCT TTTCCTGCTC GCCAGCGTGA

1151    TGGCGTTTGC CACAGGCACA AGCTGGGGGA CGTTCGGCAT CATGCTGCCG

1201    ATTGCCGCCG CCATGGCGGT CAAAGTCGAT CCCTCACTGA TTATCCCGTG

1251    TATGTCCGCC GTGATGGCGG GGGCGGTATG CGGCGACCAC TGCTCGCCCA

1301    TTTCCGACAC GACCATCCTG TCGTCCACCG GCGCGCGCTG CAACCACATC

1351    GACCACGTTA CNTCGCAACT GCCTTACGCC TTAACCGTTG CCGCCGCCGC

1401    CGCATCGGGN TACCTCGCAT TGGGTCTGAC AAAATCCGCG CTGTTGGGTT

1451    TTGGCANGAC AGGCATTGTA TTGGCGGTGC TGATTTTTCT GTTGAAAGAT

1501    AAAAAACGCG CCAACGCCTG A
```

This encodes a protein having amino acid sequence (SEQ ID NO: 694):

```
  1    MQLIDYSHSF FSVVPPFLAL ALAVITRRVL LSLGIGILVG VAFLVGGNPV

51    DGLTHLKDMV VGLAWSDGDW SLGKPKXLVF LILLGIFTSL LTYSGSNQAF

101    ADWAARHIKN RRGAKMLTAC LVFVTFIDDY FHSLAVGAXA RPVTDKFKVS

151    RAKLAYILDS TAAPMCVLMP VSSWGASIIA TLAGLLVTYK ITEYTPMGTF

201    VAMSLMNYYA LFALIMVFVV AWFSFDIGSM ARFEQAALNE AHDETAVSDG

251    SWGRVYALII PVLALIASTV SAMIYTGAQA SETFSILGAF ENTDVNTSLV

301    FGGTCGVLAV VLCTLGTIKI ADYPKAVWQG AKSMFGAIAI LILAWLISTV

351    VGEMHTGDYL STLVAGNIHP GFLXVILFLL ASVMAFATGT SWGTFGIMLP

401    IAAAMAVKVD PSLIIPCMSA VMAGAVCGDH CSPISDTTIL SSTGGRCNHI

451    DHVTSQLPYA LTVAAAASG YLALGLTKSA LLGFGXTGIV LAVLIFLLKD

501    KKRANA*
```

ORF26a (SEQ ID NO: 694) and ORF26-1 (SEQ ID NO: 692) show 97.8% identity in 506 aa overlap:

```
                    10         20         30         40         50         60
orf26a.pep   MQLIDYSHSFFSVVPPFLALALAVITRRVLLSLGIGILVGVAFLVGGNPVDGLTHLKDMV
             ||||||||||||||||||||||||||||||||||||||||||||||||||||||||||||
orf26-1      MQLIDYSHSFFSVVPPFLALALAVITRRVLLSLGIGILVGVAFLVGGNPVDGLTHLKDMV
                    10         20         30         40         50         60

70         80         90        100        110        120
orf26a.pep   VGLAWSDGDWSLGKPKXLVFLILLGIFTSLLTYSGSNQAFADWAKRHIKNRRGAKMLTAC
             |||||||||||||||| |||||||||||||||||||||||||||||||||||||||||||
orf26-1      VGLAWSDGDWSLGKPKILVFLILLGIFTSLLTYSGSNQAFADWAKRHIKNRRGAKMLTAC
                    70         80         90        100        110        120

130        140        150        160        170        180
orf26a.pep   LVFVTFIDDYFHSLAVGAXARPVTDKFKVSRAKLAYILDSTAAPMCVLMPVSSWGASIIA
             |||||||||||||||||||| |||||||||||:|||||||||||||||||||||||||||
orf26-1      LVFVTFIDDYFHSLAVGAIARPVTDKFKVSRTKLAYILDSTAAPMCVLMPVSSWGASIIA
                   130        140        150        160        170        180

190        200        210        220        230        240
orf26a.pep   TLAGLLVTYKITEYTPMGTFVAMSLMNYYALFALIMVFVVAWFSFDIGSMARFEQAALNE
             ||||||||||||||||||||||||||||||||||||||||||||||||||||||||||||
```

```
                  -continued
orf26-1   TLAGLLVTYKITEYTPMGTFVAMSLMNYYALFALIMVFVVAWFSFDIGSMARFEQAALNE
               190       200       210       220       230       240

250       260       270       280       290       300
orf26a.pep AHDETAVSDGSWGRVYALIIPVLALIASTVSAMIYTGAQASETFSILGAFENTDVNTSLV
           ||||||||::|||||||||||||||||||||||||||||||||||||||||||||||||
orf26-1    AHDETAVSDATKGRVYALIIPVLALIASTVSAMIYTGAQASETFSILGAFENTDVNTSLV
               250       260       270       280       290       300

310       320       330       340       350       360
orf26a.pep FGGTCGVLAVVLCTLGTIKIADYPKAVWQGAKSMFGAIAILILAWLISTVVGEMHTGDYL
           ||||||||||||||||||| ||||||||||||||||||||||||||||||||||||||||
orf26-1    FGGTCGVLAVVLCTLGTIKTADYPKAVWQGAKSMFGAIAILILAWLISTVVGEMHTGDYL
               310       320       330       340       350       360

370       380       390       400       410       420
orf26a.pep STLVAGNIHPGFLXVILFLLASVMAFATGTSWGTFGIMLPIAAAMAVKVDPSLIIPCMSA
           ||||||||||||| |||||||||||||||||||||||||||||||||||:|:||||||||
orf26-1    STLVAGNIHPGFLPVILFLLASVMAFATGTSWGTFGIMLPIAAAMAVKVEPALIIPCMSA
               370       380       390       400       410       420

430       440       450       460       470       480
orf26a.pep VMAGAVCGDHCSPISDTTILSSTGARCNHIDHVTSQLPYALTVAAAAASGYLALGLTKSA
           ||||||||||||||||||||||||||||||||||||||||||||||||||||||||||||
orf26-1    VMAGAVCGDHCSPISDTTILSSTGARCNHIDHVTSQLPYALTVAAAAASGYLALGLTKSA
               430       440       450       460       470       480

490       500
orf26a.pep LLGFGXTGIVLAVLIFLLKDKKRANAX
           |||||:|||||||||||||||||||||
orf26-1    LLGFGTTGIVLAVLIFLLKDKKRANAX
               490       500
```

Homology with a Predicted ORF from *N.gonorrhoeae*

ORF26 (SEQ ID NO: 690) shows 94.8% and 99% identity in 97 and 206 aa overlap at the N-terminus and C-terminus, respectively, with a predicted ORF (ORF26ng) (SEQ ID NO: 696) from *N. gonorrhoeae*:

```
orf26.pep MQLIDYSHSFFSVVPPFLALALAVITRRVLLSLGIGILXXVAFLVGGNPVDGLTHLKDMV  60
          |||||||||||||||||||||||||||||||||||||  ||||||||||||||||||||
orf26ng   MQLIDYSHSFFSVVPPFLALALAVITRRVLLSLGIGILVGVAFLVGGNPVDGLTHLKDMV  60 orf26.pep VGLAWSDXDWSLGKPKILVFXILLGIFTSLLTYSGSN                         97
          |||||:| |||||||||||||:|||||||||||||||
orf26ng   VGLAWADGDWSLGKPKILVFLILLGIFTSLLTYSGSNQAFADWAKRHIKNRCGAKMLTAC 120
                                               // orf26.pep                                     TSLVFGGTCGVFAVVLCTLGTIKTADYPKA 326
                                              |||||||||||:||||||:|||||||||||
orf26ng   ASTVSAMIYTGAQASETFSILGAFENTDVNTSLVFGGTCGVLAVVLCTFGTIKTADYPKA 326 orf26.pep VWQGAKSMFGAIAILILAWLISTVVGEMHTGDYLSTLVAGNIHPGFLPVILFLLASVMAF 386
          ||||||||||||||||||||||||||||||||||||||||||||||||||||||||||||
orf26ng   VWQGAKSMFGAIAILILAWLISTVVGEMHTGDYLSTLVAGNIHPGFLPVILFLLASVMAF 386 orf26.pep ATGTSWGTFGIMLPIAAAMAVKVEPALIIPCMSAVMAGAVCGDHCSPISDTTILSSTGAR 446
          ||||||||||||||||||||||||||||||||||||||||||||||||||||||||||||
orf26ng   ATGTSWGTFGIMLPIAAAMAVKVEPALIIPCMSAVMAGAVCGDHCSPISDTTILSSTGAR 446 orf26.pep CNHIDHVTSQLPYALTVAAAAASGYLALGLTKSALLGFGTTGIVLAVLIFLLKDKK     502
          |||||||||||||||||||||||||||||||||||||||||||||||||||||||
orf26ng   CNHIDHVTSQLPYALTVAAAAASGYLALGLTKSALLGFGTTGIVLAVLIFLLKDKKRADV 506
```

The complete length ORF26ng nucleotide sequence (SEQ ID NO: 695) is:

```
  1   ATGCAGCTGA TTGACTATTC ACATTCATTT TTCTCGGTTG TGCCACCCTT

51   TTTGGCACTG GCACTTGCCG TCATTACCCG CCGCGTACTG CTGTCTTTAG

101   GCATCGGTAT TTTGGTCGGC GTTGCCTTTT TGGTCGGCGG CAACCCCGTC
```

-continued

```
 151   GACGGTCTGA CACACCTGAA AGACATGGTC GTCGGCTTGG CTTGGGCAGA
 201   CGGCGATTGG TCGCTGGGCA AACCAAAAAT CTTGGTTTTC CTGATACTTT
 251   TGGGCATTTT CACTTCACTG CTGACCTACT CCGGCAGCAA TCAGGCGTTT
 301   GCCGACTGGG CAAAACGGCA CATTAAAAAC CGGTGCGGCG CGAAAATGCT
 351   GACCGCCTGC CTCGTGTTCG TAACCTTTAT CGACGACTAT TTCCACAGCC
 401   TCGCCGTCGG TGCGATTGCC CGCCCCGTTA CCGACAAGTT TAAAGTTTCC
 451   CGCGCCAAAC TCGCCTACAT CCTCGACTCC ACTGCCTCGC CCATGTGCGT
 501   GCTGATGCCC GTTTCAAGCT GGGGCGCGTC GATTATCGCC ACGCTTGCCG
 551   GATTGCTCGT TACCTACAAA ATTACCGAAT ACACGCCGAT GGGGACGTTT
 601   GTCGCCATGA GCCTGATGAA CTATTACGCG CTGTTTGCCC TGATTATGGT
 651   ATTCGTCGTC GCATGGTTCT CCTTCGACAT CGGCTCGAtg gCGCGTTTCG
 701   AACAGGCTGC GTTGAACGAA gcccaggacg aaaccgccgc tTCAGACgCT
 751   ACCAAAGGTC GTGTTTACGC ATTGATTATT CCCGTTTTGG CCTTAATCGC
 801   CTCAACGGTT TCCGCCATGA TCTACACCGG CGCGCAGGCA AGCGAAACCT
 851   TCAGCATTTT GGGGGCATTT GAAAATACCG ACGTAAACAC TTCGCTGGTA
 901   TTCGGCGGCA CTTGCGGCGT GCTTGCCGTC GTCCTCTGCA CGTTCGGCAC
 951   GATTAAAACC GCCGATTATC CCAAAGCCGT GTGGCAGGGT GCGAAATCCA
1001   TGTTCGGCGC AATCGCCATT TTAATCCTCG CCTGGCTCAT CAGTACGGTT
1051   GTCGGCGAAA TGCACACGGG CGACTACCTC TCCACGCTGG TTGCGGGCAA
1101   CATCCATCCC GGCTTCCTGC CCGTCATCCT CTTCCTGCTC GCCAGCGTGA
1151   TGGCGTTTGC CACAGGCACA AGCTGGGGGA CGTTCGGCAT TATGCTGCCG
1201   ATTGCCGCCG CCATGGCGGT CAAAGTCGAA CCCGCGCTGA TTAtcccGTG
1251   TATGTCCGCA GTAATGGCGG GGGCGGTATG CGGCGACCAC TGTTCGCCCA
1301   TCTCCGACAC GACCATCCTG TCGTCCACCG GCGCGCGCTG CAACCACATC
1351   GACCACGTTA CCTCGCAACT GCCTTATGCC CTGACGGTTG CCGCCGCCGC
1401   CGCATCGGGC TACCTCGCAT GGGTCTGAC AAAATCCGCG CTGTTGGGCT
1451   TTGGCACGAC CGGTATTGTA TTGGCGGTGC TGATTTTTCT GTTGAAAGAT
1501   AAAAAACGCG CCGACGTTTG A
```

This encodes a protein having amino acid sequence (SEQ ID NO: 696):

```
  1   MQLIDYSHSF FSVVPPFLAL ALAVITRRVL LSLGIGILVG VAFLVGGNPV
 51   DGLTHLKDMV VGLAWADGDW SLGKPKILVF LILLGIFTSL LTYSGSNQAF
101   ADWAKRHIKN RCGAKMLTAC LVFVTFIDDY FHSLAVGAIA RPVTDKFKVS
151   RAKLAYILDS TASPMCVLMP VSSWGASIIA TLAGLLVTYK ITEYTPMGTF
201   VAMSLMNYYA LFALIMVFVV AWFSFDIGSM ARFEQAALNE AQDETAASDA
251   TKGRVYALII PVLALIASTV SAMIYTGAQA SETFSILGAF ENTDVNTSLV
301   FGGTCGVLAV VLCTFGTIKT ADYPKAVWQG AKSMFGAIAI LILAWLISTV
351   VGEMHTGDYL STLVAGNIHP GFLPVILFLL ASVMAFATGT SWGTFGIMLP
401   IAAAMAVKVE PALIIPCMSA VMAGAVCGDH CSPISDTTIL SSTGARCNHI
```

-continued

```
451 DHVTSQLPYA LTVAAAAASG YLALGLTKSA LLGFGTTGIV LAVLIFLLKD

501 KKRADV*
```

ORF26ng (SEQ ID NO: 696) and ORF26-1 (SEQ ID NO: 692) show 98.4% identity in 505 aa overlap:

```
                    10         20         30         40         50         60
orf26-1.pep MQLIDYSHSFFSVVPPFLALALAVITRRVLLSLGIGILVGVAFLVGGNPVDGLTHLKDMV
            ||||||||||||||||||||||||||||||||||||||||||||||||||||||||||||
orf26ng     MQLIDYSHSFFSVVPPFLALALAVITRRVLLSLGIGILVGVAFLVGGNPVDGLTHLKDMV
                    10         20         30         40         50         60

70         80         90        100        110        120
orf26-1.pep VGLAWSDGDWSLGKPKILVFLILLGIFTSLLTYSGSNQAFADWAKRHIKNRRGAKMLTAC
            |||||:||||||||||||||||||||||||||||||||||||||||||||||| ||||||
orf26ng     VGLAWADGDWSLGKPKILVFLILLGIFTSLLTYSGSNQAFADWAKRHIKNRCGAKMLTAC
                    70         80         90        100        110        120

130        140        150        160        170        180
orf26-1.pep LVFVTFIDDYFHSLAVGAIARPVTDKFKVSRTKLAYILDSTAAPMCVLMPVSSWGASIIA
            |||||||||||||||||||||||||||||||||:||||||||:|||||||||||||||||
orf26ng     LVFVTFIDDYFHSLAVGAIARPVTDKFKVSRAKLAYILDSTASPMCVLMPVSSWGASIIA
                   130        140        150        160        170        180

190        200        210        220        230        240
orf26-1.pep TLAGLLVTYKITEYTPMGTFVAMSLMNYYALFALIMVFVVAWFSFDIGSMARFEQAALNE
            ||||||||||||||||||||||||||||||||||||||||||||||||||||||||||||
orf26ng     TLAGLLVTYKITEYTPMGTFVAMSLMNYYALFALIMVFVVAWFSFDIGSMARFEQAALNE
                   190        200        210        220        230        240

250        260        270        280        290        300
orf26-1.pep AHDETAVSDATKGRVYALIIPVLALIASTVSAMIYTGAQASETFSILGAFENTDVNTSLV
            |:||||:||||||||||||||||||||||||||||||||||||||||||||||||||||
orf26ng     AQDETAASDATKGRVYALIIPVLALIASTVSAMIYTGAQASETFSILGAFENTDVNTSLV
                   250        260        270        280        290        300

310        320        330        340        350        360
orf26-1.pep FGGTCGVLAVVLCTLGTIKTADYPKAVWQGAKSMFGAIAILILAWLISTVVGEMHTGDYL
            |||||||||||||:||||||||||||||||||||||||||||||||||||||||||||||
orf26ng     FGGTCGVLAVVLCTFGTIKTADYPKAVWQGAKSMFGAIAILILAWLISTVVGEMHTGDYL
                   310        320        330        340        350        360

370        380        390        400        410        420
orf26-1.pep STLVAGNIHPGFLPVILFLLASVMAFATGTSWGTFGIMLPIAAAMAVKVEPALIIPCMSA
            ||||||||||||||||||||||||||||||||||||||||||||||||||||||||||||
orf26ng     STLVAGNIHPGFLPVILFLLASVMAFATGTSWGTFGIMLPIAAAMAVKVEPALIIPCMSA
                   370        380        390        400        410        420

430        440        450        460        470        480
orf26-1.pep VMAGAVCGDHCSPISDTTILSSTGARCNHIDHVTSQLPYALTVAAAAASGYLALGLTKSA
            ||||||||||||||||||||||||||||||||||||||||||||||||||||||||||||
orf26ng     VMAGAVCGDHCSPISDTTILSSTGARCNHIDHVTSQLPYALTVAAAAASGYLALGLTKSA
                   430        440        450        460        470        480

490        500
orf26-1.pep LLGFGTTGIVLAVLIFLLKDKKRANAX
            |||||||||||||||||||||||||::
orf26ng     LLGFGTTGIVLAVLIFLLKDKKRADVX
                   490        500
```

In addition, ORF26 ng (SEQ ID NO: 696) shows significant homology to a hypothetical *H.influenzae* protein(SEQ ID NO: 1156):

```
sp|P44263|YF86_HAEIN HYPOTHETICAL PROTEIN HI1586 )gi|1074850|pir||C64037
hypothetical
protein HI1586 - Haemophilus influenzae (strain Rd KW20) )gi|1574427 (U32832) H.
influenzae predicted coding region HI1586 [Haemophilus influenzae] Length = 519
Score = 538 bits (1370), Expect = e-152
Identities = 280/507 (55%), Positives = 346/507 (68%), Gaps = 7/507 (1%)

Query:  1 MQLIDYSHSFFSVVPPFLALALAVITRRXXXXXXXXXXXXXXAFLVGGNPVDGLTHLKDMV  60
          M+LID+S S +S+VP  LA+ LA+ TRR              L        +L     V
Sbjct: 14 MELIDFSSSVWSIVPALLAIILAIATRRVLVSLSAGIIIGSLMLSDWQIGSAFNYLVKNV  73
```

-continued

```
Query:  61 VGLAWADGDWSLGKPKILVFLILLGIFTSLLTYSGSNQAFADWAKRHIKNRCGAKMLTAC  120
           V L +ADG+ +      I++FL+LLG+ T+LLT SGSN+AFA+WA+  IK R GAK+L A
Sbjct:  74 VSLVYADGEIN-SNMNIVLFLLLLGVLTALLTVSGSNRAFAEWAQSRIKGRRGAKLLAAS  132

Query: 121 LVFVTFIDDYFHSLAVGAIARPVTDKFKVSRAKLAYILDSTASPMCVLMPVSSWGASIIA  180
           LVFVTFIDDYFHSLAVGAIARPVTD+FKVSRAKLAYILDSTA+PMCV+MPVSSWGA II
Sbjct: 133 LVFVTFIDDYFHSLAVGAIARPVTDRFKVSRAKLAYILDSTAAPNCVMMPVSSWGAYIIT  192

Query: 181 TLAGLLVTYKITEYTPMGTFVAMSLMNYYALFALIMVFVVAWFSFDIGSMARFEQAALNE  240
           + GLL TY ITEYTP+G FVAMS MN+YA+F++IMVF VA+FSFDI SM R E+ AL
Sbjct: 193 LIGGLLATYSITEYTPIGAFVAMSSMNFYAIFSIIMVFFVAYFSFDIASMVRHEKLALKN  252

Query: 241 AQDETAASDATKGRVYALIIPVLALIASTVSAMIYTGAQA----SETFSILGAFENTDVN  296
           +D+     TKG+V LI+P+L LI +TVS MIYTGA+A       + FS+LG FENT V
Sbjct: 253 TEDQLEEETGTKGQVRNLILPILVLIIATVSMMIYTGAEALAADGKVFSVLGTFENTVVG  312

Query: 297 TSLVFGGTCGVL--AVVLCTFGTIKTADYPKAVWQGAKSMFGXXXXXXXXXXXXSTVVGEM  354
           TSLV GG C ++   ++      +    +Y ++   G KSM G            + +VG+M
Sbjct: 313 TSLVVGGFCSIIISTLLIILDRQVSVPEYVRSWIVGIKSMSGAIAILFFAWTINKIVGDM  372

Query: 355 HTGDYLSTLVAGNIHPGFLPVILFLLASVMAFATGTSWGTFGIMLPIAAAMAVKVEPALT  414
           TG YLS+LV+GNI   FLPVILF+L + MAF+TGTSWGTFGIMLPIAAAMA   P L+
Sbjct: 373 QTGKYLSSLVSGNIPMQFLPVILFVLGAAMAFSTGTSWGTFGIMLPIAAAMAANAAPELL  432

Query: 415 IPCMSAVMAGAVCGDHCSPTSDTTTLSSTGARCNHIDHVTSQXXXXXXXXXXXXXXXXXX  474
           +PC+SAVMAGAVCGDHCSP+SDTTTLSSTGA+CNHIDHVT+Q
Sbjct: 433 LPCLSAVMAGAVCGDHCSPVSDTTILSSTGAKCNHIDHVTTQLPYAATVATATSIGYIVV  492

Query: 475 XXXKSALLGFGTTGIVLAVLIFLLKDK                                  501
              S L GF  T + L V+IF +K +
Sbjct: 493 GFTYSGLAGFAATAVSLIVIIFAVKKR                                  519
```

Based on this analysis, it is predicted that these proteins from *N.meningitidis* and *N.gonorrhoeae*, and their epitopes, could be useful antigens for vaccines or diagnostics, or for raising antibodies.

Example 83

The following partial DNA sequence was identified in *N.meningitidis* (SEQ 1D NO: 697):

```
  1 ..AAGCAATGGT ATGCCGACGN .AGTATCAAG ACGCAAATGG TTATGGTCAA
 51   CGATGAGCCT GCCAAAATTC TGACTTGGGA TGAAAGCGGC CGATTACTCT
101   CGGAACTGTC TATCCGCCAC CATCAACGCA ACGGGGTGGT TTTGGAGTGG
151   TATGAAGATG GTTCTAAAAA GAGCGAAGT. GTTTATCAGG ATGACAAGTT
201   GGTCAGGAAA ACCCAGTGGG ATAAGGATGG TTATTTAATC GAACCCTGA
```

This corresponds to the amino acid sequence (SEQ ID NO: 698; ORF27):

```
  1 ..KQWYADXSIK TEMVMVNDEP AKILTWDESG RLLSELSIRH HQRNGVVLEW
 51   YEDGSKKSEX VYQDDKLVRK TQWDKDGYLI EP*
```

Further work revealed the complete nucleotide sequence (SEQ ID NO: 699):

```
  1 ATGAAAAAAT TATCTCGGAT TGTATTTTCA ACTGTCCTGT TGGGTTTTTC
 51 GGCCGCTTTG CCGGCGCAGA CCTATTCTGT TTATTTTAAT CAGAACGGAA
101 AGCTGACGGC GACGATGTCT TCTGCCGCTT ATATCAGGCA ATATAGTGTG
151 GTGGCGGGTA TTGCGCACGC GCAGGATTTT TATTATCCGT CGATGAAGAA
201 ATATTCTGAA CCTTATATCG TTGCTTCAAC GCAAATCAAA TCTTTTGTGC
251 CTACCCTGCA AAACGGTATG TTGATTTTGT GGCATTTTAA TGGTCAGAAA
```

-continued

```
301  AAAATGGCGG GGGGCTTCAG CAAGGGTAAG CCGGACGGGG AGTGGGTCAA
351  CTGGTATCCG AACGGTAAAA AATCTGCCGT TATGCCTTAT AAAAATGGCT
401  TGAGTGAGGG TACGGGATAC CGCTATTACC GTAACGGCGG CAAGGAAAGC
451  GAAATCCAGT TTAAGCAAAA TAAGGCAAAC GGCGTATGGA AGCAATGGTA
501  TGCCGACGGC AGTATCAAGA CGGAAATGGT TATGGTCAAC GATGAGCCTG
551  CCAAAATTCT GACTTGGGAT GAAAGCGGCC GATTACTCTC GGAACTGTCT
601  ATCCGCCACC ATCAACGCAA CGGGGTGGTT TTGGAGTGGT ATGAAGATGG
651  TTCTAAAAAG AGCGAAGCTG TTTATCAGGA TGACAAGTTG GTCAGGAAAA
701  CCCAGTGGGA TAAGGATGGT TATTTAATCG AACCCTGA
```

This corresponds to the amino acid sequence (SEQ ID NO: 700; ORF27-1):

```
  1  MKKLSRIVFS TVLLGFSAAL PAQTYSVYFN QNGKLTATMS SAAYIRQYSV
 51  VAGIAHAQDF YYPSMKKYSE PYIVASTQIK SFVPTLQNGM LILWHFNGQK
101  KMAGGFSKGK PDGEWVNWYP NGKKSAVMPY KNGLSEGTGY RYYRNGGKES
151  EIQFKQNKAN GVWKQWYADG SIKTEMVMVN DEPAKILTWD ESGRLLSELS
201  IRHHQRNGVV LEWYEDGSKK SEAVYQDDKL VRKTQWDKDG YLIEP*
```

Computer analysis of this amino acid sequence gave the following results:
Homology with a Predicted ORF from *N.meningitidis* (Strain A)

ORF27 (SEQ ID NO: 698) shows 91.5% identity over a 82aa overlap with an ORF (ORF27a) (SEQ ID NO: 702) from strain A of *N. meningitidis*:

```
                                   10         20         30
orf27.pep                          KQWYADXSIKTEMVMVNDEPAKILTWDESG
                                   ||||||:||||||||||||||||||||||
orf27a    LSEGTGXRYYRNGGKESEIQFKQNKANGVWKQWYADGNIKTEMVMVNDEPAKILTWDESG
             140       150       160       170       180       190

40         50         60         70         80
orf27.pep RLLSELSIRHHQRNGVVLEWYEDGSKKSEXVYQDDKLVRKTQWDKDGYLIEPX
          ||||||||:|| |||||||||||||||| |||||||||||||| ||||||||
orf27a    RLLSELSIHHHXRNGVVLEWYEDGSKKXEAVYQDDKLVRKTQWDXDGYLIEPX
             200       210       220       230       240
```

The complete length ORF27a nucleotide sequence (SEQ ID NO: 701) is:

```
  1  ATGAAAAAAT TATCTCGGAT TGTATTTTCA ACTGTCCTGT TGGGTTTTTC
 51  GGCCGCTTTG CCGGCGCAGA NCTATTCTGT TTATTTTAAT CAGAACGGGA
101  AACTGACGGC GACGNTGTCT TCTGCCGCNT ATATCAGGCA ATATAGTGTG
151  GCGGAGGGTA TTGCGCACGC GCAGGANTTT TANTATCCGT CGATGAAGAA
201  ATATTCCGAA CCTTATATCG TTGCTTCAAC GCAAATCAAA TCTTTTGTGC
251  CTACCCTGCA AAACGGTATG TTGATTTTGT GGCATTTTAA NGGTCAGAAA
301  AAAATGGCNG GGGCTTCAG CAAGGGTAAG CCGGACGGGG AGTGGGTCAA
351  CTGGTATCCG AACGGTAAAA AATCTGCCGT TATGCCTTAT AAAAATGGTT
401  TGAGTGAAGG TACGGGGTNN CGCTATTACC GTAACGGCGG CAAGGAAAGC
```

```
-continued
451 GAAATCCAGT TTAAACAGAA TAAGGCAAAC GGCGTATGGA AGCAATGGTA

501 TGCCGACGGC AATATCAAAA CGGAAATGGT TATGGTCAAT GATGAGCCTG

551 CCAAAATTCT GACATGGGAT GAAAGCGGTC GATTACTCTC GGAACTGTCT

601 ATCCATCATC ATNAACGTAA TGGAGTAGTC TTAGAGTGGT ATGAAGATGG

651 TTCTAAAAAG ANTGAAGCTG TTTATCAGGA TGATAAGTTG GTCAGGAAAA

701 CCCAGTGGGA TAANGATGGT TATTTAATCG AACCCTGA
```

This encodes a protein having amino acid sequence (SEQ ID NO: 702):

```
  1 MKKLSRIVFS TVLLGFSAAL PAQXYSVYFN QNGKLTATXS SAAYIRQYSV

51 AEGIAHAQXF XYPSMKKYSE PYIVASTQIK SFVPTLQNGM LILWHFXGQK

101 KMAGGFSKGK PDGEWVNWYP NGKKSAVMPY KNGLSEGTGX RYYRNGGKES

151 EIQFKQNKAN GVWKQWYADG NIKTEMVMVN DEPAKILTWD ESGRLLSELS

201 IHHHXRNGVV LEWYEDGSKK XEAVYQDDKL VRKTQWDXDG YLIEP*
```

ORF27a (SEQ ID NO: 702) and ORF27-1 (SEQ ID NO: 700) show 94.7% identity in 245 aa overlap:

```
                    10         20         30         40         50         60
orf27a.pep  MKKLSRIVFSTVLLGFSAALPAQXYSVYFNQNGKLTATXSSAAYIRQYSVAEGIAHAQXF
            ||||||||||||||||||||||:|||||||||||||||:||||||||||: |||||| |
orf27-1     MKKLSRIVFSTVLLGFSAALPAQTYSVYFNQNGKLTATMSSAAYIRQYSVVAGIAHAQDF
                    10         20         30         40         50         60

70         80         90        100        110        120
orf27a.pep  XYPSMKKYSEPYIVASTQIKSFVPTLQNGMLILWHFXGQKKMAGGFSKGKPDGEWVNWYP
            ||||||||||||||||||||||||||||||||||||| ||||||||||||||||||||||
orf27-1     YYPSMKKYSEPYIVASTQIKSFVPTLQNGMLILWHFNGQKKMAGGFSKGKPDGEWVNWYP
                    70         80         90        100        110        120

130        140        150        160        170        180
orf27a.pep  NGKKSAVMPYKNGLSEGTGXRYYRNGGKESEIQFKQNKANGVWKQWYADGNIKTEMVMVN
            ||||||||||||||||||| ||||||||||||||||||||||||||||||:|||||||||
orf27-1     NGKKSAVMPYKNGLSEGTGYRYYRNGGKESEIQFKQNKANGVWKQWYADGSIKTEMVMVN
                   130        140        150        160        170        180

190        200        210        220        230        240
orf27a.pep  DEPAKILTWDESGRLLSELSIHHHXRNGVVLEWYEDGSKKXEAVYQDDKLVRKTQWDXDG
            |||||||||||||||||||||:|| |||||||||||||||| |||||||||||||||| ||
orf27-1     DEPAKILTWDESGRLLSELSIRHHQRNGVVLEWYEDGSKKSEAVYQDDKLVRKTQWDKDG
                   190        200        210        220        230        240 orf27a.pep  YLIEPX
            ||||||
orf27-1     YLIEPX
```

Homology with a Predicted ORF from *N.gonorrhoeae*

ORF27 (SEQ ID NO: 698) shows 96.3% identity over 82 aa overlap with a predicted ORF (ORF27ng) (SEQ ID NO: 704) from *N.gonorrhoeae*:

```
orf27.pep                         KQWYADXSIKTEMVMVNDEPAKILTWDESG    30
                                  ||||||  ||||||||||||||||||||||
orf27ng     LSEGTGYRYYRNGGKESEIQFKQNKANGVWKQWYADGSIKTEMVMVNDEPAKILTWDESG   193 orf27.pep   RLLSELSIRHHQRNGVVLEWYEDGSKKSEXVYQDDKLVRKTQWDKDGYLIEP    82
            ||||||||||:||||||||||||||||||  |||||||||||||||||||||
orf27ng     RLLSELSIRHHKRNGVVLEWYEDGSKKSEAVYQDDKLVRKTQWDKDGYLIEP   245
```

The complete length ORF27ng nucleotide sequence (SEQ ID NO: 703) is:

```
  1  ATGAAGAAAT TATCTCGGAT TGTATTTTCA ATCGTACTGT TGGGTTTTTC
 51  GGCCGCTTTG CCGGCGCAGA CCTATTCTGT TTATTTTAAT CAGAACGGGA
101  AACTGACGGC GACGATGTCT TCTGCCGCTT ATATCAGGCA ATATAGTGTG
151  GCGGCGGGTA TCGCACACGC GCAGGATTTT TATTATCCGT CGATGAAGAA
201  ATATTCCGAA CCTTATATCG TTGCTTCAAC GCAAATCAAA TCTTTTGTGC
251  CTACCCTGCA AAACGGTATG TTGATTTTGT GGCATTTTAA TGGTCAGAAA
301  AAAATGGCGG GGGGCTTCAG CAAGGGTAAG CCGGACGGGG AATGGGTCAA
351  CTGGTATCCG AACGGTAAAA AATCTGCGGT TATGCCTTAT AAAAATGGCT
401  TGAGTGAGGG TACGGGATAC CGTTATTACC GTAACGGCGG CAAGGAAAGC
451  GAAATCCAGT TTAAGCAAAA TAAGGGGAAC GGCGTATGGA AGCAATGGTA
501  TGCCGATGGA AGTATCAAGA CGGAAATGGT TATGGTCAAC GATGAGCCTG
551  CCAAAATTCT GACTTGGGAT GAAAGCGGCC GATTACTTTC GGAACTGTCT
601  ATCCGCCACC ATAAACGCAA CGGGGTGGTT TTGGAGTGGT ATGAAGATGG
651  TTCTAAAAAG AGCGAGGCTG TTTATCAGGA TGACAAGTTG GTCAGGAAAA
701  CCCAATGGGA TAAGGATGGT TATTTAATCG AACCCTGA
```

This encodes a protein having amino acid sequence (SEQ ID NO: 704):

```
  1  MKKLSRIVFS IVLLGFSAAL PAQTYSVYFN QNGKLTATMS SAAYIRQYSV
 51  AAGIAHAQDF YYPSMKKYSE PYIVASTQIK SFVPTLQNGM LILWHFNGQK
101  KMAGGFSKGK PDGEWVNWYP NGKKSAVMPY KNGLSEGTGY RYYRNGGKES
151  EIQFKQNKAN GVWKQWYADG SIKTEMVMVN DEPAKILTWD ESGRLLSELS
201  IRHHKRNGVV LEWYEDGSKK SEAVYQDDKL VRKTQWDKDG YLIEP*
```

ORF27ng (SEQ ID NO: 704) and ORF27-1 (SEQ ID NO: 700) show 98.8% identity in 245 aa overlap:

```
                    10         20         30         40         50         60
orf27-1.pep MKKLSRIVFSTVLLGFSAALPAQTYSVYFNQNGKLTATMSSAAYIRQYSVVAGIAHAQDF
            ||||||||| ||||||||||||||||||||||||||||||||||||||||:||||||||
orf27ng     MKKLSRIVFSIVLLGFSAALPAQTYSVYFNQNGKLTATMSSAAYIRQYSVAAGIAHAQDF
                    10         20         30         40         50         60

70         80         90        100        110        120
orf27-1.pep YYPSMKKYSEPYIVASTQIKSFVPTLQNGMLILWHFNGQKKMAGGFSKGKPDGEWVNWYP
            ||||||||||||||||||||||||||||||||||||||||||||||||||||||||||||
orf27ng     YYPSMKKYSEPYIVASTQIKSFVPTLQNGMLILWHFNGQKKMAGGFSKGKPDGEWVNWYP
                    70         80         90        100        110        120

130        140        150        160        170        180
orf27-1.pep NGKKSAVMPYKNGLSEGTGYRYYRNGGKESEIQFKQNKANGVWKQWYADGSIKTEMVMVN
            ||||||||||||||||||||||||||||||||||||||||||||||||||||||||||||
orf27ng     NGKKSAVMPYKNGLSEGTGYRYYRNGGKESEIQFKQNKANGVWKQWYADGSIKTEMVMVN
                   130        140        150        160        170        180

190        200        210        220        230        240
orf27-1.pep DEPAKILTWDESGRLLSELSIRHHQRNGVVLEWYEDGSKKSEAVYQDDKLVRKTQWDKDG
            |||||||||||||||||||||||||:||||||||||||||||||||||||||||||||||
orf27ng     DEPAKILTWDESGRLLSELSIRHHKRNGVVLEWYEDGSKKSEAVYQDDKLVRKTQWDKDG
                   190        200        210        220        230        240 orf27-1.pep YLIEPX
            ||||||
orf27ng     YLIEPX
```

Based on this analysis, including the putative leader sequence in the gonococcal protein, it was predicted that the proteins from *N.meningitidis* and *N.gonorrhoeae*, and their epitopes, could be useful antigens for vaccines or diagnostics, or for raising antibodies.

Figure 17A:
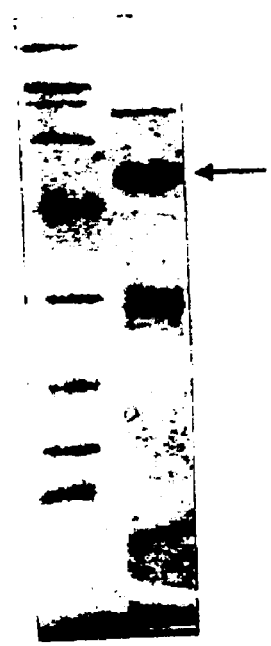
Figure 17B:
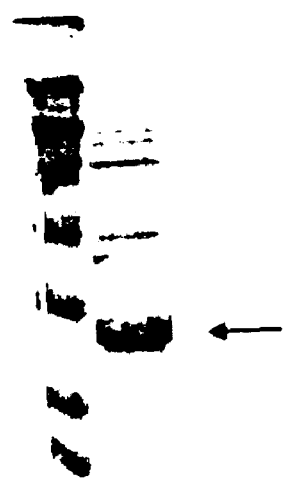

ORF27-1 (SEQ ID NO: 700) (24.5 kDa) was cloned in pET and pGex vectors and expressed in *E.coli*, as described above. The products of protein expression and purification were analyzed by SDS-PAGE. FIG. 17A shows the results of affinity purification of the GST-fusion protein, and FIG. 17B shows the results of expression of the His-fusion in *E.coli*. Purified GST-fusion protein was used to immunise mice, whose sera were used for ELISA, which gave a positive result, confirming that ORF27-1 (SEQ ID NO: 700) is a surface-exposed protein and a useful immunogen.

Example 84

The following partial DNA sequence was identified in *N.meningitidis* (SEQ ID NO: 705):

```
  1 ATGAAATTTA CCAAGCACCC CGTCTGGGCA ATGGCGTTCC GCCCATTTTA
 51 TTCGCTGGCG GCTCTGTACG GCGCATTGTC CGTATTGCTG TGGGGTTTCG
101 GCTACACGGG AACGCACkAG CTGTCCGGTT TCTATTGGCA CGCGCATGAg
151 ATGATTTGGG GTTATGCCGG ACTGGTCGTC ATCGCCTTCC TGCTGACCGC
201 CGTCGCCACT TGGACGGGGC AGCCGCCCAC GCGGGGCGGC GTaTCTGGTC
251 GGCTTGACTA TCTTTTGGCT GGCTGCGCGG ATTGCCGCCT TTATCCCGGG
301 TTGGGGTGCG TCGGCAAGCG GCATACTCGG TACGCTGTTT TTCTGGTACG
351 GCGCGGTGTG CATGGCTTTG CCCGTTATCC GTTCGCAGAA TCAACGCAAC
401 TATGTTgCCG TGTTCGCGCT GTTCGTCTTG GGCGGCACGC ATGCGGCGTT
451 CCACGTCCAG CTGCACAACG GCAACCTAGG CGGACTCTTG AGCGGATTGC
501 AGTCGGGCTT GGTGATG
```

This corresponds to the amino acid sequence (SEQ ID NO: 706; ORF47):

```
  1 MKFTKHPVWA MAFRPFYSLA ALYGALSVLL WGFGYTGTHX LSGFYWHAHE
 51 MIWGYAGLVV IAFLLTAVAT WTGQPPTRGG VLVGLTIFWL AARIAAFIPG
101 WGASASGILG TLFFWYGAVC HALPVIRSQN QRNYVAVFAL FVLGGTHAAF
151 HVQLHNGNLG GLLSGLQSGL VM
```

Further work revealed the complete nucleotide sequence (SEQ ID NO: 707):

```
  1 ATGAAATTTA CCAAGCACCC CGTCTGGGCA ATGGCGTTCC GCCCATTTTA
 51 TTCGCTGGCG GCTCTGTACG GCGCATTGTC CGTATTGCTG TGGGGTTTCG
101 GCTACACGGG AACGCACGAG CTGTCCGGTT TCTATTGGCA CGCGCATGAG
151 ATGATTTGGG GTTATGCCGG ACTGGTCGTC ATCGCCTTCC TGCTGACCGC
201 CGTCGCCACT TGGACGGGGC AGCCGCCCAC GCGGGGCGGC GTTCTGGTCG
251 GCTTGACTAT CTTTTGGCTG GCTGCGCGGA TTGCCGCCTT TATCCCGGGT
301 TGGGGTGCGT CGGCAAGCGG CATACTCGGT ACGCTGTTTT TCTGGTACGG
351 CGCGGTGTGC ATGGCTTTGC CCGTTATCCG TTCGCAGAAT CAACGCAACT
401 ATGTTGCCGT GTTCGCGCTG TTCGTCTTGG CGGCACGCA TGCGGCGTTC
451 CACGTCCAGC TGCACAACGG CAACCTAGG GGACTCTTGA GCGGATTGCA
501 GTCGGGCTTG GTGATGGTGT CGGGTTTTAT CGGTCTGATT GGTACGCGGA
551 TTATTTCGTT TTTTACGTCC AAACGCTTGA ATGTGCCGCA GATTCCCAGT
```

```
-continued
 601   CCGAAATGGG TGGCGCAGGC TTCGCTGTGG CTGCCCATGC TGACTGCCAT

651   GCTGATGGCG CACGGTGTGT TGGCTTGGCT GTCTGCCGTT TTTGCCTTTG

701   CGGCAGGTGT GATTTTTACC GTGCAGGTGT ACCGCTGGTG GTATAAACCC

751   GTGTTGAAAG AGCCGATGCT GTGGATTCTG TTTGCCGGCT ATCTGTTTAC

801   CGGATTGGGG CTGATTGCGG TCGGCGCGTC TTATTTCAAA CCCGCTTTCC

851   TCAATCTGGG TGTGCATCTG ATCGGGGTCG GCGGTATCGG CGTGCTGACT

901   TTGGGCATGA TGGCGCGTAC CGCGCTTGGT CATACGGGCA ATCCGATTTA

951   TCCGCCGCCC AAAGCCGTTC CCGTTGCGTT TTGGCTGATG ATGGCGGCAA

1001   CCGCCGTCCG TATGGTTGCC GTATTTTCTT CCGGCACTGC CTACACGCAC

1051   AGCATCCGCA CCTCTTCGGT TTTGTTTGCA CTCGCGCTTT TGGTGTATGC

1101   GTGGGAGTAT ATTCCTTGGC TGATTCGTCC GCGTTCGGAC GGCAGGCCCG

1151   GTTGA
```

This corresponds to the amino acid sequence (SEQ ID NO: 708; ORF47-1):

```
  1   MKFTKHPVWA MAFRPFYSLA ALYGALSVLL WGFGYTGTHE LSGFYWHAHE

51   MIWGYAGLVV IAFLLTAVAT WTGQPPTRGG VLVGLTIFWL AARIAAFIPG

101   WGASASGILG TLFFWYGAVC MALPVIRSQN QRNYVAVFAL FVLGGTHAAF

151   HVQLHNGNLG GLLSGLQSGL VMVSGFIGLI GTRIISFFTS KRLNVPQIPS

201   PKWVAQASLW LPMLTAMLMA HGVLAWLSAV FAFAAGVIFT VQVYRWWYKP

251   VLKEPMLWIL FAGYLFTGLG LIAVGASYFK PAFLNLGVHL IGVGGIGVLT

301   LGMMARTALG HTGNPIYPPP KAVPVAFWLM MAATAVRMVA VFSSGTAYTH

351   SIRTSSVLFA LALLVYAWKY IPWLIRPRSD GRPG*
```

Computer analysis of this amino acid sequence predicts a leader peptide and also gave the following results:
Homology with a Predicted ORF from N.meningitidis (Strain A)

ORF47 (SEQ ID NO: 706) shows 99.4% identity over a 172aa overlap with an ORF (ORF47a) (SEQ ID NO: 710) from strain A of N. meningitidis:

```
                   10        20        30        40        50        60
orf47.pep  MKFTKHPVWAMAFRPFYSLAALYGALSVLLWGFGYTGTHXLSGFYWHAHEMIWGYAGLVV
           ||||||||||||||||||||||||||||||||||||||| ||||||||||||||||||||
orf47a     MKFTKHPVWAMAFRPFYSLAALYGALSVLLWGFGYTGTHELSGFYWHAHEMIWGYAGLVV
                   10        20        30        40        50        60

70        80        90       100       110       120
orf47.pep  IAFLLTAVATWTGQPPTRGGVLVGLTIFWLAARIAAFIPGWGASASGILGTLFFWYGAVC
           ||||||||||||||||||||||||||||||||||||||||||||||||||||||||||||
orf47a     IAFLLTAVATWTGQPPTRGGVLVGLTIFWLAARIAAFIPGWGASASGILGTLFFWYGAVC
                   70        80        90       100       110       120

130       140       150       160       170       180
orf47.pep  MALPVIRSQNQRNYVAVFALFVLGGTHAAFHVQLHNGNLGGLLSGLQSGLVM
           ||||||||||||||||||||||||||||||||||||||||||||||||||||
orf47a     MALPVIRSQNQRNYVAVFALFVLGGTHAAFHVQLHNGNLGGLLSGLQSGLVMVSGFIGLI
                  130       140       150       160       170       180 orf47a     GTRIISFFTSKRLNVPQIPSPKWVAQASLWLPMLTAMLMAHGVMPWLSAAFAFAAGVIFT
                  190       200       210       220       230       240
```

The complete length ORF47a nucleotide sequence (SEQ ID NO: 709) is:

```
   1  ATGAAATTTA CCAAGCACCC CGTTTGGGCA ATGGCGTTCC GCCCGTTTTA
  51  TTCACTGGCG GCTCTGTACG GCGCATTGTC CGTATTGCTG TGGGGTTTCG
 101  GCTACACGGG AACGCACGAG CTGTCCGGTT TCTATTGGCA CGCGCATGAG
 151  ATGATTTGGG GTTATGCCGG ACTGGTCGTC ATCGCCTTCC TGCTGACCGC
 201  CGTCGCCACT TGGACGGGGC AGCCGCCCAC GCGGGGCGGC GTTCTGGTCG
 251  GCTTGACTAT CTTTTGGCTG GCTGCGCGGA TTGCCGCCTT TATCCCGGGT
 301  TGGGGTGCGT CGGCAAGCGG CATACTCGGT ACGCTGTTTT TCTGGTACGG
 351  CGCGGTGTGC ATGGCTTTGC CCGTTATCCG TTCGCAGAAT CAACGCAATT
 401  ATGTTGCCGT GTTCGCGCTG TTCGTCTTGG GCGGTACGCA CGCGGCGTTC
 451  CACGTCCAGC TGCACAACGG CAACCTAGGC GGACTCTTGA GCGGATTGCA
 501  GTCGGGCTTG GTGATGGTGT CGGGTTTTAT CGGTCTGATT GGTACGCGGA
 551  TTATTTCGTT TTTTACGTCC AAACGGTTGA ATGTGCCGCA GATTCCCAGT
 601  CCGAAATGGG TGGCGCAGGC TTCGCTGTGG CTGCCCATGC TGACCGCCAT
 651  GCTGATGGCG CACGGCGTGA TGCCTTGGCT GTCGGCGGCT TTCGCGTTTG
 701  CGGCAGGTGT GATTTTTACC GTGCAGGTGT ACCGCTGGTG GTATAAGCCT
 751  GTGTTGAAAG AGCCGATGCT GTGGATTCTG TTTGCCGGCT ATCTGTTTAC
 801  CGGATTGGGG CTGATTGCGG TCGGCGCGTC TTATTTCAAA CCCGCTTTCC
 851  TCAATCTGGG TGTGCATCTG ATCGGGGTCG GCGGTATCGG CGTGCTGACT
 901  TTGGGCATGA TGGCGCGTAC CGCGCTCGGT CATACGGGCA ATCCGATTTA
 951  TCCGCCGCCC AAAGCCGTTC CCGTTGCGTT TTGGCTGATG ATGGCGGCAA
1001  CCGCCGTCCG TATGGTTGCC GTATTTTCTT CCGGCACTGC CTACACGCAC
1051  AGCATACGCA CCTCTTCGGT TTTGTTTGCA CTCGCGCTTT TGGTGTATGC
1101  GTGGAAGTAT ATTCCTTGGC TGATTCGTCC GCGTTCGGAC GGCAGGCCCG
1151  GTTGA
```

This encodes a protein having amino acid sequence (SEQ ID NO: 710):

```
  1  MKFTKHPVWA MAFRPFYSLA ALYGALSVLL WGFGYTGTHE LSGFYWHAHE
 51  MIWGYAGLVV IAFLLTAVAT WTGQPPTRGG VLVGLTIFWL AARIAAFIPG
101  WGASASGILG TLFFWYGAVC MALPVIRSQN QRNYAVFAL  FVLGGTHAAF
151  HVQLHNGNLG GLLSGLQSGL VMVSGFIGLI GTRIISFFTS KRLNVPQIPS
201  PKWVAQASLW LPMLTAMLMA HGVMPWLSAA FAFAAGVIFT VQVYRWWYKP
251  VLKEPMLWIL FAGYLFTGLG LIAVGASYFK PAFLNLGVHL IGVGGIGVLT
301  LGMMARTALG HTGNPIYPPP KAVPVAFWLM MAATAVRMVA VFSSGTAYTH
351  SIRTSSVLFA LALLVYAWKY IPWLIRPRSD GRPG*
```

ORF47a (SEQ ID NO: 710) and ORF47-1 (SEQ ID NO: 708) show 99.2% identity in 384 aa overlap:

```
                    10        20        30        40        50        60
orf47a.pep  MKFTKHPVWAMAFRPFYSLAALYGALSVLLWGFGYTGTHELSGFYWHAHEMIWGYAGLVV
            ||||||||||||||||||||||||||||||||||||||||||||||||||||||||||||
orf47-1     MKFTKHPVWAMAFRPFYSLAALYGALSVLLWGFGYTGTHELSGFYWHAHEMIWGYAGLVV
                    10        20        30        40        50        60

70        80        90       100       110       120
orf47a.pep  IAFLLTAVATWTGQPPTRGGVLVGLTIFWLAARIAAFIPGWGASASGILGTLFFWYGAVC
            ||||||||||||||||||||||||||||||||||||||||||||||||||||||||||||
orf47-1     IAFLLTAVATWTGQPPTRGGVLVGLTIFWLAARIAAFIPGWGASASGILGTLFFWYGAVC
                    70        80        90       100       110       120

130       140       150       160       170       180
orf47a.pep  MALPVIRSQNQRNYVAVFALFVLGGTHAAFHVQLHNGNLGGLLSGLQSGLVMVSGFIGLI
            ||||||||||||||||||||||||||||||||||||||||||||||||||||||||||||
orf47-1     MALPVIRSQNQRNYVAVFALFVLGGTHAAFHVQLHNGNLGGLLSGLQSGLVMVSGFIGLI
                   130       140       150       160       170       180

190       200       210       220       230       240
orf47a.pep  GTRIISFFTSKRLNVPQIPSPKWVAQASLWLPMLTAMLMAHGVMPWLSAAFAFAAGVIFT
            |||||||||||||||||||||||||||||||||||||||||||:||||:|||||||||||
orf47-1     GTRIISFFTSKRLNVPQIPSPKWVAQASLWLPMLTAMLMAHGVLAWLSAVFAFAAGVIFT
                   190       200       210       220       230       240

250       260       270       280       290       300
orf47a-pep  VQVYRWWYKPVLKEPMLWILFAGYLFTGLGLIAVGASYFKPAFLNLGVHLIGVGGIGVLT
            ||||||||||||||||||||||||||||||||||||||||||||||||||||||||||||
orf47-1     VQVYRWWYKPVLKEPMLWILFAGYLFTGLGLIAVGASYFKPAFLNLGVHLIGVGGIGVLT
                   250       260       270       280       290       300

310       320       330       340       350       360
orf47a.pep  LGMMARTALGHTGNPIYPPPKAVPVAFWLMMAATAVRMVAVFSSGTAYTHSIRTSSVLFA
            ||||||||||||||||||||||||||||||||||||||||||||||||||||||||||||
orf47-1     LGMMARTALGHTGNPIYPPPKAVPVAFWLMMAATAVRMVAVFSSGTAYTHSIRTSSVLFA
                   310       320       330       340       350       360

370       380
orf47a.pep  LALLVYAWKYIPWLIRPRSDGRPGX
            |||||||||||||||||||||||||
orf47-1     LALLVYAWKYIPWLIRPRSDGRPGX
                   370       380
```

Homology with a Predicted ORF from *N.gonorrhoeae*
ORF47 (SEQ ID NO: 706) shows 97.1% identity over 172 aa overlap with a predicted ORF (ORF47ng) (SEQ ID NO: 712) from *N.gonorrhoeae*:

```
ORF47    MKFTKHPVWAMAFRPFYSLAALYGALSVLLWGFGYTGTHELSGFYWHAHEMIWGYAGLVV   60
         ||||||||||||||||||||||||||||||||||||||||||||||||||||||||||||
ORF47ng  MKFTKHPVWAMAFRPFYSLAALYGALSVLLWGFGYTGTHELSGFYWHAHEMIWGYAGLVV   60

ORF47    IAFLLTAVATWTGQPPTRGGVLVGLTIFWLAARIAAFIPGWGASASGILGTLFFWYGAVC  120
         ||||||||||||||||||||||||||||| |||||||||||||:||||||||||||||||
ORF47ng  IAFLLTAVATWTGQPPTRGGVLVGLTAFWLAARIAAFIPGWGAAASGILGTLFFWYGAVC  120

ORF47    MALPVIRSQNQRNYVAVFALFVLGGTHAAFHVQLHNGNLGGLLSGLQSGLVM          172
         ||||||||:|||||||||:|||||||||||||||||||||||||||||||||
ORF47ng  MALPVIRSQNRRNYVAVFAIFVLGGTHAAFHVQLHNGNLGGLLSGLQSGLVMVWGFIGLI  180
```

The (ORF47ng nucleotide sequence (SEQ ID NO: 711) is predicted to encode a protein comprising amino acid sequence (SEQ ID NO: 712):

```
  1  MKFTKHPVWA MAFRPFYSLA ALYGALSVLL WGFGYTGTHE LSGFYWHAHE

51  MIWGYAGLVV IAFLLTAVAT WTGQPPTRGG VLVGLTAFWL AARIAAFIPG

101  WGAAASGILG TLFFWYGAVC MALPVIRSQN RRNYVAVFAI FVLGGTHAAF
```

```
151  HVQLHNGNLG GLLSGLQSGL VMVWGFIGLI GMKIISFFTS KRLKLPQIPS

201  PKWVAHASLW LPMLNAILMA HRVMPWLSAA FPFAAGVIFT VQVYAGGITP

251  IEETSCGSVA GICYRLGNSS G
```

The predicted leader peptide and transmembrane domains are identical (except for an Ile/Ala substitution at residue 87 and an Leu/Ile substitution at position 140) to sequences in the meningococcal protein (see also *Pseudomonas stutzeri* orf396 (SEQ ID NO: 1157), accession number e246540):

| TM segments in ORF47ng |
| --- |
| INTEGRAL Likelihood = −5.63 Transmembrane 52–68 |
| INTEGRAL Likelihood = −3.88 Transmembrane 169–185 |
| INTEGRAL Likelihood = −3.08 Transmembrane 82–98 |

-continued

| TM segments in ORF47ng |
| --- |
| INTEGRAL Likelihood = −1.91 Transmembrane 134–150 |
| INTEGRAL Likelihood = −1.44 Transmembrane 107–123 |
| INTEGRAL Likelihood = −1.38 Transmenbrane 227–243 |

Further work revealed the complete gonococcal DNA sequence (SEQ ID NO: 713):

```
   1  ATGAAATTTA CCAAACATCC CGTCTGGGCA ATGGCGTTCC GCCCGTTTTA

51  TTCACTGGCG GCACTGTACG GCGCATTGTC CGTATTGCTG TGGGGTTTCG

101  GCTACACGGG AACGCACGAG CTGTCCGGTT TCTATTGGCA CGCGCATGAG

151  ATGATTTGGG GTTATGCCGG TCTCGTCGTC ATCGCCTTCC TGCTGACCGC

201  CGTCGCCACT TGGACGGGAC AGCCGCCCAC GAGGGGCGGC GTTCTGGTCG

251  GCTTGACCGC CTTTTGGCTG GCTGCGCGGA TTGCCGCCTT TATCCCGGGT

301  TGGGGTGCGG CGGCAAGCGG CATACTCGGT ACGCTGTTTT TCTGGTACGG

351  CGCGGTGTGC ATGGCTTTGC CCGTTATCCG TtcgCAAAAC CGGCGCAACT

401  ATGtcgCCGT ATTCGCAATA TTTGTGCTGG GCGGTACGCA TGCGgcgTTC

451  CACGtccAgc tGCACAACGG CAACCTAGGC GGACTCTTGA GCGGATTGCA

501  GTCGGGCCTG GTTATGGTGT CGGGCTTTAT CGGCCTGATT GGGATGAGGA

551  TTATTTCGTT TTTTACGTCC AAACGGTTGA ACGTGCCGCA GATTCCCAGT

601  CCGAAATGGG TGGCGCAGGC TTCGCTGTGG CTACCCATGC TGACCGCCAT

651  ACTGATGGCG CACGGCGTGA TGCCTTGGCT GTCGGCGGCT TTCGCGTTTG

701  CGGCGGGCGT GATTTTTACC GTACAGGTGT ACCGCTGGTG GTATAAACCC

751  GTATTGAAAG AACCGATGCT GTGGATTCTG TTTGCCGGCT ATCTGTTTAC

801  CGGATTGGGG CTGATTGCGG TCGGCGCGTC TTATTTCAAA CCTGCCTTCC

851  TCAATCTGGG CGTACATCTG ATCGGGGTCG GCGGTATCGG CGTGCTGACT

901  TTGGGCATGA TGGCGCGTAC CGCGCTCGGT CATACGGGCA ATTCGATTTA

951  TCCGCCGCCC AAAGCCGTTC CCGTTGCGTT TTGGCTGATG ATGGCGGCAA

1001  CCGCCGTCCG TATGGTTGCC GTATTTTCTT CCGGCACTGC CTACACGCAC

1051  AGCATCCGCA CGTCTTCGGT TTTGTTTGCA CTCGCGCTGC TGGTGTATGC

1101  GTGGAAATAC ATTCCGTGGC TGATCCGTCC GCGTTCGGAC GGCAGGCCCG

1151  GTTGA
```

This encodes a protein having amino acid sequence (SEQ ID NO: 714; ORF47ng-1):

```
  1 MKFTKHPVWA MAFRPFYSLA ALYGALSVLL WGFGYTGTHE LSGFYWHAHE
 51 MIWGYAGLVV IAFLLTAVAT WTGQPPTRGG VLVGLTAFWL AARIAAFIPG
101 WGAAASGILG TLFFWYGAVC MALPVIRSQN RRNYVAVFAI FVLGGTHAAF
151 HVQLHNGNLG GLLSGLQSGL VMVSGFIGLI GMRIISFFTS KRLNVPQIPS
201 PKWVAQASLW LPMLTAILMA HGVMPWLSAA FAFAAGVIFT VQVYRWWYKP
251 VLKEPMLWIL FAGYLFTGLG LIAVGASYFK PAFLNLGVHL IGVGGIGVLT
301 LGMMARTALG HTGNSIYPPP KAVPVAFWLM MAATAVRMVA VFSSGTAYTH
351 SIRTSSVLFA LALLVYAWKY IPWLIRPRSD GRPG*
```

ORF47ng-1 (SEQ ID NO: 714) and ORF47-1 (SEQ ID NO: 708) show 97.4% identity in 384 overlap:

```
                   10        20        30        40        50        60
orf47-1.pep MKFTKHPVWAMAFRPFYSLAALYGALSVLLWGFGYTGTHELSGFYWRAHEMIWGYAGLVV
            ||||||||||||||||||||||||||||||||||||||||||||||||||||||||||||
orf47ng-1   MKFTKHPVWAMAFRPFYSLAALYGALSVLLWGFGYTGTHELSGFYWRAHEMIWGYAGLVV
                   10        20        30        40        50        60

70        80        90       100       110       120
orf47-1.pep IAFLLTAVATWTGQPPTRGGVLVGLTIFWLAARIAAFIPGWGASASGILGTLFFWYGAVC
            |||||||||||||||||||||||||||| |||||||||||||||:|||||||||||||||
orf47ng-1   IAFLLTAVATWTGQPPTRGGVLVGLTAFWLAARIAAFIPGWGAAASGILGTLFFWYGAVC
                   70        80        90       100       110       120

130       140       150       160       170       180
orf47-1.pep MALPVIRSQNQRNYVAVFALFVLGGTHAAFHVQLHNGNLGGLLSGLQSGLVMVSGFIGLI
            ||||||||||:|||||||:|||||||||||||||||||||||||||||||||||||||||
orf47ng-1   MALPVIRSQNRRNYVAVFAIFVLGGTHAAFHVQLHNGNLGGLLSGLQSGLVMVSGFIGLI
                  130       140       150       160       170       180

190       200       210       220       230       240
orf47-1.pep GTRIISFFTSKRLNVPQIPSPKWVAQASLWLPMLTAMLMAHGVLAWLSAVFAFAAGVIFT
            | ||||||||||||||||||||||||||||||||||:||||||: ||||:|||||||||
orf47ng-1   GMRIISFFTSKRLNVPQIPSPKWVAQASLWLPMLTAILMAHGVMPWLSAAFAFAAGVIFT
                  190       200       210       220       230       240

250       260       270       280       290       300
orf47-1.pep VQVYRWWYKPVLKEPMLWILFAGYLFTGLGLIAVGASYFKPAFLNLGVHLIGVGGIGVLT
            ||||||||||||||||||||||||||||||||||||||||||||||||||||||||||||
orf47ng-1   VQVYRWWYKPVLKEPMLWILFAGYLFTGLGLIAVGASYFKPAFLNLGVHLIGVGGIGVLT
                  250       260       270       280       290       300

310       320       330       340       350       360
orf47-1.pep LGMMARTALGHTGNPIYPPPKAVPVAFWLMMAATAVRMVAVFSSGTAYTHSIRTSSVLFA
            ||||||||||||||| ||||||||||||||||||||||||||||||||||||||||||||
orf47ng-1   LGMMARTALGHTGNSIYPPPKAVPVAFWLMMAATAVRMVAVFSSGTAYTHSIRTSSVLFA
                  310       320       330       340       350       360

370       380
orf47-1.pep LALLVYAWKYIPWLIRPRSDGRPGX
            |||||||||||||||||||||||||
orf47ng-1   LALLVYAWKYIPWLIRPRSDGRPGX
                  370       380
```

Furthermore, ORF47ng-1 (SEQ ID NO: 714) shows significant homology to an ORF (SEQ ID NO: 1157) from *Pseudomonas stutzeri*:

```
gnl|PID|e246540 (Z73914) ORF396 protein [Pseudomonas stutzeri] Length = 396
Score = 155 bits (389), Expect = 5e-37
Identities = 121/391 (30%), Positives = 169/391 (42%), Gaps = 21/391 (5%)

Query:   7 PVWAMAFRPFYSLAALYGALSVLLWGFGYTGTHELSGFY-------WHAHEMIWGYAGLV   59
           P+W Z +AFRPF+   +LY L++ LW   +TG     GF        WH HEM++G+A +
Sbjct:  14 PIWRLAFRPFFLAGSLYALLAIPLWVAAWTGLWP--GFQPTGGWLAWHRHEMLFGFAMAI   71

Query:  60 VIAFLLTAVATWTGQPPTRGGVLVGLTAFWLAARIAAFIPGWGAAASGILGTLFFWYGAV  119
           V   FLLTAV TWTGQ    G  LVGL A WLAAR+   ++ G  AA     L  LF
Sbjct:  72 VAGFLLTAVQTWTGQTAPSGNRLVGLAAVWLAARL-GWLFGLPAAWLAPLDLLFLVALVW  130

Query: 120 CMALPVIRSQNRRNYVAVFAIFVLGGTHAAFXXXXXXXXXXXXXXXXXXXXXXMVSGFIGL  179
            MA  +  + +RNY V   + ++ G                            +V+   + L
Sbjct: 131 MMAQMLWAVRQKRNYPIVVVLSLMLGADVLILTGLLQGNDALQRQGVLAGLWLVAALMAL  190

Query: 180 IGMRIISFFTSKRLNVPQIPSP-KWVAQASLWLPMLTAILMAHGV----MPWLSAAFAFA  234
           IG R+I FFT + L        P  W+  A L   + A+L A GV       P L   F  A
Sbjct: 191 IGGRVIPFFTQRGLGKVDAVKPWVWLDVALLVGTGVIALLHAFGVAMRPQPLLGLLFV-A  249

Query: 235 AGVIFTVQVYRWWYKPVLKEPMLWILFAGYLFTGLGLIAVGASYF-KPAFXXXXXXXXXXX  293
              GV    +++ RW+ K + K  +LW L    L+ +  +    +F    A
Sbjct: 250 IGVGHLLRLMRWYDKGIWKVGLLWSLHVAMLWLVVAAFGLALWHFGLLAQSSPSLHALSV  309

Query: 294 XXXXXXXXXXMMARTALGHTGNSIYPPPKAVPVAFWLXXXXXXXXXXXXXXFSSGTAYTHSIR  353
                     M+AR LGHTG + P  + AF L              F S       +
Sbjct: 310 GSMSGLILAMIARVTLGHTGRPLQLPAGIIG-AFVL---FNLGTAARVFLSVAWPVGGLW  365

Query: 354 TSSVLFALALLVYAWKYIPWLIRPRSDGRPG                              384
           ++V + LA  +Y W+Y P L+  R DG PG
Sbjct: 366 LAAVCWTLAFALYVWRYAPMLVAARVDGHPG                              396
```

Based on this analysis, it is predicted that the proteins from *N.meningitidis* and *N.gonorrhoeae*, and their epitopes, could be useful antigens for vaccines or diagnostics, or for raising antibodies.

Example 85

The following partial DNA sequence was identified in *N.meningitidis* (SEQ ID NO: 715):

```
  1 ATGCCGTCTG AAGGTTCAGA CGGCmTCGGT GyCGGGGAAy CAGAAGyGGT
 51 AGCGCATGCC CAATGAGACT TCGTGGGTTT TGAAGCGGGT GTTTTCCAAG
101 CGTCCCCAGT TGTGGTAACG GTATCCGGTG TCyAArGTCA GCTTGGGyGT
151 GATGTCGAAa CCGACACCGG CGATGACACC AAGACCyAmG CYGCTGATrC
201 TGTkGCTTTC GTGATAGGsA GGTTTGyTGG kmksAsyTTG TAyrATwkkG
251 CCTssCwsTG kAGmGCCkTk CkyTGGTkkA swGrwArTAG TCGTGGTTTy
301 TkTTyyCACC GAATGAACyT GATGTTTAAC GTGTCCGTAG GCGACGCGCG
351 CGCCGATATA GGGTTTGAAT TTATCGTTGA GTTTGAAATC GTAAATGGCG
401 GACAAGCCGA GAGAAGAAAC GGCGTGGAAG CTGCCGTTTC CCTGATGTTT
451 TGTTTGGGTT TCTTTGTAGT TGTTGTTTAT CTCTTCAGTA ACTTTTTTAG
501 TAGAAGAATT ACTTTCTTTC CATTTTCTGT AACTGGCATA ATCTGCCGCT
551 ATTCTCCAGC CGCCGAAATC ..
```

This corresponds to the amino acid sequence (SEQ ID NO: 716; ORF67):

```
 1 ..MPSEGSDGXG XGEXEXVAHA QXDFVGFEAG VFQASPVVVT VSGVXXQLGX
51   DVETDTGDDT KTXAADXVAF VIGRFXGXXL YXXAXXXXAX XWXXXXSRGF
```

```
101    XXHRMNLMFN VSVGDARADI GFEFIVEFEI VNGGQAERRN GVEAAVSLMF

151    CLGFFVVVVY LFSNFFSRRI TFFPFSVTGI ICRYSPAAEI ..
```

Computer analysis of this amino acid sequence gave the following results:
Homology with a Predicted ORF from *N.gonorrhoeae*
ORF67 (SEQ ID NO: 716) shows 51.8% identity over 199 aa overlap with a predicted ORF (ORF67ng) (SEQ ID NO: 718) from *N.gonorrhoeae*:

```
orf67.pep                                     MPSEGSDGXGXGEXEXVAHAQXDFVGFEAG    30
                                              ||||||||  |  ||  |  |||||    ||||||||
orf67ng   TNFEIAVLSGMTVRVFYCARPAPVNGGRLKMPSEGSDGIGIGESEAVAHAQRGFVGFEAG   146
              90        100       110       120       130       140 orf67.pep VFQASPVVVTVSGVXXQLGXDVETDTGDDTKTXAADXVAFVIGRFXGXXLYXXAXXXXAX    90
          ||||||||||:|:||   |  |  ||  : :    ::: ||   |||:|| |     :          :
orf67ng   VFQASPVVVAVAGVQGQAGRDVYAHARHRAEAQAAAAVAFLIGVFLRMSVRINRNCCVSI   206 orf67.pep XWXXXXXSRGFXXHRMNLMFNVSVGDARADIGFEFIVEFEIVNGGQAERRNGVEAAVSLMF   150
           :    |    :   |:: : :|||||||:||||||:||||||||||||||||||| || |||
orf67ng   TRVGGKSTCYFFSRIDAVSDVSVGDARTDIGFEFVVEFEIVNGGQAERRNGVECAVFLMF   266 orf67pep  CLGFFVV--------VVYLFSNFFSRRITFF-PFSVTGIICRYSPAAEI              190
          |  | |        :: |: |: : | :  ||  |||||   :||||:
orf67ng   RLLVFYVKLVAAKSFIILSFQLFYVHGIFIVVPFPVTGIIRGDAPAAEVVADRHPGVDGM   326
```

The ORF67ng nucleotide sequence (SEQ ID NO: 717) is predicted to encode a protein comprising amino acid sequence (SEQ I) NO: 718):

```
  1    MPSETVGSIV NVGVDESVGF SPPFPSIQHF YRFHRIHRIR LFRPPGPMQL

51    NRHSHGSGNL GRGVWATVLS DKFPCGQVRI PACAGMTNFE IAVLSGMTVR

101    VFYCARPAPV NGGRLKMPSE GSDGIGIGES EAVAHAQRGF VGFEAGVFQA

151    SPVVVAVAGV QGQAGRDVYA HARHRAEAQA AAAVAFLIGV FLRMSVRINR

201    NCCVSITRVG GKSTCYFFSR IDAVSDVSVG DARTDIGFEF VVEFEIVNGG

251    QAERRNGVEC AVFLMFRLLV FYVKLVAAKS FIILSFQLFY VHGIFIVVPF

301    PVTGIIRGDA PAAEVVADRH PGVDGMRTDV SEIIAYRAYF VFAWSGWFRI

351    IVGNAFGGVG *
```

Based on the presence of a several putative transmembrane domains in the gonococcal protein, it is predicted that the proteins from *N.meningitidis* and *N.gonorrhoeae*, and their epitopes, could be useful antigens for vaccines or diagnostics, or for raising antibodies.

Example 86

The following partial DNA sequence was identified in *N.meningitidis* (SEQ ID NO: 719)

```
  1   ATGTTTGCTT TTTTAGAAGC CTTTTTTGTC GAATACGGTT ATGCGGCTGT

51   TTTTTTTGTA TTGGTCATCT GCGGTTTCGG CGTGCCGATT CCCGAGGATT

101   TGACCTTGGT AACAGGCGGC GTGATTTCGG GTATGGGTTA TACCAATCCG

151   CATATTATGT TTGCAGTCGG TATGCTCGGC GTATTGGTCG GGACGGCAT

201   CATGTTCGCC GCCGGACGAA TTTGGGGGCA GArArTCCTA rGGTTCArAC

251   CTATTGCGsG CATCATGACG CCGrAACGTT ATGAGCAGGT TCAGGAAAAA

301   TTCGACAAAT ACGGTAACTG GGTCTTATTT GTCGCCCGTT TCCTGCCCGG
```

```
-continued
351 TTTGAGAACG GCCGTATTTG TTACAGCCGG TATCAGCCGC AAGGTTTCAT

401 ACTTGCGTTT TATCATTATG GATGGACTGG CCGCA...
```

This corresponds to the amino acid sequence (SEQ ID NO: 720; ORF78):

```
  1 MFAFLEAFFV EYGYAAVFFV LVICGFGVPI PEDLTLVTGG VISGMGYTNP

51 HIMFAVGMLG VLVGDGIMFA AGRIWGQXXL XFXPIAXIMT PXRYEQVQEK

101 FDKYGNWVLF VARFLPGLRT AVFVTAGISR KVSYLRFIIM DGLAA...
```

Further work revealed the complete nucleotide sequence (SEQ ID NO: 721):

```
  1 ATGTTTGCTT TTTTAGAAGC CTTTTTTGTC GAATACGGTT ATGCGGCTGT

51 TTTTTTTGTA TTGGTCATCT GCGGTTTCGG CGTGCCGATT CCCGAGGATT

101 TGACCTTGGT AACAGGCGGC GTGATTTCGG GTATGGGTTA TACCAATCCG

151 CATATTATGT TTGCAGTCGG TATGCTCGGC GTATTGGTCG GGGACGGCAT

201 CATGTTCGCC GCCGGACGAA TTTGGGGGCA GAAAATCCTA AGGTTCAAAC

251 CTATTGCGCG CATCATGACG CCGAAACGTT ATGAGCAGGT TCAGGAAAAA

301 TTCGACAAAT ACGGTAACTG GGTCTTATTT GTCGCCCGTT TCCTGCCCGG

351 TTTGAGAACG GCCGTATTTG TTACAGCCGG TATCAGCCGC AAGGTTTCAT

401 ACTTGCGTTT TATCATTATG GATGGACTGG CCGCACTGAT TTCCGTCCCT

451 ATTTGGATTT ATCTGGGCGA ATACGGTGCG CACAACATCG ATTGGCTGAT

501 GGCGAAAATG CACAGCCTGC AATCGGGTAT TTTTGTTATC TTGGGTATAG

551 GTGCGACCGT TGTCGCTTGG ATTTGGTGGA AAAAACGCCA ACGTATCCAG

601 TTTTACCGCA GCAAATTGAA AGAAAAGCGG GCGCAACGCA AAGCCGCCAA

651 GGCAGCCAAA AAAGCCGCGC AAAGCAAACA ATAA
```

This corresponds to the amino acid sequence (SEQ ID NO: 722; ORF78-1):

```
  1 MFAFLEAFFV EYGYAAVFFV LVICGFGVPI PEDLTLVTGG VISGMGYTNP

51 HIMFAVGMLG VLVGDGIMFA AGRIWGQKIL RFKPIARIMT PKRYEQVQEK

101 FDKYGNWVLF VARFLPGLRT AVFVTAGISR KVSYLRFIIM DGLAALISVP

151 IWIYLGEYGA HNIDWLMAKM HSLQSGIFVI LGIGATVVAW IWWKKRQRIQ

201 FYRSKLKEKR AQRKAAKAAK KAAQSKQ*
```

Computer analysis of this amino acid sequence predicts several transmembrane domains, and also gave the following results:
Homology with the dedA Homologue of *H.influenzae* (Accession Number P45280) (SEQ ID NO: 1158)

ORF78 (SEQ ID NO: 720) and the dedA homologue (SEQ ID NO: 1158) show 58% aa identity in 144aa overlap:

```
Orf78:    4 FLEAFFVEYGYAAVFFVLVICGFGVPIPEDLTLVTGGVISGM--GYTNPHIMFAVGMLGV    61
            FL  FF EYGY AV FVL+ICGFGVPIPED+TLV+GGVI+G+    N H+M V M+GV
DedA:    20 FLIGFFTEYGYWAVLFVLIICGFGVPIPEDITLVSGGVIAGLYPENVNSHLMLLVSMIGV    79

Orf78:   62 LVGDGIMFAAGRIWGQXXLXFXPIAXIMTPXRYEQVQEKFDKYGNWVLFVARFLPGLRTA   121
            L GD  M+  GRI+G    L F PI  I+T  R   V+EKF +YGN VLFVARFLPGLR
DedA:    80 LAGDSCMYWLGRIYGTKILRFRPIRRIVTLQRLRMVREKFSQYGNRVLFVARFLPGLRAP   139

Orf78:  122 VFVTAGISRKVSYLRFIIMDGLAA                                       145
            +++ +GI+R+VSY+RF+++D  AA
DedA:   140 IYMVSGITRRVSYVRFVLIDFCAA                                       163
```

Homology with a Predicted ORF from *N.meningitidis* (Strain A)

ORF78 (SEQ ID NO: 720) shows 93.8% identity over a 145aa overlap with an ORF (ORF78a) (SEQ ID NO: 724) from strain A of *N. meningitidis*:

```
                   10         20         30         40         50         60
orf78.pep  MFAFLEAFFVEYGYAAVFFVLVICGFGVPIPEDLTLVTGGVISGMGYTNPHIMFAVGMLG
           |||:||||||||||||||||||||||||||||||||||||||||||||||||||||||||
orf78a     MFALLEAFFVEYGYAAVFFVLVICGFGVPIPEDLTLVTGGVISGMGYTNPHIMFAVGMLG
                   10         20         30         40         50         60

70         80         90        100        110        120
orf78.pep  VLVGDGIMFAAGRIWGQXXLXFXPIAXIMTPXRYEQVQEKFDKYGNWVLFVARFLPGLRT
           ||||||||||||||| | | ||| |||| ||||||| |||||||||||||||||:|||||
orf78a     VLVGDGIMFAAGRIWGQKILKFKPIARIMTPKRYAQVQEKFDKYGNWVLFVARPLPGLRT
                   70         80         90        100        110        120

130        140
orf78.pep  AVFVTAGISRKVSYLRFIIMDGLAA
           |||||||||||||||||||:|||||
orf78a     AVFVTAGISRKVSYLRFLIMDGLAALISVPVWIYLGEYGAHNIDWLMAKMHSLQSGIFIA
                  130        140        150        160        170        180
```

The complete length ORF78a nucleotide sequence (SEQ ID NO: 723) is:

```
  1 ATGTTTGCCC TTTTGGAAGC CTTTTTTGTC GAATACGGCT ATGCGGCCGT

51 GTTTTTCGTT TTGGTCATCT GCGGTTTCGG CGTGCCGATT CCCGAGGATT

101 TGACCTTGGT AACAGGCGGC GTGATTTCGG GTATGGGTTA TACCAATCCG

151 CATATTATGT TTGCAGTCGG TATGCTCGGC GTATTGGTCG GGACGGCAT

201 CATGTTCGCC GCCGGACGCA TCTGGGGGCA GAAAATCCTC AAGTTCAAAC

251 CGATTGCGCG CATCATGACG CCGAAACGTT ACGCACAGGT CAGGAAAAA

301 TTCGACAAAT ACGGCAACTG GGTGTTATTT GTCGCTCGTT TCCTGCCCGG

351 TTTGCGGACT GCCGTTTTCG TTACCGCCGG CATCAGCCGC AAAGTATCGT

401 ATCTGCGCTT TCTGATTATG GACGGGCTTG CCGCGCTGAT TTCCGTGCCC

451 GTTTGGATTT ACTTGGGCGA GTACGGCGCG CACAACATCG ATTGGCTGAT

501 GGCGAAAATG CACAGCCTGC AATCCGGCAT CTTCATCGCA TTGGGCGTGC

551 TGGCGGCGGC GCTGGCGTGG TTCTGGTGGC GCAAACGCCG ACATTATCAG
```

-continued

```
601 CTTTACCGCG CACAATTGAG CGAAAAACGC GCCAAACGCA AGGCGGAAAA
651 GGCAGCGAAA AAAGCGGCAC AGAAGCAGCA GTAA
```

This encodes a protein having amino acid sequence (SEQ ID NO: 724):

```
  1 MFALLEAFFV EYGYAAVFFV LVICGFGVPI PEDLTLVTGG VISGMGYTNP
 51 HIMFAVGMLG VLVGDGIMFA AGRIWGQKIL KFKPIARIMT PKRYAQVQEK
101 FDKYGNWVLF VARFLPGLRT AVFVTAGISR KVSYLRFLIM DGLAALISVP
151 VWIYLGEYGA HNIDWLMAKM HSLQSGIFIA LGVLAAALAW FWWRKRRHYQ
201 LYRAQLSEKR AKRKAEKAAK KAAQKQQ*
```

ORF78a (SEQ ID NO: 724) and ORF78-1 (SEQ ID NO: 722) show 89.0% identity in 227 aa overlap:

```
                  10        20        30        40        50        60
orf78a.pep MFALLEAFFVEYGYAAVFFVLVICGFGVPIPEDLTLVTGGVISGMGYTNPHIMFAVGMLG
           |||:||||||||||||||||||||||||||||||||||||||||||||||||||||||||
orf78-1    MFAFLEAFFVEYGYAAVFFVLVICGFGVPIPEDLTLVTGGVISGMGYTNPHIMFAVGMLG
                  10        20        30        40        50        60

70        80        90       100       110       120
orf78a.pep VLVGDGIMFAAGRIWGQKILKFKPIARIMTPKRYAQVQEKFDKYGNWVLFVARFLPGLRT
           ||||||||||||||||||||:||||||||||||||| ||||||||||||||||||||||
orf78-1    VLVGDGIMFAAGRIWGQKILRFKPIARIMTPKRYEQVQEKFDKYGNWVLFVARFLPGLRT
                  70        80        90       100       110       120

130       140       150       160       170       180
orf78a.pep AVFVTAGISRKVSYLRFLIMDGLAALISVPVWIYLGEYGAHNIDWLMAKMHSLQSGIFIA
           |||||||||||||||||:|||||||||||||:||||||||||||||||||||||||||:
orf78-1    AVFVTAGISRKVSYLRFIIMDGLAALISVPIWIYLGEYGAHNIDWLMAKMHSLQSGIFVI
                 130       140       150       160       170       180

190       200       210       220
orf78a.pep LGVLAAALAWFWWRKRRHYQLYRAQLSEKRAKRKAEKAAKKAAQKQQX
           ||:|:::||:||::  |:||::|:||||:||| ||||||||||::||
orf78-1    LGIGATVVAWIWWKKRQRIQFYRSKLKEKRAQRKAAKAAKKAAQSKQX
                 190       200       210       220
```

Homology with a Predicted ORF from N.gonorrhoeae

ORF78 (SEQ ID NO: 720) shows 97.4% identity over 38 aa overlap with a predicted ORF (ORF78ng) (SEQ ID NO: 726) from N. gonorrhoeae:

```
orf78.pep XXLXFXPIAXIMTPXRYEQVQEKFDKYGNWVLFVARFLPGLRTAVFVTAGISRKVSYLRF 137
                                   ||||||||||||||||||||||||||||||||
orf78ng                            YPVLFVARFLPGLRTAVFVTAGISRKVSYLRF  32 orf78.pep IIMDGLAA                                                     145
          :|||||||
orf78ng   LIMDGLAALISVPVWIYLGEYGAHNIDWLMAKMHSLQSGIFIALGVLAAALAWFWWRKRR  92
```

The ORF78ng nucleotide sequence (SEQ ID NO: 725) is predicted to encode a protein comprising amino acid sequence (SEQ ID NO: 726):

```
  1 ..YPVLFVARFL PGLRTAVFVT AGISRKVSYL RFLIMDGLAA LISVPVWIYL
 51    GEYGAHNIDW LMAKMHSLQS GIFIALGVLA AALAWFWWRK RRHYQLYRAQ
101    LSEKRAKRKA EKAAKKAAQK QQ*
```

Further work revealed the complete gonococcal nucleotide sequence (SEQ ID NO: 727):

```
  1  atgtttgccc tttTggaagc CTTTTTTGTC GAAtacggCt atgcGGCCGT
 51  GTTTTTCGTT TTGGTCATCT GCGGTTTCGG CGTGCCGATT CCCGAAGATT
101  TGACCTTGGT AACGGGCGGC GTGATTTCGG GTATGGGTTA TACCAATCCG
151  CATATTATGT TTGCGGTCGG TATGCTCGGC GTGTTGGCGG GCGACGGCGT
201  GATGTTTGCC GCCGGACGCA TCTGGGGGCA GAAAATCCTC AAGTTCAAAC
251  CGATTGCGCG CATCATGACG CCGAAACGTT ACGCGCAGGT TCAGGAAAAA
301  TTCGACAAAT ACGGCAACTG GGTTCTGTTT GTCGCCCGTT TCCTGCCGGG
351  TTTGCGGACT GCCGTTTTCG TTACCGCCGG CATCAGCCGC AAAGTATCGT
401  ATCTGCGCTT TCTGATTATG GACGGGCTGG CCGCGCTGAT TTCCGTGCCC
451  GTTTGGATTT ACTTGGGCGA GTACGGCGCG CACAACATCG ATTGGCTGAT
501  GGCGAAAATG CACAGCCTGC AATCGGGCAT CTTCATCGCA TTGGGCGTGC
551  TGGCGGCGGC GCTGGCGTGG TTCTGGTGGC GCAAACGCCG ACATTATCAG
601  CTTTACCGCG CACAATTGAG CGAAAAACGC GCCAAACGCA AGGCGGAAAA
651  GGCAGCGAAA AAAGCGGCAC AGAAGCAGCA GTAa
```

This corresponds to the amino acid sequence (SEQ ID NO: 728; ORF78ng-1):

```
  1  MFALLEAFFV EYGYAAVFFV LVICGFGVPI PEDLTLVTGG VISGMGYTNP
 51  HIMFAVGMLG VLAGDGVMFA AGRIWGQKIL KFKPIARIMT PKRYAQVQEK
101  FDKYGNWVLF VARFLPGLRT AVFVTAGISR KVSYLRFLIM DGLAALISVP
151  VWIYLGEYGA HNIDWLMAKM HSLQSGIFIA LGVLAAALAW FWWRKRRHYQ
201  LYRAQLSEKR AKRKAEKAAK KAAQKQQ*
```

ORF78ng-1 (SEQ ID NO: 728) and ORF78-1 (SEQ ID NO: 722) show 88.1% identity in 227 aa overlap:

```
                    10        20        30        40        50        60
orf78-1.pep  MFAFLEAFFVEYGYAAVFFVLVICGFGVPIPEDLTLVTGGVISGMGYTNPHIMFAVGMLG
             |||:||||||||||||||||||||||||||||||||||||||||||||||||||||||||
orf78ng-1    MFALLEAFFVEYGYAAVFFVLVICGFGVPIPEDLTLVTGGVISGMGYTNPHIMFAVGMLG
                    10        20        30        40        50        60

70        80        90       100       110       120
orf78-1.pep  VLVGDGIMFAAGRIWGQKILRFKPIARIMTPKRYEQVQEKFDKYGNWVLFVARFLPGLRT
             ||:||||:||||||||||||||:||||||||||||| |||||||||||||||||||||||
orf78ng-1    VLAGDGVMFAAGRIWGQKILKFKPIARIMTPKRYAQVQEKFDKYGNWVLFVARFLPGLRT
                    70        80        90       100       110       120

130       140       150       160       170       180
orf78-1.pep  AVFVTAGISRKVSYLRFLIMDGLAALISVPIWIYLGEYGAHNIDWLMAKMHSLQSGIFVI
             |||||||||||||||||||||||||||||:||||||||||||||||||||||||||||:
orf78ng-1    AVFVTAGISRKVSYLRFLIMDGLAALISVPVWIYLGEYGAHNIDWLMAKMHSLQSGIFIA
                   130       140       150       160       170       180

190       200       210       220
orf78-1.pep  LGIGATVVAWIWWKKRQRIQFYRSKLKEKRAQRKAAKAAKKAAQSKQX
             ||: |:::||:||:||:: |:||::|:||||:||| ||||||||::||
orf78ng-1    LGVLAAALAWFWWRKRRHYQLYRAQLSEKRAKRKAEKAAKKAAQKQQX
                   190       200       210       220
```

Furthermore, orf78ng-1 (SEQ ID NO: 728) shows homology to the dedA protein (SEQ ID NO: 1158) from *H.influenzae*:

```
sp|P45280|YG29_HAEIN HYPOTHETICAL PROTEIN HI1629 )gi|1073983|pir||D64133 dedA
protein (dedA) homolog - Haemophilus influenzae (strain Rd KW20)
)gi|1574476 (U32836) dedA protein (dedA) [Haemophilus influenzae] Length = 212
Score = 223 bits (563), Expect = 7e-58
Identities = 108/182 (59%), Positives = 140/182 (76%), Gaps = 2/182 (1%)
Query:   5 LEAFFVEYGYAAVFFVLVICGFGVPIPEDLTLVTGGVISGM--GYTNPHIMFAVGMLGVL    62
           L  FF EYGY AV FVL+ICGFGVPIPED+TLV+GGVI+G+      N H+M  V M+GVL
Sbjct:  21 LIGFFTEYGYWAVLFVLIICGFGVPIPEDITLVSGGVIAGLYPENVNSHLMLLVSMIGVL    80

Query:  63 AGDGVMFAAGRIWGQKILKFKPIARIMTPKRYAQVQEKFDKYGNWVLFVARFLPGLRTAV   122
           AGD  M+  GRI+G KIL+F+PI RI+T +R    V+EKF +YGN VLFVARFLPGLR  +
Sbjct:  81 AGDSCMYWLGRIYGTKILRFRPIRRIVTLQRLRMVREKFSQYGNRVLFVARFLPGLRAPI   140

Query: 123 FVTAGISRKVSYLRFLIMDGLAALISVPVWIYLGEYGAHNIDWLMAKMHSLQSGIFIALG   182
           ++  +GI+R+VSY+RF+++D  AA+ISVP+WIYLGE GA N+DWL  ++    Q  I+I +G
Sbjct: 141 YMVSGITRRVSYVRFVLIDFCAAIISVPIWIYLGELGAKNLDWLHTQIQKGQIVIYIFIG   200

Query: 183 VL                                                            184
           L
Sbjct: 201 YL                                                            202
```

Based on this analysis, including the presence of putative transmembrane domains, it is predicted that these proteins from *N.meningitidis* and *N.gonorrhoeae*, and their epitopes, could be useful antigens for vaccines or diagnostics, or for raising antibodies.

Example 87

The following partial DNA sequence was identified in *N.meningitidis* (SEQ ID NO: 729):

```
  1 ATGAAAAAAT TATTGGCGGC CGTGATGATG GCAGGTTTGG CAGGCGCGGT
 51 TTCCGCCGCC GGAGTCCACG TTGAGGACGG CTGGGCGCGC ACCACCGTCG
101 AAGGTATGAA AATAGGCGGC GCGTTCATGA AATCCACAA CGACGAAGCC
151 AAACAAGACT TTTTGCTCGG CGGAAGCAGC CCCGTTGCCG ACCGCGTCGA
201 AGTGCATACC CACATCAACG ACAACGGCGT GATGCGGATG CGCGAAGTCG
251 AAGGCGGCGT GCCTTTGGAA GCGAAATCCG TTACCGAACT CAAACCCGGC
301 AGCTATCATG TGATGTTTAT GGGTTTGAAA AAACAATTAA AAGAGGGCGA
351 TAAAATTCCC GTTACCCTGA AATTTAAAAA CGCCAAAGCG CAAACCGTCC
401 AACTGGAAGT CAAAATCGCG CCGATGCCGG CAATGAACCA C...
```

This corresponds to the amino acid sequence (SEQ ID NO: 730; ORF79):

```
  1 MKKLLAAVMM AGLAGAVSAA GVHVEDGWAR TTVEGMKIGG AFMKIHNDEA
 51 KQDFLLGGSS PVADRVEVHT HINDNGVMRM REVEGGVPLE AKSVTELKPG
101 SYHVMFMGLK KQLKEGDKIP VTLKFKNAKA QTVQLEVKIA PMPAMNH..
```

Further work revealed the complete nucleotide sequence (SEQ ID NO: 731):

```
  1 ATGAAAAAAT TATTGGCGGC CGTGATGATG GCAGGTTTGG CAGGCGCGGT
 51 TTCCGCCGCC GGAGTCCACG TTGAGGACGG CTGGGCGCGC ACCACCGTCG
101 AAGGTATGAA AATAGGCGGC GCGTTCATGA AATCCACAA CGACGAAGCC
151 AAACAAGACT TTTTGCTCGG CGGAAGCAGC CCCGTTGCCG ACCGCGTCGA
```

-continued

```
201  AGTGCATACC CACATCAACG ACAACGGCGT GATGCGGATG CGCGAAGTCG

251  AAGGCGGCGT GCCTTTGGAA GCGAAATCCG TTACCGAACT CAAACCCGGC

301  AGCTATCATG TGATGTTTAT GGGTTTGAAA AAACAATTAA AAGAGGGCGA

351  TAAAATTCCC GTTACCCTGA AATTTAAAAA CGCCAAAGCG CAAACCGTCC

401  AACTGGAAGT CAAAATCGCG CCGATGCCGG CAATGAACCA CGGTCATCAC

451  CACGGCGAAG CGCATCAGCA CTAA
```

This corresponds to the amino acid sequence (SEQ ID NO: 732; ORF79-1):

```
  1  MKKLLAAVMM AGLAGAVSAA GVHVEDGWAR TTVEGMKIGG AFMKIHNDEA

51  KQDFLLGGSS PVADRVEVHT HINDNGVMRM REVEGGVPLE AKSVTELKPG

101  SYHVMFMGLK KQLKEGDKIP VTLKFKNAKA QTVQLEVKIA PMPAMNHGHH

151  HGEAHQH*
```

Computer analysis of this amino acid sequence revealed a putative leader peptide and also gave the following results: Homology with a Predicted ORF from *N.meningitidis* (Strain A)

ORF79 (SEQ ID NO: 730) shows 94.6% identity over a 147aa overlap with an ORF (ORF79a) (SEQ ID NO: 734) from strain A of *N. meningitidis*:

```
                       10         20         30         40         50         60
orf79.pep  MKKLLAAVMMAGLAGAVSAAGVHVEDGWARTTVEGMKIGGAFMKIHNDEAKQDFLLGGSS
           || ||||||||||||||||:|||||||||||||:|||||||||||||||||||||||||
orf79a     MKXLLAAVMMAGLAGAVSAAGIHVEDGWARTTVEGMKMGGAFMKIHNDEAKQDFLLGGSS
                       10         20         30         40         50         60

70         80         90        100        110        120
orf79.pep  PVADRVEVHTHINDNGVMRMREVEGGVPLEAKSVTELKPGSYHVMFMGLKKQLKEGDKIP
           ||||||||||||||||||||||||||||||||||||||||||||||||| ||||| |||||
orf79a     PVADRVEVHTHINDNGVMRMREVEGGVPLEAKSVTELKPGSYHVMFMGXKKQLKXGDKIP
                       70         80         90        100        110        120

130        140
orf79.pep  VTLKFKNAKAQTVQLEVKIAPMPAMNH
           |||||||||||||||||| ||| ||:|
orf79a     VTLKFKNAKAQTVQLEVKTAPMSAMDHGHHHGEAHQHX
                      130        140        150
```

The complete length ORF79a nucleotide sequence (SEQ ID NO: 733) is:

```
  1  ATGAAANAAC TATTGGCAGC CGTGATGATG GCAGGTTTGG CAGGCGCGGT

51  TTCCGCCGCC GGAATCCACG TTGAGGACGG CTGGGCGCGC ACCACCGTCG

101  AAGGTATGAA AATGGGCGGC GCGTTCATGA AAATCCACAA CGACGAAGCC

151  AAACAAGACT TTTTGCTCGG CGGAAGCAGC CCTGTTGCCG ACCGCGTCGA

201  AGTGCATACC CATATCAATG ATAACGGTGT GATGCGGATG CGCGAAGTCG

251  AAGGCGGCGT GCCTTTGGAG GCGAAATCCG TTACCGAACT CAAACCCGGC

301  AGCTATCATG TCATGTTTAT GGGTNTGAAA AAACAATTAA AAGANGGCGA

351  CAAGATTCCC GTTACCCTGA AATTTAAAAA CGCCAAAGCA CAAACCGTCC

401  AACTGGAAGT CAAAACCGCG CCGATGTCGG CAATGGACCA CGGTCATCAC

451  CACGGCGAAG CGCATCAGCA CTAA
```

This encodes a protein having amino acid sequence (SEQ ID NO: 734):

```
  1  MKXLLAAVMM AGLAGAVSAA GIHVEDGWAR TTVEGMKMGG AFMKIHNDEA

51  KQDFLLGGSS PVADRVEVHT HINDNGVMRM REVEGGVPLE AKSVTELKPG

101  SYHVEMFMGXK KQLKXGDKIP VTLKFKNAKA QTVQLEVKTA PMSAMDHGHH

151  HGEAHQH*
```

ORF79a (SEQ ID NO: 734) and ORF79-1 (SEQ ID NO: 732) show 94.9% identity in 157 aa overlap:

```
                     10         20         30         40         50         60
orf79a.pep   MKXLLAAVMMAGLAGAVSAAGIHVEDGWARTTVEGMKMGGAFMKIHNDEAKQDFLLGGSS
             ||  ||||||||||||||||: |||||||||||||||||:|||||||||||||||||||||
orf79-1      MKKLLAAVMMAGLAGAVSAAGVHVEDGWARTTVEGMKIGGAFMKIHNDEAKQDFLLGGSS
                     10         20         30         40         50         60

70         80         90        100        110        120
orf79a.pep   PVADRVEVHTHINDNGVMRMREVEGGVPLEAKSVTELKPGSYHVMFMGXKKQLKXGDKIP
             ||||||||||||||||||||||||||||||||||||||||||||||||| ||||| |||||
orf79-1      PVADRVEVHTHINDNGVMRMREVEGGVPLEAKSVTELKPGSYHVMFMGLKKQLKEGDKIP
                     70         80         90        100        110        120

130        140        150
orf79a.pep   VTLKFKNAKAQTVQLEVKTAPMSAMDHGHHHGEAHQHX
             ||||||||||||||||||||| ||| ||:||||||||||
orf79-1      VTLKFKNAKAQTVQLEVKIAPMPAMNHGHHHGEAHQHX
                    130        140        150
```

Homology with a Predicted ORF from *N.gonorrhoeae*

ORF79 (SEQ ID NO: 730) shows 96.1% identity over 76 aa overlap with a predicted ORF (ORF79ng) (SEQ ID NO: 736) from *N.gonorrhoeae*:

```
orf79.pep  FMKIHNDEAKQDFLLGGSSPVADRVEVHTHINDNGVMRMREVEGGVPLEAKSVTELKPGS   101
                                           |||||||||||:|||||||||||||||||||
orf79ng                                INDNGVMRMREVKGGVPLEAKSVTELKPGS    30 orf79.pep  YHVMFMGLKKQLKEGDKIPVTLKFKNAKAQTVQLEVKIAPMPAMNH                147
           ||||||||||||||||||||||||||||||||||||||| ||| ||||
orf79ng    YHVMFMGLKKQLKEGDKIPVTLKFKNAKAQTVQLEVKTAPMSAMNHGHHHGEAHQH       86
```

An ORF79ng nucleotide sequence (SEQ ID NO: 735) was predicted to encode a protein comprising amino acid sequence (SEQ ID NO: 736):

```
  1  ..INDNGVMRMR EVKGGVPLEA KSVTELKPGS YHVMFMGLKK QLKEGDKIPV

51     TLKFKNAKAQ TVQLEVKTAP MSAMNHGHHH GEAHQH*
```

Further work revealed the complete gonococcal DNA sequence (SEQ ID NO: 737):

```
  1  ATGAAAAAAT TATTGGCAGC CGTGATGATG GCAGGTTTGG CAGGCGCGGT

51  TTccgccgCc GGagTccAtG TCGAggACGG CTGGGCGCGc accaCTGtcg 101  aaggtATgaa aatggGCGGC GCgttCATga aaATCCACAA CGACGaaGcc 151  atacaaGACt ttgtgcTCgg CGGaagcatg cccgttgccg accgcGTCGA 201  AGTGCAtaca cacATCAACG ACAACGGCGT GATGCGTATG CGCGAAGTCA
```

```
                     -continued
251  AAGGCGGCGT GCCTTTGGAG GCGAAATCCG TTACCGAACT CAAACCCGGC

301  AGCTATCACG TGATGTTTAT GGGTTTGAAA AAACAACTGA AAGAGGGCGA

351  CAAGATTCCC GTTACCCTGA AATTTAAAAA CGCCAAAGCG CAAACCGTCC

401  AACTGGAAGT CAAAACCGCG CCGATGTCGG CAATGAACCA CGGTCATCAC

451  CACGGCGAAG CGCATCAGCA CTAA
```

This corresponds to the amino acid sequence (SEQ ID NO: 738; ORF79ng-1):

```
  1  MKKLLAAVMM AGLAGAVSAA GVHVEDGWAR TTVEGMKMGG AFMKIHNDEA

51  IQDFVLGGSM PVADRVEVHT HINDNGVMRM REVKGGVPLE AKSVTELKPG

101  SYHVMFMGLK KQLKEGDKIP VTLKFKNAKA QTVQLEVKTA PMSAMNHGHH

151  HGEAHQH*
```

ORF79ng-1(SEQ ID NO: 738) and ORF79-1 (SEQ ID NO: 732) show 95.5% identity in 157 aa overlap:

```
                 10        20        30        40        50        60
orf79-1.pep  MKKLLAAVMMAGLAGAVSAAGVHVEDGWARTTVEGMKIGGAFMKIHNDEAKQDFLLGGSS
             ||||||||||||||||||||||||||||||||||||:||||||||||||| |||:||||
orf79ng-1    MKKLLAAVMMAGLAGAVSAAGVHVEDGWARTTVEGMKMGGAFMKIHNDEAIQDFVLGGSM
                 10        20        30        40        50        60

70        80        90       100       110       120
orf79-1.pep  PVADRVEVHTHINDNGVMRMREVEGGVPLEAKSVTELKPGSYHVMFMGLKKQLKEGDKIP
             |||||||||||||||||||||||:||||||||||||||||||| ||||||||||||||||
orf79ng-1    PVAQRVEVHTHINDNGVMRMREVKGGVPLEAKSVTELKPGSYVVMFMGLKKQLKEGDKIP
                 70        80        90       100       110       120

130       140       150
orf79-1.pep  VTLKFKNAKAQTVQLEVKIAPMPAMNHGHHHGEAHQHX
             |||||||||||||||||| ||| ||||||||||||||
orf79ng-1    VTLKFKNAKAQTVQLEVKTAPMSAMNHGHHHGEAHQHX
                130       140       150
```

Furthermore, ORF79ng-1 (SEQ ID NO: 738) shows significant homology to a protein (SEQ ID NO: 1159) from *Aquifex aeolicus*:

```
gi|2983695 (AE000731) putative protein (Aquifex aeolicus) Length = 151
Score = 63.6 bits (152), Expect = 6e-10
Identities = 38/114 (33%), Positives = 58/114 (50%), Gaps = 1/114 (0%)

Query:  24 VEDGWARTTVEGMKMGGAFMKIHNDEAIQDFVLGGSMPVADRVEVHTHINDNGVMRMREV    83
           V+  W        G     M I N+    D+++G    +A RVE+H  + +N V +M
Sbjct:  27 VKHPWVMEPPPGPNTTMMGMIIVNEGDEPDYLIGAKTDIAQRVELHKTVIENDVAKMVPQ    86

Query:  84 KGGVPLEAKSVTELKPGSYMVMFMGLKKQLKEGDKIPVTLKFKNAKAQTVQLEV         137
           + + + K   E K    YHVM +GLKK++KEGDK+ V L F+ +    TV+ V
Sbjct:  81 ER-IEIPPKGKVEFKHHGYHVMIIGLKKRIKEGDKVKVELIFEKSGKITVEAPV         139
```

Based on this analysis, it is predicted that the proteins from *N.meningitidis* and *N.gonorrhoeae*, and their epitopes, could be useful antigens for vaccines or diagnostics, or for raising antibodies.

Figure 18A:
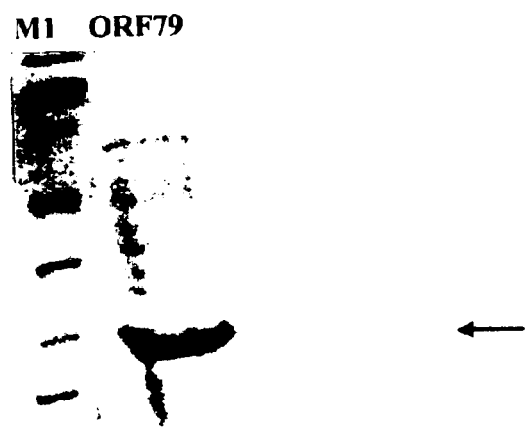
Figure 18B:
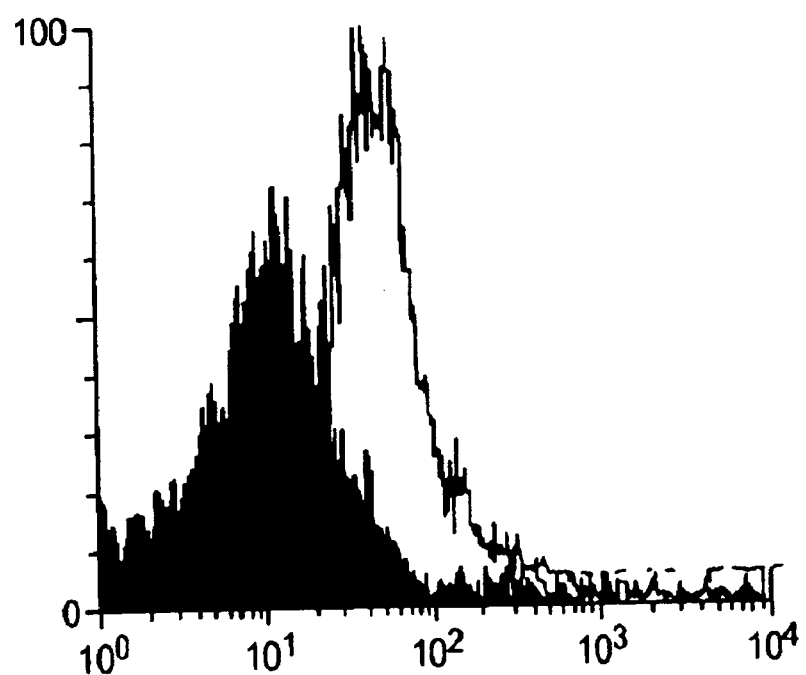

ORF79-1 (SEQ ID NO: 732) (15.6 kDa) was cloned in the pET vector and expressed in *E.coli*, as described above. The products of protein expression and purification were analyzed by SDS-PAGE. FIG. 18A shows the results of affinity purification of the His-fusion protein. Purified His-fusion protein was used to immunise mice, whose sera were used for ELISA (positive result) and FACS analysis (FIG. 18B) These experiments confirm that ORF79-1 (SEQ ID NO: 732) is a surface-exposed protein, and that it is a useful immunogen.

Example 88

The following DNA sequence, believed to be complete, was identified in *N.meningitidis* (SEQ ID NO: 739):

```
  1 ATGACGGTAA CTGCGGCCGA AGGCGGCAAA GCTGCCAAGG CGTTAAAAAA
 51 ATATCTGATT ACGGGCATTT TGGTCTGGCT GCCGATTGCG GTAACGGTTT
101 GGGTGGTTTC CTATATCGTT TCCGCGTCCG ATCAGCTCGT CAACCTGCTG
151 CCGAAGCAAT GGCGGCCGCA ATATGTTTTG GGGTTTAATA TCCCGGGGCT
201 GGGCGTTATC GTTGCCATTG CCGTATTGTT TGTAACCGGA TTGTTTGCCG
251 CCAACGTATT GGGTCGGCAG ATCCTCGCCG CGTGGGACAG CCTGTTGGGG
301 CGGATTCCGG TTGTGAAAtC CATCTATTCG AGTGTGAAAA AAGTATCCGA
351 ATacgTGCTG TCCGACAGCA GCCGTTCGTT TAAAACGCCG GTACTCGTGC
401 CGTTTCCCCA GCCCGGTATT TGGACGATyG CTTTCGTGTC AGGGCAGGTG
451 TCGAATGCGG TTAAGGCCGC ATTGCCGAAs GACGGCGATT ATCTTTCCGT
501 GTATGTTCCG ACCACGCCGA ATCCGACCGG CGGTTACTAT ATTATGGTAA
551 AGAAAAGCGA TGTGCGCGAA CTCGATATGA GCGTGGACGA AsCATTGAAA
601 TATGTGATTT CGCTGGGTAT GGTCATCCCT GACGACCTGC CCGTCAAAAC
651 ATTGGCAsGA CCTATGCCGT CTGAAAAGGC GGATTTGCCC GAACAACAAT
701 AA
```

This corresponds to the amino acid sequence (SEQ ID NO: 740; ORF98):

```
  1 MTVTAAEGGK AAKALKKYLI TGILVWLPIA VTVWVVSYIV SASDQLVNLL
 51 PKQWRPQYVL GFNIPGLGVI VAIAVLFVTG LFAANVLGRQ ILAAWDSLLG
101 RIPVVKSIYS SVKKVSEYVL SDSSRSFKTP VLVPFPQPGI WTIAFVSGQV
151 SNAVKAALPX DGDYLSVYVP TTPNPTGGYY IMVKKSDVRE LDMSVDEXLK
201 YVISLGMVIP DDLPVKTLAX PMPSEKADLP EQQ*
```

Further work revealed the complete nucleotide sequence (SEQ ID NO: 741):

```
  1 ATGACGGAAC nTGCGGCCGA AGGCGGCAAA GCTGCCAArG CGTTAAAAAA
 51 ATATCTGATT ACGGGCATTT TGGTCTGGCT GCCGATTGCG GTAACGGTTT
101 GGGTGGTTTC CTATATCGTT TCCGCGTCCG ATCAGCTCGT CAACCTGCTG
151 CCGAAGCAAT GGCGGCCGCA ATATGTTTTG GGGTTTAATA TCCCGGGGCT
201 GGGCGTTATC GTTGCCATTG CCGTATTGTT TGTAACCGGA TTGTTTGCCG
251 CCAACGTATT GGGTCGGCAG ATCCTCGCCG CGTGGGACAG CCTGTTGGGG
301 CGGATTCCGG TTGTGAAATC CATCTATTCG AGTGTGAAAA AAGTATCCGA
351 ATCGCTGCTG TCCGACAGCA GCCGTTCGTT TAAAACGCCG GTACTCGTGC
401 CGTTTCCCCA GCCCGGTATT TGGACGATTG CTTTCGTGTC AGGGCAGGTG
451 TCGAATGCGG TTAAGGCCGC ATTGCCGAAG GACGGCGATT ATCTTTCCGT
501 GTATGTTCCG ACCACGCCGA ATCCGACCGG CGGTTACTAT ATTATGGTAA
551 AGAAAAGCGA TGTGCGCGAA CTCGATATGA GCGTGGACGA AGCATTGAAA
601 TATGTGATTT CGCTGGGTAT GGTCATCCCT GACGACCTGC CCGTCAAAAC
651 ATTGGCAGGA CCTATGCCGT CTGAAAAGGC GGATTTGCCC GAACAACAAT
701 AA
```

This corresponds to the amino acid sequence (SEQ ID NO: 742; ORF98-1):

```
  1 MTEXAAEGGK AAKALKKYLI TGILVWLPIA VTVWVVSYIV SASDQLVNLL

51 PKQWRPQYVL GFNIPGLGVI VAIAVLFVTG LFAANVLGRQ ILAAWDSLLG

101 RIPVVKSIYS SVKKVSESLL SDSSRSFKTP VLVPFPQPGI WTIAFVSGQV

151 SNAVKAALPK DGDYLSVYVP TTPNPTGGYY IMVKKSDVRE LDMSVDEALK

201 YVISLGMVIP DDLPVKTLAG PMPSEKADLP EQQ*
```

Computer analysis of this amino acid sequence gave the following results:
Homology with a Predicted ORF from *N.meningitidis* (Strain A)

ORF98 (SEQ ID NO: 740) shows 96.1% identity over a 233aa overlap with an ORF (ORF98a) (SEQ ID NO: 744) from strain A of *N. meningitidis*:

```
                   10         20         30         40         50         60
orf98.pep MTVTAAEGGKAAKALKKYLITGILVWLPIAVTVWVVSYIVSASDQLVNLLPKQWRPQYVL
          ||  ||||||||||||||||||||||||||||||||||||||||||||||||||||||||
orf98a    MTEPAAEGGKAAKALKKYLITGILVWLPIAVTVWVVSYIVSASDQLVNLLPKQWRPQYVL
                   10         20         30         40         50         60

70         80         90        100        110        120
orf98.pep GFNIPGLGVIVAIAVLFVTGLFAANVLGRQILAAWDSLLGRIPVVKSIYSSVKKVSEYVL
          |||||||||||||||||||||||||||||||||||||||||||||||||||||||  :|
orf98a    GFNIPGLGVIVAIAVLFVTGLFAANVLGRQILAAWDSLLGRIPVVKSIYSSVKKVSXSLL
                   70         80         90        100        110        120

130        140        150        160        170        180
orf98.pep SDSSRSFKTPVLVPFPQPGIWTIAFVSGQVSNAVKAALPXDGDYLSVYVPTTPNPTGGYY
          |||||||||||||||||||| |||||||||||||||||| ||||||||||||||||||||
orf98a    SDSSRSFKTPVLVPFPQSGIWTIAFVSGQVSNAVKAALPKDGDYLSVYVPTTPNPTGGYY
                  130        140        150        160        170        180

190        200        210        220        230
orf98.pep IMVKKSDVRELDMSVDEXLKYVISLGMVIPDDLPVKTLAXPMPSEKADLPEQQX
          ||||||||||||||||||| |||||||||||||||||||| |||||||||||||
orf98a    IMVKKSDVRELDMSVDEALKYVISLGMVIPDDLPVKTLAGPMPSEKADLPEQQX
                  190        200        210        220        230
```

The complete length ORF98a nucleotide sequence (SEQ ID NO: 743) is:

```
  1 ATGACGGAAC CTGCGGCCGA AGGCGGCAAA GCTGCCAAGG CGTTAAAAAA

51 ATATCTGATT ACGGGCATTT TGGTCTGGCT GCCGATTGCG GTAACGGTTT

101 GGGTGGTTTC CTATATCGTT TCCGCGTCCG ATCAGCTCGT CAACCTGCTG

151 CCGAAGCAAT GGCGGCCGCA ATATGTTTTG GGGTTTAATA TCCCGGGGCT

201 GGGCGTTATC GTTGCCATTG CCGTATTGTT TGTAACCGGA TTATTTGCCG

251 CAAACGTATT GGGCCGGCAG ATTCTTGCCG CGTGGGACAG CTTGTTGGGG

301 CGGATTCCGG TTGTGAAGTC CATCTATTCG AGTGTGAAAA AAGTATCCGA

351 NTCGTTGCTG TCCGACAGCA GCCGTTCGTT TAAAACACCA GTACTCGTGC

401 CGTTTCCCCA ATCGGGTATT TGGACAATCG CATTCGTGTC CGGTCAGGTG

451 TCGAATGCGG TTAAGGCCGC ATTGCCGAAG GACGGCGATT ATCTTTCCGT

501 GTATGTTCCG ACCACGCCGA ATCCGACCGG CGGTTACTAT ATTATGGTAA

551 AGAAAAGCGA TGTGCGCGAA CTCGATATGA GCGTGGACGA AGCGTTGAAA

601 TATGTGATTT CGCTGGGTAT GGTCATCCCT GACGACCTGC CCGTCAAAAC

651 ATTGGCAGGA CCTATGCCGT CTGAAAAGGC GGATTTGCCC GAACAACAAT

701 AA
```

This encodes a protein having amino acid sequence (SEQ ID NO: 744):

```
  1 MTEPAAEGGK AAKALKKYLI TGILVWLPIA VTVWVVSYIV SASDQLVNLL

51 PKQWRPQYVL GFNIPGLGVI VAIAVLFVTG LFAANVLGRQ ILAAWDSLLG

101 RIPVVKSIYS SVKKVSXSLL SDSSRSFKTP VLVPFPQSGI WTIAFVSGQV

151 SNAVKAALPK DGDYLSVYVP TTPNPTGGYY IMVKKSDVRE LDMSVDEALK

201 YVISLGMVIP DDLPVKTLAG PMPSEKADLP EQQ*
```

ORF98a (SEQ ID NO: 744) and ORF98-1 (SEQ ID NO: 742) show 98.7% identity in 233 aa overlap:

```
                   10         20         30         40         50         60
orf98.pep  MTEPAAEGGKAAKALKKYLITGILVWLPIAVTVWVVSYIVSASDQLVNLLPKQWRPQYVL
           ||| ||||||||||||||||||||||||||||||||||||||||||||||||||||||||
orf98-1    MTEXAAEGGKAAKALKKYLITGILVWLPIAVTVWVVSYIVSASDQLVNLLPKQWRPQYVL
                   10         20         30         40         50         60

70         80         90        100        110        120
orf98.pep  GFNIPGLGVIVAIAVLFVTGLFAANVLGRQILAAWDSLLGRIPVVKSIYSSVKKVSXSLL
           |||||||||||||||||||||||||||||||||||||||||||||||||||||||| |||
orf98-1    GFNIPGLGVIVAIAVLFVTGLFAANVLGRQILAAWDSLLGRIPVVKSIYSSVKKVSESLL
                   70         80         90        100        110        120

130        140        150        160        170        180
orf98.pep  SDSSRSFKTPVLVPFPQSGIWTIAFVSGQVSNAVKAALPKDGDYLSVYVPTTPNPTGGYY
           ||||||||||||||||||||||||||||||||||||||||||||||||||||||||||||
orf98-1    SDSSRSFKTPVLVPFPQPGIWTIAFVSGQVSNAVKAALPKDGDYLSVYVPTTPNPTGGYY
                  130        140        150        160        170        180

190        200        210        220        230
orf98.pep  IMVKKSDVRELDMSVDEALKYVISLGMVIPDDLPVKTLAGPMPSEKADLPEQQX
           |||||||||||||||||||||||||||||||||||||||||||||||||||||
orf98-1    IMVKKSDVRELDMSVDEALKYVISLGMVIPDDLPVKTLAGPMPSEKADLPEQQX
                  190        200        210        220        230
```

Homology with a Predicted ORF from *N.gonorrhoeae*

ORF98 (SEQ ID NO: 740) shows 95.3% identity over a 233 aa overlap with a predicted ORF (ORF98ng) (SEQ ID NO: 746) from *N.gonorrhoeae*:

```
                   10         20         30         40         50         60
orf98.pep  MTVTAAEGGKAAKALKKYLITGILVWLPIAVTVWVVSYIVSASDQLVNLLPKQWRPQYVL   60
           || |||||||||||||||||||||||||||||||||||||||||||||||||||||||||
orf98ng    MTEPAAEGGKAAKALKKYLITGILVWLPIAVTVWVVSYIVSASDQLVNLLPKQWRPQYVL   60 orf98.pep  GFNIPGLGVIVAIAVLFVTGLFAANVLGRQILAAWDSLLGRIPVVKSIYSSVKKVSEYVL  120
           ||||||||||||||||||||||||||||||||||||||||| |||||||||||||||| :|
orf98ng    GFNIPGLGVIVAIAVLFVTGLFAANVLGRQILAAWDSLLXRIPVVKSIYSSVKKVSESLL  120 orf98.pep  SDSSRSFKTPVLVPFPQPGIWTIAFVSGQVSNAVKAALPXDGDYLSVYVPTTPNPTGGYY  180
           |||||||||||||||||| ||||||||||||||||||| |||||||||||||||||||||
orf98ng    SDSSRSFKTPVLVPFPQSGIWTIAFVSGQVSNAVKAALPQDGDYLSVYVPTTPNPTGGYY  180 orf98.pep  IMVKKSDVRELDMSVDEXLKYVISLGMVIPDDLPVKTLAXPMPSEKADLPEQQ         233
           ||||||||||||||||| |||||||||||||||||||| ||| |||:|||||
orf98ng    IMVKKSDVRELDMSVDEALKYVISLGMVIPDDLPVKTLAGPMPPEKAELPEQQ         233
```

The complete length ORF98ng nucleotide sequence (SEQ ID NO: 745) is predicted to encode a protein having amino acid sequence (SEQ ID NO: 746):

```
  1 MTEPAAEGGK AAKALKKYLI TGILVWLPIA VTVWVVSYIV SASDQLVNLL

51 PKQWRPQYVL GFNIPGLGVI VAIAVLFVTG LFAANVLGRQ ILAAWDSLLX

101 RIPVVKSIYS SVKKVSESLL SDSSRSFKTP VLVPFPQSGI WTIAFVSGQV
```

-continued

```
151 SNAVKAALPQ DGDYLSVYVP TTPNPTGGYY IMVKKSDVRE LDMSVDEALK

201 YVISLGMVIP DDLPVKTLAG PMPPEKAELP EQQ*
```

Further work revealed the complete nucleotide sequence (SEQ ID NO: 747):

```
  1 ATGACGGAAC CTGCGGCCGA AGGCGGCAAA GCTGCCAAGG CGTTAAAAAA

51 ATATCTGATT ACAGGCATTT TGGTCTGGCT GCCGATTGCG GTAACGGTTT

101 GGGTGGTTTC CTATATCGTT TCCGCGTCCG ACCAGCTTGT CAACCTGCTG

151 CCGAAGCAAT GGCGGCCGCA ATATGTTTTG GGGTTTAATA TCCCCGGGCT

201 CGGCGTTATT GTTGCCATTG CCGTATTGTT TGTAACCGGA TTATTTGCCG

251 CAAACGTGTT GGGCCGGCAG ATTCTTGCCG CGTGGGACAG CCTGTTgggg 301 cggaTTCCGG TTGTCAAATC CATCTATTCG AGTGTGAAAA AAGTATCCGA

351 ATCGCTGCTG TCCGACAGCA GCCGTTCGTT TAAAACGCCG GTACTCGTGC

401 CGTTTCCCCA ATCGGGTATT TGGACAATCG CATTCGTGTC CGGTCAGGTG

451 TCGAATGCGG TTAAGGCCGC ATTGCCGCAG GATGGCGATT ATCTTTCCGT

501 GTATGTCCCG ACCACGCCCA ACCCGACCGG CGGTTACTAT ATTATGGTAA

551 AGAAAAGCGA TGTGCGCGAA CTCGATATGA GCGTGGACGA AGCGTTGAAA

601 TATGTGATTT CGCTGGGTAT GGTCATCCCT GACGACCTGC CCGTCAAAAC

651 ATTGGCAGGA CCTATGCCGC CTGAAAAGGC GGAGTTGCCC GAACAACAAT

701 AA
```

This corresponds to the amino acid sequence (SEQ ID NO: 748; ORF98ng-1):

```
  1 MTEPAAEGGK AAKALKKYLI TGILVWLPIA VTVWVVSYIV SASDQLVNLL

51 PKQWRPQYVL GFNIPGLGVI VAIAVLFVTG LFAANVLGRQ ILAAWDSLLG

101 RIPVVKSIYS SVKKVSESLL SDSSRSFKTP VLVPFPQSGI WTIAFVSGQV

151 SNAVKAALPQ DGDYLSVYVP TTPNPTGGYY IMVKKSDVRE LDMSVDEALK

201 YVISLGMVIP DDLPVKTLAG PMPPEKAELP EQQ*
```

ORF98ng-1 (SEQ ID NO: 748) and ORF98-1 (SEQ ID NO: 742) show 97.9% identity in 233 aa overlap:

```
                    10         20         30         40         50         60
orf98-1.pep MTEXAAEGGKAAKALKKYLITGILVWLPIAVTVWVVSYIVSASDQLVNLLPKQWRPQYVL
            ||| ||||||||||||||||||||||||||||||||||||||||||||||||||||||||
orf98ng-1   MTEPAAEGGKAAKALKKYLITGILVWLPIAVTVWVVSYIVSASDQLVNLLPKQWRPQYVL
                    10         20         30         40         50         60

70         80         90        100        110        120
orf98-1.pep GFNIPGLGVIVAIAVLFVTGLFAANVLGRQILAAWDSLLGRIPVVKSIYSSVKKVSESLL
            ||||||||||||||||||||||||||||||||||||||||||||||||||||||||||||
orf98ng-1   GFNIPGLGVIVAIAVLFVTGLFAANVLGRQILAAWDSLLGRIPVVKSIYSSVKKVSESLL
                    70         80         90        100        110        120

130        140        150        160        170        180
orf98-1.pep SDSSRSFKTPVLVPFPQPGIWTIAFVSGQVSNAVKAALPKDGDYLSVYVPTTPNPTGGYY
            |||||||||||||||||||| |||||||||||||||||||:|||||||||||||||||||
orf98ng-1   SDSSRSFKTPVLVPFPQSGIWTIAFVSGQVSNAVKAALPQDGDYLSVYVPTTPNPTGGYY
                   130        140        150        160        170        180
```

```
                  190       200       210       220       230
orf98-1.pep  IMVKKSDVRELDMSVDEALKYVISLGMVIPDDLPVKTLAGPMPSEKADLPEQQX
             |||||||||||||||||||||||||||||||||||||||||| |||:||||||
orf98ng-1    IMVKKSDVRELDMSVDEALKYVISLGMVIPDDLPVKTLAGPMPPEKAELPEQQX
                  190       200       210       220       230
```

Based on this analysis, including the fact that the putative transmembrane domains in the gonococcal protein are identical to the sequences in the meningococcal protein, it is predicted that the proteins from *N.meningitidis* and *N.gonorrhoeae*, and their epitopes, could be useful antigens for vaccines or diagnostics, or for raising antibodies.

Example 89

The following partial DNA sequence was identified in *N.meningitidis* (SEQ ID NO: 749):

```
   1  ATgAAAACGG TAGTCTGGAT TGTCGTCCTG TTTGCCGCCG CCGTCGGACT
  51  GGCGCTGGCT TCGGGCATTT ACACCGGCGA CGTGTATATC GTACTCGGAC
 101  AGACCATGCT CAGAATCAAC CTGCACGCCT TTGTGTTAGG TTCGCTGATT
 151  GCCGTCGTGG TGTGGTATTT CTTGTTTAAA TTCATTATCG GsGgTACTCA
 201  ATATCCCCGA AAAGATGCAG CGTTTCGGTT CGGCnCGTAA AGGCCkCAAG
 251  ssCGsGCTTG CCTTGAACAA GGCGGGTTTG GCGTATTTTG AAGGGCGTTT
 301  TGAAAAGGCG GAACTAGAAG CCTCACGCGT GTTGGTCAAC AAAGtAGGCC
 351  GaGAGACAAC CGGACTTTGG CATTGATGCT GrGCGCGCAC GCCGCCGGAC
 401  AGATGGAAAA CATCGAssTG CGCGACCGTT ATCTTGCGGA AATCGCCAAA
 451  CTGCCGGAAA AACAGCAGCT TTCCCGTTAT CTTTTGTTGG CGGAATCGGC
 501  GTTGAACCGG CGCGATTACG AAGCGGCGGA AGCCAATCTT CATGCGGCGG
 551  CGAAGATGAA TGCCAACCTT ACGCGCCTCG TGCGTCTGCA .ATTCGTTAC
 601  GCTTTCGACA GGGGCGACGC GTTGCAGGTT CTGGCAAAAA CCGAAAAACT
 651  TTCCAAGGCG GGCGCGTTGG GCAAATCGGA AATGGAACGG TATCAAAATT
 701  GGGCATATCC GTCGCCAGCT GGCGGATGCT GCCGATGCCG CCGCTTTGAA
 751  AACCTGCCTG AAGCGGATTC CCGACAGCCT CAAAAACGGG GAATTGAGCG
 801  TATCGGTTGC GGAGAAGTAC GAACGTTTGG GACTGTATGC CGATGCGGTC
 851  AAATGGGTCA AACAGCATTA TCCGCAsAAC CGCCGCCCCG AGCTTTTGGA
 901  AGCCTTTGTC GAAAGCGTGC GCTTTTTGGG CGAGCGCGAA CAGCAGAAAG
 951  CCATCGATTT TGCCGATGCT TGGCTGAAAG AACAGCCCGA TAACGCGCTT
1001  CTGCTGATGT ATCTCGGTCG GCTCGCCTTC GGCCGCAAAC TTTGGGGCAA
1051  GGCAAAAGGC TACCTTGAAG CGAGCATTGC ATTAAAGCCG AGTATTTCCG
1101  CGCGTTTGGT TCTAACAAAG GTTTTCGACG AAATCGGAGA ACCGCAGAAG
1151  GCGGAGGCGC AC...
```

This corresponds to the amino acid sequence (SEQ ID NO: 750; ORF100):

```
   1  MKTVVWIVVL FAAAVGLALA SGIYTGDVYI VLGQTMLRIN LHAFVLGSLI
  51  AVVVWYFLFK FIIGVLNIPE KMQRFGSARK GXKXXLALNK AGLAYFEGRF
 101  EKAELEASRV LVNKVGRDNR TLALMLXAHA AGQMENIXXR DRYLAEIAKL
 151  PEKQQLSRYL LLAESALNRR DYEAAEANLH AAAKMNANLT RLVRLXIRYA
```

```
                          -continued
201  FDRGDALQVL AKTEKLSKAG ALGKSEMERY QNWAYRRQLA DAADAAALKT

251  CLKRIPDSLK NGELSVSVAE KYERLGLYAD AVKWVKQHYP XNRRPELLRA

301  FVESVRFLGE REQQKAIDFA DAWLKEQPDN ALLLMYLGRL AFGRKLWGKA

351  KGYLEASIAL KPSISARLVL TKVFDEIGEP QKAEAH...
```

Further work revealed the complete nucleotide sequence (SEQ ID NO: 751):

```
   1  ATGAAAACGG TAGTCTGGAT TGTCGTCCTG TTTGCCGCCG CCGTCGGACT

51  GGCGCTGGCT TCGGGCATTT ACACCGGCGA CGTGTATATC GTACTCGGAC

101  AGACCATGCT CAGAATCAAC CTGCACGCCT TTGTGTTAGG TTCGCTGATT

151  GCCGTCGTGG TGTGGTATTT CTTGTTTAAA TTCATTATCG GCGTACTCAA

201  TATCCCCGAA AAGATGCAGC GTTTCGGTTC GGCGCGTAAA GGCCGCAAGG

251  CCGCGCTTGC CTTGAACAAG GCGGGTTTGG CGTATTTTGA AGGGCGTTTT

301  GAAAAGGCGG AACTAGAAGC CTCACGCGTG TTGGTCAACA AAGAGGCCGG

351  AGACAACCGG ACTTTGGCAT TGATGCTGGG CGCGCACGCC GCCGGACAGA

401  TGGAAAACAT CGAGCTGCGC GACCGTTATC TTGCGGAAAT CGCCAAACTG

451  CCGGAAAAAC AGCAGCTTTC CCGTTATCTT TTGTTGGCGG AATCGGCGTT

501  GAACCGGCGC GATTACGAAG CGGCGGAAGC CAATCTTCAT GCGGCGGCGA

551  AGATGAATGC CAACCTTACG CGCCTCGTGC GTCTGCAACT TCGTTACGCT

601  TTCGACAGGG GCGACGCGTT GCAGGTTCTG GCAAAAACCG AAAAACTTTC

651  CAAGGCGGGC GCGTTGGGCA AATCGGAAAT GGAACGGTAT CAAAATTGGG

701  CATACCGCCG CCAGCTGGCG GATGCTGCCG ATGCCGCCGC TTTGAAAACC

751  TGCCTGAAGC GGATTCCCGA CAGCCTCAAA AACGGGGAAT TGAGCGTATC

801  GGTTGCGGAA AAGTACGAAC GTTTGGGACT GTATGCCGAT GCGGTCAAAT

851  GGGTCAAACA GCATTATCCG CACAACCGCC GCCCCGAGCT TTTGGAAGCC

901  TTTGTCGAAA GCGTGCGCTT TTTGGGCGAG CGCGAACAGC AGAAAGCCAT

951  CGATTTTGCC GATGCTTGGC TGAAAGAACA GCCCGATAAC GCGCTTCTGC

1001  TGATGTATCT CGGTCGGCTC GCCTACGGCC GCAAACTTTG GGGCAAGGCA

1051  AAAGGCTACC TTGAAGCGAG CATTGCATTA AAGCCGAGTA TTTCCGCGCG

1101  TTTGGTTCTA GCAAAGGTTT TCGACGAAAT CGGAGAACCG CAGAAGGCGG

1151  AGGCGCAGCG CAACTTGGTT TTGGAAGCCG TCTCCGATGA CGAACGTCAC

1201  GCAGCGTTAG AGCAGCATAG CTGA
```

This corresponds to the amino acid sequence (SEQ ID NO: 752; ORF100-1):

```
   1  MKTVVWIVVL FAAAVGLALA SGIYTGDVYI VLGQTMLRIN LHAFVLGSLI

51  AVVVWYFLFK FIIGVLNIPE KMQRFGSARK GRKAALALNK AGLAYFEGRF

101  EKAELEASRV LVNKEAGDNR TLALMLGAHA AGQMENIELR DRYLAEIAKL

151  PEKQQLSRYL LLAESALNRR DYEAAEANLH AAAKMNANLT RLVRLQLRYA

201  FDRGDALQVL AKTEKLSKAG ALGKSEMERY QNWAYRRQLA DAADAAALKT
```

-continued

```
251  CLKRIPDSLK NGELSVSVAE KYERLGLYAD AVKWVKQHYP HNRRPELLEA

301  FVESVRFLGE REQQKAIDFA DAWLKEQPDN ALLLMYLGRL AYGRKLWGKA

351  KGYLEASIAL KPSISARLVL AKVFDEIGEP QKAEAQRNLV LEAVSDDERH

401  AALEQHS*
```

Computer analysis of this amino acid sequence gave the following results:
Homology with a Predicted ORF from *N.meningitidis* (Strain A)

ORF100 (SEQ ID NO: 750) shows 93.5% identity over a 386aa overlap with an ORF (ORF100a) (SEQ ID NO: 754) from strain A of *N. meningitidis*:

```
                     10         20         30         40         50         60
orf100.pep  MKTVVWIVVLFAAAVGLALASGIYTGDVYIVLGQTMLRINLHAFVLGSLIAVVVWYFLFK
            ||||||||||||| ||||||||| ||||||||||||||||||||||||||||||||||||
orf100a     MKTVVWIVVLFAAAXGLALASGIXTGDVYIVLGQTMLRINLHAFVLGSLIAVVVWYFLFK
                     10         20         30         40         50         60

70         80         90        100        110        120
orf100.pep  FIIGVLNIPEKMQRFGSARKGXKXXLALNKAGLAYFEGRFEKAELEASRVLVNKVGRDNR
            ||||||| |||||||||||||| |  |||||||||||||||||||||||| || : |||
orf100a     FIIGVLNXPEKMQRFGSARKGRKAALALNKAGLAYFEGRFEKAELEASRVLGNKEAGDNR
                     70         80         90        100        110        120

130        140        150        160        170        180
orf100.pep  TLALMLXAHAAGQMENIXXRDRYLAEIAKLPEKQQLSRYLLLAESALNRRDYEAAEANLH
            |||||| ||||||||||  |||||||||||||||||||||||||||||||||||||||||
orf100a     TLALMLGAHAAGQMENIELRDRYLAEIAKLPEKQQLSRYLLLAESALNRRDYEAAEANLH
                    130        140        150        160        170        180

190        200        210        220        230        240
orf100.pep  AAAKMNANLTRLVRLXIRYAFDRGDALQVLAKTEKLSKAGALGKSEMERYQNWAYRRQLA
            |||||||||||||||:|||||||||||||||||| |||||| ||||||||||||||||
orf100a     AAAKMNANLTRLVRLQLRYAFDRGDALQVLAKTEKXSKAGAXGKSEMERYQNWAYRRQLX
                    190        200        210        220        230        240

250        260        270        280        290        300
orf100.pep  DAADAAALKTCLKRIPDSLKNGELSVSVAEKYERLGLYADAVKWVKQHYPXNRRPELLEA
            |||||||||||||||||||||||||||||||||||||||||||||||||| ||||||||
orf100a     DAADAAALKTCLKRIPDSLKNGELSVSVAEKYERLGLYADAVKWVKQHYPHNRRPELLEA
                    250        260        270        280        290        300

310        320        330        340        350        360
orf100.pep  FVESVRFLGEREQQKAIDFADAWLKEQPDNALLLMYLGRLAFGRKLWGKAKGYLEASIAL
            |||||||||||:||||||||||||||||||||| :|||||| ||||||||||||||||||
orf100a     FVESVRFLGERDQQKAIDFADAWLKEQPDNALLLXYLGRLAYGRKLWGKAKGYLEASIAL
                    310        320        330        340        350        360

370        380
orf100.pep  KPSISARLVLTKVFDEIGEPQKAEAH
            |||||||||:||||  |||||||:
orf100a     KPSISARLVLAKVFDETGEPQKAEAQRNLVLASVAEENRPSAETHX
                    370        380        390        400
```

The complete length ORF100a nucleotide sequence (SEQ ID NO: 753) is:

```
  1  ATGAAAACGG TAGTCTGGAT TGTCGTCCTG TTTGCCGCCG CNNTCGGGCT

51  GGCATTGGCG TCGGGCATTN ACACCGGCGA CGTGTATATC GTACTCGGAC

101  AGACCATGCT CAGAATCAAC CTGCACGCCT TTGTGTTAGG TTCGCTGATT

151  GCCGTCGTGG TGTGGTATTT CCTGTTCAAA TTCATCATCG GCGTACTCAA

201  TANCCCCGAA AAGATGCAGC GTTTCGGTTC GGCGCGTAAA GGCCGCAAGG

251  CCGCGCTTGC TTTGAACAAG GCGGGTTTGG CGTATTTTGA AGGGCGTTTT

301  GAAAAGGCGG AACTTGAAGC CTCGCGCGTA TTGGGAAACA AAGAGGCGGG
```

```
351   GGATAACCGG ACTTTGGCAT TGATGTTGGG CGCACATGCC GCCGGGCAGA
401   TGGAAAACAT CGAGCTGCGC GACCGTTATC TTGCGGAAAT CGCCAAACTG
451   CCGGAAAAGC AGCAGCTTTC CCGTTATCTT TTGTTGGCGG AATCGGCGTT
501   GAACCGGCGC GATTACGAAG CGGCGGAAGC CAATCTTCAT GCGGCGGCGA
551   AGATGAATGC CAACCTTACG CGCCTCGTGC GTCTGCAACT TCGTTACGCT
601   TTCGACAGGG GCGACGCGTT GCAGGTTCTG GCAAAAACCG AAAAANTTTC
651   CAAGGCGGGC GCGTNGGGCA AATCGGAAAT GGAACGGTAT CAAAATTGGG
701   CATACCGCCG CCAGCTGNCG GATGCTGCCG ATGCCGCCGC TTTGAAAACC
751   TGCCTGAAGC GGATTCCCGA CAGCCTCAAA ACGGGGAAT TGAGCGTATC
801   GGTTGCGGAA AAGTACGAAC GTTTGGGACT GTATGCCGAT GCGGTCAAAT
851   GGGTCAAACA GCATTATCCG CACAACCGCC GACCCGAACT TTTGGAAGCN
901   TTTGTCGAAA GCGTGCGCTT TTTGGGCGAA CGCGATCAGC AGAAAGCCAT
951   CGATTTTGCC GATGCTTGGC TGAAAGAACA GCCCGATAAT GCGCTTCTGC
1001  TGANGTATCT CGGTCGGCTC GCCTACGGCC GCAAACTTTG GGGCAAGGCA
1051  AAAGGCTACC TTGAAGCGAG CATTGCATTA AAGCCGAGTA TTTCCGCGCG
1101  TTTGGTTCTG GCAAAGGTTT TTGACGAAAC CGGAGAACCG CAGAAGGCGG
1151  AGGCGCAGCG CAACTTGGTT TTGGCAAGCG TTGCCGAGGA AAACCGNCCT
1201  TCCGCCGAAA CCCATTGA
```

This encodes a protein having amino acid sequence (SEQ ID NO: 754):

```
  1   MKTVVWIVVL FAAAXGLALA SGIXTGDVYI VLGQTMLRIN LHAFVLGSLI
 51   AVVVWYFLFK FIIGVLNXPE KMQRFGSARK GRKAALALNK AGLAYFEGRF
101   EKAELEASRV LGNKEAGDNR TLALMLGAHA AGQMENIELR DRYLAEIAKL
151   PEKQQLSRYL LLAESALNRR DYEAAEANLH AAAKMNANLT RLVRLQLRYA
201   FDRGDALQVL AKTEKXSKAG AXGKSEMERY QNWAYRRQLX DAADAAALKT
251   CLKRIPDSLK NGELSVSVAE KYERLGLYAD AVKWVKQHYP HNRRPELLEA
301   FVESVRFLGE RDQQKAIDFA DAWLKEQPDN ALLLXYLGRL AYGRKLWGKA
351   KGYLEASIAL KPSISARLVL AKVFDETGEP QKAEAQRNLV LASVAEENRP
401   SAETH*
```

ORF100a (SEQ ID NO: 754) and ORF100-1 (SEQ ID NO: 752) show 95.1% identity in 406 aa overlap:

```
                    10         20         30         40         50         60
orf100a.pep MKTVVWIVVLFAAAXGLALASGIXTGDVYIVLGQTMLRINLHAFVLGSLIAVVVWYFLFK
            |||||||||||||   ||||||||  ||||||||||||||||||||||||||||||||||
orf100-1    MKTVVWIVVLFAAAVGLALASGIYTGDVYIVLGQTMLRINLHAFVLGSLIAVVVWYFLEK
                    10         20         30         40         50         60

70         80         90        100        110        120
orf100a.pep FIIGVLNXPEKMQRFGSARKGRKAALALNKAGLAYFEGRFEKAELEASRVLGNKEAGDNR
            |||||||  |||||||||||||||||||||||||||||||||||||||||||  ||||||
orf100-1    FIIGVLNIPEKMQRFGSARKGRKAALALNKAGLAYFEGRFEKAELEASRVLVNKEAGDNR
                    70         80         90        100        110        120
```

```
                     130       140       150       160       170       180
orf100a.pep  TLALMLGAHAAGQMENIELRDRYLAEIAKLPEKQQLSRYLLLAESALNRRDYEAAEANLH
             ||||||||||||||||||||||||||||||||||||||||||||||||||||||||||||
orf100-1     TLALMLGAHAAGQMENIELRDRYLAEIAKLPEKQQLSRYLLLAESALNRRDYEAAEANLH
                     130       140       150       160       170       180

190       200       210       220       230       240
orf100a.pep  AAAKMNANLTRLVRLQLRYAFDRGDALQVLAKTEKXSKAGAXGKSEMERYQNWAYRRQLX
             |||||||||||||||||||||||||||||||||||| |||||:|||||||||||||||| 
orf100-1     AAAKMNANLTRLVRLQLRYAFDRGDALQVLAKTEKLSKAGALGKSEMERYQNWAYRRQLA
                     190       200       210       220       230       240

250       260       270       280       290       300
orf100a.pep  DAADAAALKTCLKRIPDSLKNGELSVSVAEKYERLGLYADAVKWVKQHYPHNRRPELLEA
             ||||||||||||||||||||||||||||||||||||||||||||||||||||||||||||
orf100-1     DAADAAALKTCLKRIPDSLKNGELSVSVAEKYERLGLYADAVKWVKQHYPHNRRPELLEA
                     250       260       270       280       290       300

310       320       330       340       350       360
orf100a.pep  FVESVRFLGERDQQKAIDFADAWLKEQPDNALLLXYLGRLAYGRKLWGKAKGYLEASIAL
             ||||||||||:|||||||||||||||||||||||  ||||||||||||||||||||||||
orf100-1     FVESVRFLGEREQQKAIDFADAWLKEQPDNALLLMYLGRLAYGRKLWGKAKGYLEASIAL
                     310       320       330       340       350       360

370       380       390       400
orf100a.pep  KPSISARLVLAKVFDETGEPQKAEAQRNLVLASVAEENRPSA-ETHX
             |||||||||||||||| ||||||||||||||| :|::::| :|  | |
orf100-1     KPSISARLVLAKVFDEIGEPQKAEAQRNLVLEAVSDDERHAALEQHSX
                     370       380       390       400
```

Homology with a Predicted ORF from *N.gonorrhoeae*

ORF100 (SEQ ID NO: 750) shows 93.3% identity over a 386 aa overlap with a predicted ORF (ORF100ng) (SEQ ID NO: 756) from *N.gonorrhoeae*:

```
orf100.pep   MKTVVWIVVLFAAAVGLALASGIYTGDVYIVLGQTMLRINLHAFVLGSLIAVVVWYFLFK   60
             ||||||||||||||||||||||||||||||||||||||||||||||||||||||||||||
orf100ng     MKTVVWIVVLFAAAVGLALASGIYTGDVYIVLGQTMLRINLHAFVLGSLIAVVVWYFLFK   60 orf100.pep   FIIGVLNIPEKMQRFGSARKGXKXXLALNKAGLAYFEGRFEKAELEASRVLVNKVGRDNR  120
             ||||||||||:|:| ||||||  |   ||||||||||||||||||||||||| : |||
orf100ng     FIIGVLNIPENMRRSGSARKGRKAALALNKAGLAYFEGRFEKAELEASRVLGNKEAGDNR  120 orf100.pep   TLALMLXAHAAGQMENIXXRDRYLAEIAKLPEKQQLSRYLLLAESALNRRDYEAAEANLH  180
             ||||||  |||||||||  |||||||||||||||||||||||||||||||||||||||||
orf100ng     TLALMLGAHAAGQMENIELRDRYLAEIAKLPEKQQLSRYLLLAESALNRRDYEAAEANLH  180 orf100.pep   AAAKMNANLTRLVRLXIRYAFDRGDALQVLAKTEKLSKAGALGKSEMERYQNWAYRRQLA  240
             |||||||||||||||  :|||||||||||||||||||||||||||||||||||||||:|
orf100ng     AAAKMNANLTRLVRLQLRYAFDRGDALQVLAKTEKLSKAGALGKSEMERYQNWAYRRQMA  240 orf100.pep   DAADAAALKTCLKRIPDSLKNGELSVSVAEKYERLGLYADAVKWVKQHYPXNRRPELLEA  300
             |||||||||||||||||||||||||||||||||||||||||||||||||| |||||||||
orf100ng     DAADAAALKTCLKRIPDSLKNGELSVSVAEKYERLGLYADAVKWVKQHYPHNRRPELLEA  300 orf100.pep   FVESVRFLGEREQQKAIDFADAWLKEQPDNALLMYLGRLAFGRKLWGKAKGYLEASIAL   360
             |||||||||||||||||||||:|||||||||||||||||:||||||||||||||||||
orf100ng     FVESVRFLGEREQQKAIDFADSWLKEQPDNALLLMYLGRLAYGRKLWGKAKGYLEASIAL  360 orf100.pep   KPSISARLVLTKVFDEIGEPQKAEAH                                   386
             ||||  |||||:|||||  ::  |||||:
orf100ng     KPSIPARLVLAKVFDETAQSQKAEAQRNLVLASVAGENRPSAETR                405
```

The complete length ORF100ng nucleotide sequence (SEQ ID NO: 755) is:

```
  1   ATGAAAACGG TAGTCTGGAT TGTTGTCCTG TTTGCCGCCG CCGTCGGACT

51   GGCGCTGGCT TCGGGCATTT ACACCGGCGA CGTGTATATC GTACTCGGAC

101   AGACCATGCT CAGAATCAAC CTGCACGCCT TGTGTTAGG TTCGCTGATT
```

-continued

```
 151    GCCGTCGTGG TGTGGTATTT CCTGTTTAAA TTCATCATCG GCGTACTCAA
 201    TATCCCCGAA AATATGCGGC GTTCCGGTTC GGCGCGGAAA GGCCGCAAGG
 251    CCGCGCTTGC CTTGAATAAG GCGGGTTTGG CGTATTTCGA AGGGCGTTTT
 301    GAAAAGGCGG AACTCGAAGC CTCTCGAGTG TTGGGCAACA AAGAGGCCGG
 351    AGACAACCGG ACTTTGGCAT TGATGCTGGG CGCGCACGCG GCAGGACAGA
 401    TGGAAAATAT CGAGCTGCGC GACCGTTATC TTGCGGAAAT CGCCAAACTG
 451    CCGGAAAAAC AGCAGCTTTC CCGCTATCTT CTGCTGGCGG AATCGGCGTT
 501    AAACCGGCGC GATTACGAAG CGGCGGAAGC CAATCTTCAT GCGGCGGCGA
 551    AGATGAATGC CAACCTTACG CGCCTCGTGC GTCTGCAACT TCGTTACGCC
 601    TTCGATCGGG GCGATGCGTT GCAGGTTCTG GCAAAAaccG AAAAACTTTC
 651    CAAGGCGGGC GCGTTGGGCA AATCGGAAAT GGAACGGTAT CAAAATTGGG
 701    CATACCGCCG CCAGATGGCG GATGCTGCCG ATGCCGCCGC TTTGAAAACC
 751    TGCCTGAAGC GGATTCCCGA CAGCCTCAAA AACGGGGAAT TGagcGTATC
 801    GGTTGCGGAA AAGTACGAAC GTTTGGGACT GTATGCCGAT GCGGTCAAAT
 851    GGGTCAAACA GCATTATCCG CACAACCGCC GCCCCGAGCT TTTGGAAGCC
 901    TTTGTCGAAA GCGTGCGCTT TTTGGGCGAG CGCGAACAGC AGAAAGCCAT
 951    CGATTTTGCC GATTCTTGGC TGAAAGAACA GCCCGATAAC GCGCTTCTGC
1001    TGATGTATCT CGGCCGGCTC GCCTACGCC GCAAACTTTG GGGTAAGGCA
1051    AAAGGCTACC TTGAAGCGAG TATTGCACTG AAGCCGAGTA TTCCGGCGCG
1101    TTTGGTGTTG GCAAAGGTTT TTGACGAAAC CGCACAGTCG CAAAAAGCCG
1151    AAGCACAGCG CAACTTGGTT TTGGCAAGCG TTGCCGGGGA AAACCGCCCT
1201    TCCGCCGAAA CCCGTTGA
```

This encodes a protein having amino acid sequence (SEQ ID NO: 756):

```
  1    MKTVVWIVVL FAAAVGLALA SGIYTGDVYI VLGQTMLRIN LHAFVLGSLI
 51    AVVVWYFLFK FIIGVLNIPE NMRRSGSARK GRKAALALNK AGLAYFEGRF
101    EKAELEASRV LGNKEAGDNR TLALMLGAHA AGQMENIELR DRYLAEIAKL
151    PEKQQLSRYL LAESALNRR DYEAAEANLH AAAKMNANLT RLVRLQLRYA
201    FDRGDALQVL AKTEKLSKAG ALGKSEMERY QNWAYRRQMA DAADAAALKT
251    CLKRIPDSLK NGELSVSVAE KYERLGLYAD AVKWVKQHYP HNRRPELLEA
301    FVESVRFLGE REQQKAIDFA DSWLKEQPDN ALLLMYLGRL AYGRKLWGKA
351    KGYLEASIAL KPSIPARLVL AKVFDETAQS QKAEAQRNLV LASVAGENRP
401    SAETR*
```

ORF100ng (SEQ ID NO: 756) and ORF100-1 (SEQ ID NO: 752) show 95.3% identity in 402 aa overlap:

```
                     10         20         30         40         50         60
orf100-1.pep  MKTVVWIVVLFAAAVGLALASGIYTGDVYIVLGQTMLRINLHAFVLGSLIAVVVWYFLFK
              ||||||||||||||||||||||||||||||||||||||||||||||||||||||||||||
orf100ng      MKTVVWIVVLFAAAVGLALASGIYTGDVYIVLGQTMLRINLHAFVLGSLIAVVVWYFLFK
                     10         20         30         40         50         60
```

-continued

```
                    70        80        90        100       110       120
orf100-1.pep  FIIGVLNIPEKMQRFGSARKGRKAALALNKAGLAYFEGRFEKAELEASRVLVNKEAGDNR
              ||||||||||:|:| |||||||||||||||||||||||||||||||||||| ||||||||
orf100ng      FIIGVLNIPENMRRSGSARKGRKAALALNKAGLAYFEGRFEKAELEASRVLGNKEAGDNR
                    70        80        90        100       110       120

130       140       150       160       170       180
orf100-1.pep  TLALMLGAHAAGQMENIELRDRYLAEIAKLPEKQQLSRYLLLAESALNRRDYEAAEANLH
              ||||||||||||||||||||||||||||||||||||||||||||||||||||||||||||
orf100ng      TLALMLGAHAAGQMENIELRDRYLAEIAKLPEKQQLSRYLLLAESALNRRDYEAAEANLH
                    130       140       150       160       170       180

190       200       210       220       230       240
orf100-1.pep  AAAKMNANLTRLVRLQLRYAFDRGDALQVLAKTEKLSKAGALGKSEMERYQNWAYRRQLA
              ||||||||||||||||||||||||||||||||||||||||||||||||||||||||||:|
orf100ng      AAAKMNANLTRLVRLQLRYAFDRGDALQVLAKTEKLSKAGALGKSEMERYQNWAYRRQMA
                    190       200       210       220       230       240

250       260       270       280       290       300
orf100-1.pep  DAADAAALKTCLKRIPDSLKNGELSVSVAEKYERLGLYADAVKWVKQHYPHNRRPELLEA
              ||||||||||||||||||||||||||||||||||||||||||||||||||||||||||||
orf100ng      DAADAAALKTCLKRIPDSLKNGELSVSVAEKYERLGLYADAVKWVKQHYPHNRRPELLEA
                    250       260       270       280       290       300

310       320       330       340       350       360
orf100-1.pep  FVESVRFLGEREQQKAIDFADAWLKEQPDNALLLMYLGRLAYGRKLWGKAKGYLEASIAL
              ||||||||||||||||||||:|||||||||||||||||||||||||||||||||||||||
orf100ng      FVESVRFLGEREQQKAIDFADSWLKEQPDNALLLMYLGRLAYGRKLWGKAKGYLEASIAL
                    310       320       330       340       350       360

370       380       390       400
orf100-1.pep  KPSISARLVLAKVFDEIGEPQKAEAQRNLVLEAVSDDERHAALEQHSX
              |||| ||||||||||| :: |||||||||| :|: ::| :|
orf100n      KPSIPARLVLAKVFDETAQSQKAEAQRNLVLASVAGENRPSAETRX
                    370       380       390       400
```

Based on this analysis, including the presence of a putative leader sequence, a putative transmembrane domain, and a RGD motif, it is predicted that the proteins from *N.meningitidis* and *N.gonorrhoeae*, and their epitopes, could be useful antigens for vaccines or diagnostics, or for raising antibodies.

Example 90

The following DNA sequence, believed to be complete, was identified in *N.meningitidis* (SEQ ID NO: 757)

```
  1 ATGATGTTTT CTTGGTTCAA GCTGTTTCAC TTGTTTTTTG TCATTTCGTG
 51 GTTTGCAGGG CTGTTTTACC TGCCGAGGAT TTTCGTCAAT ATGGCGATGA
101 TTGATGTGCC GCGCGGCAAT CCCGAGTATG TGCGTCTGTC GGGCATGGCG
151 GTGCGGCTGT ACCGTTTTAT GTCGCCGTTG GGCTTCGGCG CGGTCGTGTT
201 CGGCGCGGCG ATACCGTTTG CCGCCGGCTG GTGGGGCAGC GGCTGGGTAC
251 ACGTCAAACT GTGTTTGGGC TTGATGCTCT TGGCTTACCA GTTGTATTGC
301 GGCGTGCTGC TGCGCCGTTT TCAGGATTAC AGCAATGCTT TTTCACACCG
351 CTGGTACCGC GTGTTCAACG AAATCCCCGT GCTGCTGATG GTTGCCGCGC
401 TGTATSTGGT CGTGTTCAAA CCGTTTTGA
```

This corresponds to the amino acid sequence (SEQ ID NO: 758; ORF102):

```
  1 MMFSWFKLFH LFFVISWFAG LFYLPRIFVN MAMIDVPRGN PEYVRLSGMA
 51 VRLYRFMSPL GFGAVVFGAA IPFAAGWWGS GWVHVKLCLG LMLLAYQLYC
101 GVLLRRFQDY SNAFSHRWYR VFNEIPVLLM VAALYXVVFK PF*
```

Further work revealed the complete nucleotide sequence (SEQ ID NO: 759):

```
  1 ATGATGTTTT CTTGGTTCAA GCTGTTTCAC TTGTTTTTTG TCATTTCGTG

51 GTTTGCAGGG CTGTTTTACC TGCCGAGGAT TTTCGTCAAT ATGGCGATGA

101 TTGATGTGCC GCGCGCAAAT CCCGAGTATG TGCGTCTGTC GGGCATGGCG

151 GTGCGGCTGT ACCGTTTTAT GTCGCCGTTG GGCTTCGGCG CGGTCGTGTT

201 CGGCGCGGCG ATACCGTTTG CCGCCGGCTG GTGGGGCAGC GGCTGGGTAC

251 ACGTCAAACT GTGTTTGGGC TTGATGCTCT TGGCTTACCA GTTGTATTGC

301 GGCGTGCTGC TGCGCCGTTT TCAGGATTAC AGCAATGCTT TTTCACACCG

351 CTGGTACCGC GTGTTCAACG AAATCCCCGT GCTGCTGATG GTTGCCGCGC

401 TGTATCTGGT CGTGTTCAAA CCGTTTTGA
```

This corresponds to the amino acid sequence (SEQ ID NO: 760; ORF102-1):

```
  1 MMFSWFKLFH LFFVISWFAG LFYLPRIFVN MAMIDVPRGN PEYVRLSGMA

51 VRLYRFMSPL GFGAVVFGAA IPFAAGWWGS GWVHVKLCLG LMLLAYQLYC

101 GVLLRRFQDY SNAFSHRWYR VFNEIPVLLM VAALYLVVFK PF*
```

Computer analysis of this amino acid sequence gave the following results:
Homology with HP1484 Hypothetical Integral Membrane Protein of *H. pylori* (Accession Number AE000647) (SEQ ID NO: 1160)
ORF102 (SEQ ID NO: 758) and HP1484 (SEQ ID NO: 1160) show 33% aa identity in 143aa overlap:

```
orf102    3 FSWFKLFHLFFVISWFAGLFYLPRIFVNMAMIDVPRGNPEYVRLSGMAVRLYRFMSPLGF  62
            F W K FH+  VISW A LFYLPR+FV  A      +    V++     +LY F++
HP1484    8 FLWVKAFHVIAVISWMAALFYLPRLFVYHAENAHKKEFVGVVQIQEK--KLYSFIASPAM  65 orf102   63 GAVVFGAAIPFAAG---WWGSGWVHVKLCLGLMLLAYQLYCGVLLRRFQDYSNAFSHRWY 119
            G   +    +      +   GW+H KL L ++LLAY  YC  +R  +     + R+Y
HP1484   66 GFTLITGILMLLIEPTLFKSGGWLHAKLALVVLLLAYHFYCKKCMRELEKDPTRRNARFY 125 orf102  120 RVFNEIPXXXXXXXXXXXXFKPF                                      142
            RVFNE P            KPF
HP1484  126 RVFNEAPTILMILIVILVVVKPF                                      148
```

Homology with a Predicted ORF from *N.meningitidis* (Strain A)
ORF102 (SEQ ID NO: 758) shows 99.3% identity over a 142aa overlap with an ORF (ORF102a)
(SEQ ID NO: 2) from strain A of *N. meningitidis*:

```
                    10        20        30        40        50        60
orf102.pep  MMFSWFKLFHLFFVISWFAGLFYLPRIFVNMAMIDVPRGNPEYVRLSGMAVRLYRFMSPL
            ||||||||||||||||||||||||||||||||||||||||||||||||||||||||||||
orf102a     MMFSWFKLFHLFFVISWFAGLFYLPRIFVNMAMIDVPRGNPEYVRLSGMAVRLYRFMSPL
                    10        20        30        40        50        60

70        80        90       100       110       120
orf102.pep  GFGAVVFGAAIPFAAGWWGSGWVHVKLCLGLMLLAYQLYCGVLLRRFQDYSNAFSHRWYR
            ||||||||||||||||||||||||||||||||||||||||||||||||||||||||||||
orf102a     GFGAVVFGAAIPFAAGWWGSGWVHVKLCLGLMLLAYQLYCGVLLRRFQDYSNAFSHRWYR
                    70        80        90       100       110       120
```

```
                   130        140
orf102.pep  VFNEIPVLLMVAALYXVVFKPFX
            |||||||||||||||| |||||||
orf102a     VFNEIPVLLMVAALYLVVFKPFX
                   130        140
```

The complete length ORF102a nucleotide sequence (SEQ ID NO: 761) is:

```
  1  ATGATGTTTT CTTGGTTCAA GCTGTTTCAC TTGTTTTTTG TCATTTCGTG
 51  GTTTGCAGGG CTGTTTTACC TGCCGAGGAT TTTCGTCAAT ATGGCGATGA
101  TTGATGTGCC GCGCGGCAAT CCCGAGTATG TGCGTCTGTC GGGCATGGCG
151  GTGCGGCTGT ACCGTTTTAT GTCGCCGTTG GGCTTCGGCG CGGTCGTGTT
201  CGGCGCGGCG ATACCGTTTG CCGCCGGCTG GTGGGGCAGC GGCTGGGTAC
251  ACGTCAAACT GTGTTTGGGC TTGATGCTCT TGGCTTACCA GTTGTATTGC
301  GGCGTGCTGC TGCGCCGTTT TCAGGATTAC AGCAATGCTT TTTCACACCG
351  CTGGTACCGC GTGTTCAACG AAATCCCCGT GCTGCTGATG GTTGCCGCGC
401  TGTATCTGGT CGTGTTCAAA CCGTTTTGA
```

This encodes a protein having amino acid sequence (SEQ ID NO: 762):

```
  1  MMFSWFKLFH LFFVISWFAG LFYLPRIFVN MAMIDVPRGN PEYVRLSGMA
 51  VRLYRFMSPL GFGAVVFGAA IPFAAGWWGS GWVHVKLCLG LMLLAYQLYC
101  GVLLRRFQDY SNAFSHRWYR VFNEIPVLLM VAALYLVVFK PF*
```

ORF102a (SEQ ID NO: 762) and ORF102-1 (SEQ ID NO: 760) show complete identity in 142 aa overlap:

```
                    10         20         30         40         50         60
orf102a.pep  MMFSWFKLFHLFFVISWFAGLFYLPRIFVNMAMIDVPRGNPEYVRLSGMAVRLYRFMSPL
             ||||||||||||||||||||||||||||||||||||||||||||||||||||||||||||
orf102-1     MMFSWFKLFHLFFVISWFAGLFYLPRIFVNMAMIDVPRGNPEYVRLSGMAVRLYRFMSPL
                    10         20         30         40         50         60

70         80         90        100        110        120
orf102a.pep  GFGAVVFGAAIPFAAGWWGSGWVHVKLCLGLMLLAYQLYCGVLLRRFQDYSNAFSHRWYR
             ||||||||||||||||||||||||||||||||||||||||||||||||||||||||||||
orf102-1     GFGAVVFGAAIPFAAGWWGSGWVHVKLCLGLMLLAYQLYCGVLLRRFQDYSNAFSHRWYR
                    70         80         90        100        110        120

130        140
orf102a.pep  VFNEIPVLLMVAALYLVVFKPFX
             |||||||||||||||||||||||
orf102-1     VFNEIPVLLMVAALYLVVFKPFX
                   130        140
```

Homology with a Predicted ORF from *N.gonorrhoeae*

ORF102 (SEQ ID NO: 758) shows 97.9% identity over a 142 aa overlap with a predicted ORF (ORF102ng) (SEQ ID NO: 764) from *N. gonorrhoeae*:

```
orf102.pep  MMFSWFKLFHLFFVISWFAGLFYLPRIFVNMAMIDVPRGNPEYVRLSGMAVRLYRFMSPL   60
            ||||||||||||||||||||||||||||||||||||:|||||||||||||||||||||||
orf102ng    MMFSWFKLFHLFFVISWFAGLFYLPRIFVNMAMIDAPRGNPEYVRLSGMAVRLYRFMSPL   60
```

```
                       -continued
orf102.pep  GFGAVVFGAAIPFAAGWWGSGWVHVKLCLGLMLLAYQLYCGVLLRRFQDYSNAFSHRWYR  120
            |||||||||||||| |||||||||||||||||||||||||||||||||||||||||||
orf102ng    GFGAVVFGAAIPFAAGRWGSGWVHVKLCLGLMLLAYQLYCGVLLRRFQDYSNAFSHRWYR  120 orf102.pep  VFNEIPVLLMVAALYXVVFKPF                                       142
            ||||||||||||||| ||||||
orf102ng    VFNEIPVLLMVAALYLVVFKPF                                       142
```

The complete length ORF102ng nucleotide sequence (SEQ ID NO: 763) is:

```
  1  ATGATGTTTT CTTGGTTCAA GCTGTTTCAC TTGTTTTTTG TCATTTCGTG

51  GTTTGCAGGG CTGTTTTACC TGCCGAGGAT TTTCGTCAAT ATGGCGATGA

101  TTGATGCGCC GCGCGGCAAT CCCGAGTATG TGCGCCTGTC GGGGATGGCG

151  GTGCGGTTGT ACCGTTTTAT GTCGCCTTTG GGTTTCGGCG CGGTCGTGTT

201  CGGCGCGGCG ATACCGTTTG CCGCcggccg GTGGGGCagc ggctggGTTC

251  ACGTCAAACT GTGTTTGGGC TTGATGCTCT TGGCTTATCA GTTGTATTGC

301  GGCGTGCTGC TGCGCCGTTT TCAGGATTAC AGCAATGCTT TTTCACACCG

351  CTGGTACCGC GTGTTCAAcg aAATCCCCGT GCTGCTGATG GTTGCCGCGC

401  TGTATCTGGT CGTGTTCAAA CCGTTTTGA
```

This encodes a protein having amino acid sequence (SEQ ID NO: 764):

```
  1  MMFSWFKLFH LFFVISWFAG LFYLPRIFVN MAMIDAPRGN PEYVRLSGMA

51  VRLYRFMSPL GFGAVVFGAA IPFAAGRWGS GWVHVKLCLG LMLLAYQLYC

101  GVLLRRFQDY SNAFSHRWYR VFNEIPVLLM VAALYLVVFKPF*
```

ORF102ng (SEQ ID NO: 764) and ORF102-1 (SEQ ID NO: 760) show 98.6% identity in 142 aa overlap:

```
                  10         20         30         40         50         60
orf102-1.pep  MMFSWFKLFHLFFVISWFAGLFYLPRIFVNMAMIDVPRGNPEYVRLSGMAVRLYRFMSPL
              |||||||||||||||||||||||||||||||||||:||||||||||||||||||||||||
orf102ng      MMFSWFKLFHLFFVISWFAGLFYLPRIFVNMAMIDAPRGNPEYVRLSGMAVRLYRFMSPL
                  10         20         30         40         50         60

70         80         90        100        110        120
orf102-1.pep  GFGAVVFGAAIPFAAGWWGSGWVHVKLCLGLMLLAYQLYCGVLLRRFQDYSNAFSHRWYR
              |||||||||||||||| |||||||||||||||||||||||||||||||||||||||||||
orf102ng      GFGAVVFGAAIPFAAGRWGSGWVHVKLCLGLMLLAYQLYCGVLLRRFQDYSNAFSHRWYR
                  70         80         90        100        110        120

130        140
orf102-1.pep  VFNEIPVLLMVAALYLVVFKPFX
              |||||||||||||||||||||||
orf102ng      VFNEIPVLLMVAALYLVVFKPFX
                 130        140
```

In addition, ORF102ng (SEQ ID NO: 764) shows significant homology to a membrane protein (SEQ ID NO: 1160) from *H.pylori*:

```
gi|2314656 (AE000647) conserved hypothetical integral membrane protein
[Helicobacter pylori] Length = 148
Score = 79.2 bits (192), Expect = 1e-14
Identities = 50/147 (34%), Positives = 68/147 (46%), Gaps = 13/147 (8%)

Query:   3  FSWFKLFHLFFVISWFAGLFYLPRIFVNMAMIDAPRGNPEYVRLSGMAVRLYRFMSPLGF   62
            F W K FH+  VISW A LFYLPR+FV  A       V++      +LY F++
Sbjct:   8  FLWVKAFHVIAVISWMAALFYLPRLFVYHAENAHKKEFVGVVQIQEK--KLYSFIASPAM  65

Query:  63  GAVVFGAAIP-------FAAGRWGSGWVHVKLCLGLMLLAYQLYCGVLLRRFQDYSNAFS  115
            G  +   +         F +G   GW+H KL L ++LLAY  YC    +R  +     +
Sbjct:  66  GFTLITGILMLLIEPTLFKSG----GWLHAKLALVVLLLAQHFYCKKCMRELEKDPTRRN  121

Query: 116  HRWYRVFNEIPXXXXXXXXXXXXXFKPF                                  142
             R+YRVFNE P             KPF
Sbjct: 122  ARFYRVFNEAPTILMILIVILVVVKPF                                   148
```

Based on this analysis, it is predicted that these proteins from *N.meningitidis* and *N.gonorrhoeae*, and their epitopes, could be useful antigens for vaccines or diagnostics, or for raising antibodies.

Example 91

The following partial DNA sequence was identified in *N.meningitidis* (SEQ ID NO: 765):

```
  1  ATGGCAAAAA TGATGAAATG GGCGGCTGTT GCGGCGGTCG CGGCGGCAGC
 51  GGTTTGGGGC GGATGGTCTT AACTGAAGCC CGAGCCGCAC GTGCTTGATA
101  TTACGGAAAC GGTCAGGCGC GGC // .....
//.. ATTTCGTTTA CGATTTTGTC CGAACCGGAT ACGCCGATTA AGGCGAAGCT
 51  CGACAGCGTC GACCCCGGGC TGACCACGAT GTCGTCGGGC GGTTACAACA
101  GCAGTACGGA TACGGCTTCC AATGCGGTCT ACTATTATGC CCGTTCGTTT
151  GTGCCGAATC CGGACGGCAA ACTCGCCACG GGGATGACGA CGCAGAATAC
201  GGTTGAAATC GACGGCGTGA AAAATGTGCT GATTATTCCG TCGCTGACCG
251  TGAAAAATCG CGGCGGCAAG GCGTTTGTGC GCGTGTTGGG TGCGGACGGC
301  AAGGCGGCGG AACGCGAAAT CCGGACCGGT ATGAGAGACA GTATGAATAC
351  CGAAGTAAAA AGCGGGTTGA AGAGGGGGA CAAAGTGGTC ATCTCCGAAA
401  TAACCGCCGC CGAGCAACAG GAAAGCGGCG AACGCGCCCT AGGCGGCCCG
451  CCGCGCCGAT AA
```

This corresponds to the amino acid sequence (SEQ ID NO: 766; ORF85):

```
  1  MAKMMKWAAV AAVAAAAVWG GWS.LKPEPH VLDITETVVR G.........
 51  .......... .......... .......... .......... ..........
101  .......... .......... .......... .......... ..........
151  .......... .......... .......... .......... ..........
201  .......... .......... .......... .........I SFTILSEPDT
251  PIKAKLDSVD PGLTTMSSGG YNSSTDTASN AVYYYARSFV PNPDGKLATG
301  MTTQNTVEID GVKNVLIIPS LTVKNRGGKA FVRVLGADGK AAEREIRTGM
351  RDSMNTEVKS GLKEGDKVVI SEITAAEQQE SGERALGGPP RR*
```

Further work revealed the further partial nucleotide sequence (SEQ ID NO: 767):

```
   1    ..GTATCGGTCG GCGCGCAGGC ATCGGGGCAG ATTAAGATAC TTTATGTCAA
  51      ACTCGGGCAA CAGGTTAAAA AGGGCGATTT GATTGCGGAA ATCAATTCGA
 101      CCTCGCAGAC CAATACGCTC AATACGGAAA AATCCAAGTT GGAAACGTAT
 151      CAGGCGAAGC TGGTGTCGGC ACAGATTGCA TTGGGCAGCG CGGAGAAGAA
 201      ATATAAGCGT CAGGCGGCGT TATGGAAGGA AAACGCGACT TCCAAAGAGG
 251      ATTTGGAAAG CGCGCAGGAT GCGTTTGCCG CCGCCAAAGC CAATGTTGCC
 301      GAGCTGAAGG CTTTAATCAG ACAGAGCAAA ATTTCCATCA ATACCGCCGA
 351      GTCGGAATTG GGCTACACGC GCATTACCGC AACGATGGAC GGCACGGTGG
 401      TGGCGATTCT CGTGGAAGAG GGGCAGACTG TGAACGCGGC GCAGTCTACG
 451      CCGACGATTG TCCAATTGGC GAATCTGGAT ATGATGTTGA ACAAAATGCA
 501      GATTGCCGAG GGCGATATTA CCAAGGTGAA GGCGGGGCAG GATATTTCGT
 551      TTACGATTTT GTCCGAACCG GATACGCCGA TTAAGGCGAA GCTCGACAGC
 601      GTCGACCCCG GGCTGACCAC GATGTCGTCG GGCGGTTACA ACAGCAGTAC
 651      GGATACGGCT TCCAATGCGG TCTACTATTA TGCCCGTTCG TTTGTGCCGA
 701      ATCCGGACGG CAAACTCGCC ACGGGGATGA CGACGCAGAA TACGGTTGAA
 751      ATCGACGGCG TGAAAAATGT GCTGATTATT CCGTCGCTGA CCGTGAAAAA
 801      TCGCGGCGGC AAGGCGTTTG TGCGCGTGTT GGGTGCGGAC GGCAAGGCGG
 851      CGGAACGCGA AATCCGGACC GGTATGAGAG ACAGTATGAA TACCGAAGTA
 901      AAAAGCGGGT TGAAAGAGGG GGACAAAGTG GTCATCTCCG AAATAACCGC
 951      CGCCGAGCAA CAGGAAAGCG GCGAACGCGC CCTAGGCGGC CCGCCGCGCC
1001      GATAA
```

This corresponds to the amino acid sequence (SEQ ID NO: 768; ORF85-1):

```
  1    ..VSVGAQASGQ IKILYVKLGQ QVKKGDLIAE INSTQTNTL NTEKSKLETY
 51      QAKLVSAQIA LGSAEKKYKR QAALWKENAT SKEDLESAQD AFAAAKANVA
101      ELKALIRQSK ISINTAESEL GYTRITATMD GTVVAILVEE GQTVNAAQST
151      PTIVQLANLD MMLNKMQIAE GDITKVKAGQ DISFTILSEP DTPIKAKLDS
201      VDPGLTTMSS GGYNSSTDTA SNAVYYYARS FVPNPDGKLA TGMTTQNTVE
251      IDGVKNVLII PSLTVKNRGG KAFVRVLGAD GKAAEREIRT GMRDSMNTEV
301      KSGLKEGDKV VISEITAAEQ QESGERALGG PPRR*
```

Computer analysis of this amino acid sequence gave the following results:
Homology with a Predicted ORF from *N.meningitidis* (Strain A)

ORF85 (SEQ ID NO: 766) shows 87.8% identity over a 41aa overlap and 99.3% identity over a 153aa overlap with an ORF (ORF85a) (SEQ ID NO: 770) from strain A of *N. meningitidis*:

```
                        10         20         30         40
orf85.pep    MAKMMKWAAVAAVAAAAVWGGWS-LKPEPHVLDITETVRRG
             ||||||||||||||||||||||| ||||::  ||||||||
orf85a       MAKMMKWAAVAAVAAAAVWGGWSYLKPEPQAAYITETVRRGDISRTVSATGEISPSNLVS
                        10         20         30         40         50         60
```
//

```
                                          -continued
                                    80         90        100
orf85.pep  ........................ISFTILSEPDTPIKAKLDSVDPGLTTMSSG
                                   ||||||||||||||||||||||||||||||
orf85a     TIVQLANLDMMLNKMQIAEGDITKVKAGQDISFTILSEPDTPIKAKLDSVDPGLTTMSSG
           210       220       230       240       250       260

110       120       130       140       150       160
orf85.pep  GYNSSTDTASNAVYYYARSFVPNPDGKLATGMTTQNTVEIDGVKNVLIIPSLTVKNRGGK
           ||||||||||||||||||||||||||||||||||||||||||||||||||||||||||:
orf85a     GYNSSTDTASNAVYYYARSFVPNPDGKLATGMTTQNTVEIDGVKNVLIIPSLTVKNRGGR
           270       280       290       300       310       320

170       180       190       200       210       220
orf85.pep  AFVRVLGADGKAAEREIRTGMRDSMNTEVKSGLKEGDKVVISEITAAEQQESGERALGGP
           ||||||||||||||||||||||||||||||||||||||||||||||||||||||||||||
orf85a     AFVRVLGADGKAAEREIRTGMRDSMNTEVKSGLKEGDKVVISEITAAEQQESGERALGGP
           330       340       350       360       370       380

230
orf85.pep  PRRX
           ||||
orf85a     PRRX
           390
```

The complete length ORF85a nucleotide sequence (SEQ ID NO: 769) is:

```
   1  ATGGCAAAAA TGATGAAATG GCGGCTGTT GCGGCGGTCG CGGCGGCAGC

51  GGTTTGGGGC GGATGGTCTT ATCTGAAGCC CGAGCCGCAG GCTGCTTATA

101  TTACGGAAAC GGTCAGGCGC GGCGACATCA GCCGGACGGT TTCTGCAACA

151  GGGGAGATTT CGCCGTCCAA CCTGGTATCG GTCGGCGCGC AGGCATCGGG

201  GCAGATTAAG AAACTTTATG TCAAACTCGG CAACAGGTT AAAAAGGGCG

251  ATTTGATTGC GGAAATCAAT TCGACCTCGC AGACCAATAC GCTCAATACG

301  GAAAAATCCA AATTGGAAAC GTATCAGGCG AAGCTGGTGT CGGCACAGAT

351  TGCATTGGGC AGCGCGGAGA AGAAATATAA GCGTCAGGCG GCGTTGTGGA

401  AGGATGATGC GACCGCTAAA GAAGATTTGG AAAGCGCACA GGATGCGCTT

451  GCCGCCGCCA AAGCCAATGT TGCCGAGCTG AAGGCTCTAA TCAGACAGAG

501  CAAAATTTCC ATCAATACCG CCGAGTCGGA ATTGGGCTAC ACGCGCATTA

551  CCGCAACGAT GGACGGCACG GTGGTGGCGA TTCTCGTGGA AGAGGGGCAG

601  ACTGTGAACG CGGCGCAGTC TACGCCGACG ATTGTCCAAT TGGCGAATCT

651  GGATATGATG TTGAACAAAA TGCAGATTGC CGAGGGCGAT ATTACCAAGG

701  TGAAGGCGGG GCAGGATATT TCGTTTACGA TTTTGTCCGA ACCGGATACG

751  CCGATTAAGG CGAAGCTCGA CAGCGTCGAC CCCGGGCTGA CCACGATGTC

801  GTCGGGCGGC TACAACAGCA GTACGGATAC GGCTTCCAAT GCGGTCTACT

851  ATTATGCCCG TTCGTTTGTG CCGAATCCGG ACGGCAAACT CGCCACGGGG

901  ATGACGACGC AGAATACGGT TGAAATCGAC GGTGTGAAAA ATGTGCTGAT

951  TATTCCGTCG CTGACCGTGA AAAATCGCGG CGGCAGGGCG TTTGTGCGCG

1001  TGTTGGGTGC AGACGGCAAG GCGGCGGAAC GCGAAATCCG GACCGGTATG

1051  AGAGACAGTA TGAATACCGA AGTAAAAAGC GGGTTGAAAG AGGGGACAA

1101  AGTGGTCATC TCCGAAATAA CCGCCGCCGA GCAGCAGGAA AGCGGCGAAC

1151  GCGCCCTAGG CGGCCCGCCG CGCCGATAA
```

This encodes a protein having amino acid sequence (SEQ ID NO: 770):

```
  1 MAKMMKWAAV AAVAAAAVWG GWSYLKPEPQ AAYITETVRR GDISRTVSAT
 51 GEISPSNLVS VGAQASGQIK KLYVKLGQQV KKGDLIAEIN STSQTNTLNT
101 EKSKLETYQA KLVSAQIALG SAEKKYKRQA ALWKDDATAK EDLESAQDAL
151 AAAKANVAEL KALIRQSKIS INTAESELGY TRITATMDGT VVAILVEEGQ
201 TVNAAQSTPT IVQLANLDMM LNKMQIAEGD ITKVKAGQDI SFTILSEPDT
251 PIKAKLDSVD PGLTTMSSGG YNSSTDTASN AVYYYARSFV PNPDGKLATG
301 MTTQNTVEID GVKNVLIIPS LTVKNRGGRA FVRVLGADGK AAEREIRTGM
351 RDSMNTEVKS GLKEGDKVVI SEITAAEQQE SGERALGGPP RR*
```

ORF85a (SEQ ID NO: 770) and ORF85-1 (SEQ ID NO: 768) show 98.2% identity in 334 aa overlap:

```
                    30        40        50        60        70        80
orf85a.pep  PQAAYITETVRRGDISRTVSATGEISPSNLVSVGAQASGQIKKLYVKLGQQVKKGDLIAE
                                 ||||||||||||| |||||||||||||||||||
orf85-1                          VSVGAQASGQIKILYVKLGQQVKKGDLIAE
                                             10        20        30

90       100       110       120       130       140
orf85a.pep  INSTSQTNTLNTEKSKLETYQAKLVSAQIALGSAEKKYKRQAALWKDDATAKEDLESAQD
            ||||||||||||||||||||||||||||||||||||||||||||::||:||||||||||
orf85-1     INSTSQTNTLNTEKSKLETYQAKLVSAQIALGSAEKKYKRQAALWKENATSKEDLESAQD
                    40        50        60        70        80        90

150       160       170       180       190       200
orf85a.pep  ALAAAKANVAELKALIRQSKISINTAESELGYTRITATMDGTVVAILVEEGQTVNAAQST
            |:||||||||||||||||||||||||||||||||||||||||||||||||||||||||||
orf85-1     AFAAAKANVAELKALIRQSKISINTAESELGYTRITATMDGTVVAILVEEGQTVNAAQST
                   100       110       120       130       140       150

210       220       230       240       250       260
orf85a.pep  PTIVQLANLDMMLNKMQIAEGDITKVKAGQDISFTILSEPDTPIKAKLDSVDPGLTTMSS
            ||||||||||||||||||||||||||||||||||||||||||||||||||||||||||||
orf85-1     PTIVQLANLDMMLNKMQIAEGDITKVKAGQDISFTILSEPDTPIKAKLDSVDPGLTTMSS
                   160       170       180       190       200       210

270       280       290       300       310       320
orf85a.pep  GGYNSSTDTASNAVYYYARSFVPNPDGKLATGMTTQNTVEIDGVKNVLIIPSLTVKNRGG
            ||||||||||||||||||||||||||||||||||||||||||||||||||||||||||||
orf85-1     GGYNSSTDTASNAVYYYARSFVPNPDGKLATGMTTQNTVEIDGVKNVLIIPSLTVKNRGG
                   220       230       240       250       260       270

330       340       350       360       370       380
orf85a.pep  RAFVRVLGADGKAAEREIRTGMRDSMNTEVKSGLKEGDKVVISEITAAEQQESGERALGG
            :|||||||||||||||||||||||||||||||||||||||||||||||||||||||||||
orf85-1     KAFVRVLGADGKAAEREIRTGMRDSMNTEVKSGLKEGDKVVISEITAAEQQESGERALGG
                   280       290       300       310       320       330

390
orf85a.pep  PPRRX
            |||||
orf85-1     PPRRX
```

Figure 19D:
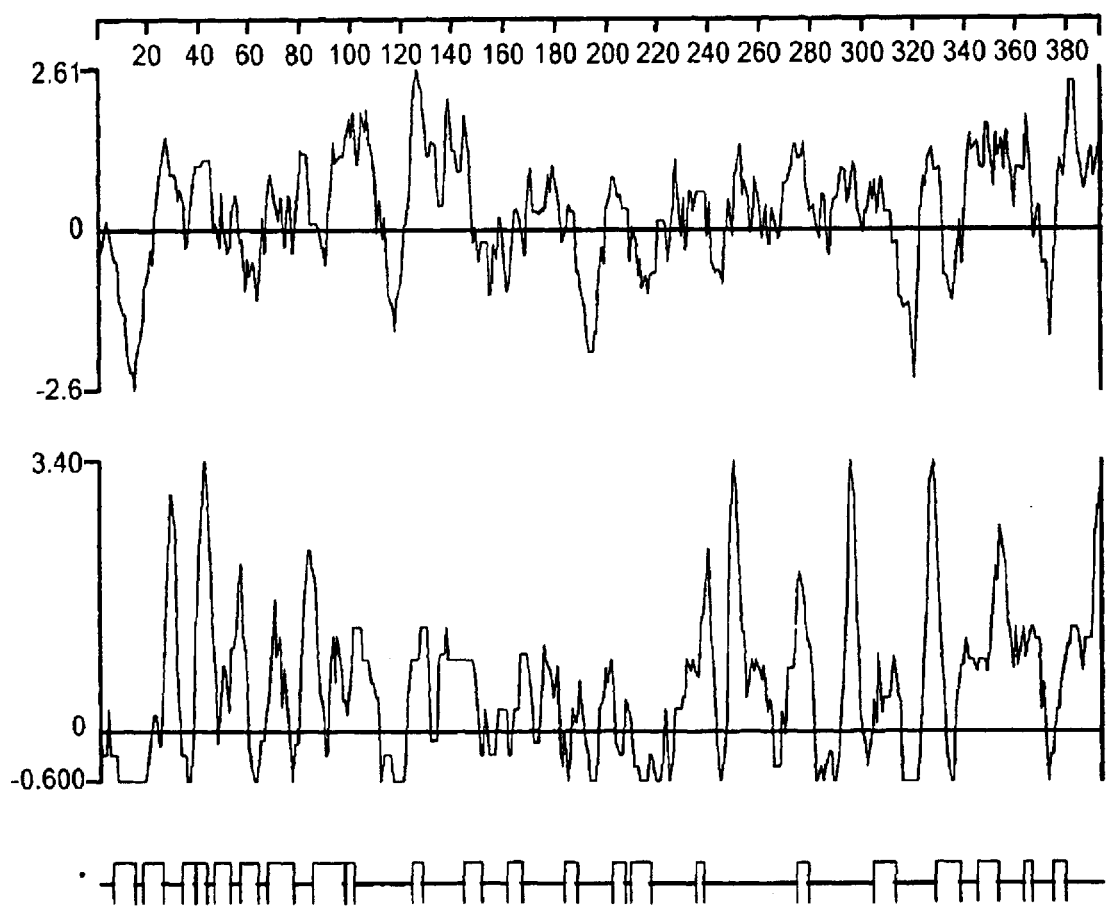

FIG. 19D shows plots of hydrophilicity, antigenic index, and AMPHI regions for ORF85a (SEQ ID NO: 770). Homology with a Predicted ORF from N.gonorrhoeae ORF85 (SEQ ID NO: 766) shows a high degree of identity with a Predicted ORF (ORF85ng) (SEQ ID NO: 772) from N. gonorrhoeae:

```
ORF85    1 MAKMMKWAAVAAVAAAAVWGGWS.LKPEPHVLDITETVRRG.........  40
           |||||||||||||||||||||| |||||::  |||:||||
ORF85ng  1 MAKMMKWAAVAAVAAAAVWGGWSYLKPEPQAAYITEAVRRGDISRTVSAT  50

ORF85    .........................................ISFTILSEPDT  250
                                                    |||||||||||
ORF85ng  201 TVNAAQSTPTIVQLANLDMMLNKMQIAEGDITKVKAGQDISFTILSEPDT  250
```

-continued

```
ORF85    251 PIKAKLDSVDPGLTTMSSGGYNSSTDTASNAVYYYARSFVPNPDGKLATG 300
             ||||||||||||||||||||||||||||||||||||||||||||||||||
ORF85ng  251 PIKAKLDSVDPGLTTMSSGGYNSSTDTASNAVYYYARSFVPNPDGKLATG 300

ORF85    301 MTTQNTVEIDGVKNVLIIPSLTVKNRGGKAFVRVLGADGKAAEREIRTGM 350
             |||||||||||||||:|||||||||||||||||||||||| |||||||||
ORF85ng  301 MTTQNTVEIDGVKNVLLIPSLTVKNRGGKAFVRVLGADGKAVEREIRTGM 350

ORF85    152 RDSMNTEVKSGLKEGDKVVISEITAAEQQESGERALGGPPRR 393
             :|||||||||||||||||||||||||||||||||||||||||
ORF85ng  351 KDSMNTEVKSGLKEGDKVVISEITAAEQQESGERALGGPPRR 393
```

The complete length ORF85ng nucleotide sequence (SEQ ID NO: 771) is:

```
   1    ATGGCAAAAA TGATGAAATG GGCGGCTGTT GCGGCGGTCG CGGCGGCaac
  51    GGTTTGGGGC GGATGGTCTT ATCTGAAGCC CGAACCGCAG GCTGCTTATA
 101    TTACGGAaac ggTCAGGCGC GGCGATATCA GCCGGACGGT TTCCGCGACG
 151    GgcgAGATTT CGCCGTCCAA CCTGGTATCG GTCGGCGCGC AGGCTTCGGG
 201    GCAGATTAAA AAGCTTTATG TCAAACTCGG CAACAGGTC AAAAAGGGCG
 251    ATTTGATTGC GGAAATCAAT TCGACCACGC AGACCAACAC GATCGATATG
 301    GAAAAATCCA AATTGGAAAC GTATCAGGCG AAGCTGGTGT CGGCACAGAT
 351    TGCATTGGGC AGCGCGGAGA AGAAATATAA GCGTCAGGCG GCGTTGTGGA
 401    AGGATGATGC GACCTCTAAA GAAGATTTGG AAAGCGCGCA GGATGCGCTT
 451    GCCGCCGCCA AAGCCAATGT TGCCGAGTTG AAGGCTTTAA TCAGACAGAG
 501    CAAAATTTCC ATCAATACCG CCGAGTCGGA TTTGGGCTAC ACGCGCATTA
 551    CCGCGACGAT GGACGGCACG GTGGTGGCGA TTCCCGTGGA AGAGGGGCAG
 601    ACTGTGAACG CGGCGCAGTC TACGCCGACG ATTGTCCAAT TGGCGAATCT
 651    GGATATGATG TTGAACAAAA TGCAGATTGC CGAGGGCGAT ATTACCAAGG
 701    TGAAGGCGGG GCAGGATATT TCGTTTACGA TTTTGTCCGA ACCGGATACG
 751    CCGATTAAGG CGAAGCTCGA CAGCGTCGAC CCCGGGCTGA CCACGATGTC
 801    GTCGGGCGGC TACAACAGCA GTACGGATAC GGCTTCCAAT GCGGTCTATT
 851    ATTATGCCCG TTCGTTTGTG CCGAATCCGG ACGGCAAACT CGCCACGGGG
 901    ATGACGACGC AGAATACGGT TGAAATCGAC GGTGTGAAAA ATGTGTTGCT
 951    TATTCCGTCG CTGACCGTGA AAAATCGCGG CGGCAAGGCG TTCGTACGCG
1001    TGTTGGGTGC GGACGGCAAG GCAGTGGAAC GCGAAATCCG GACCGGTATG
1051    AAAGACAGTA TGAATACCGA AGTGAAAAGC GGGTTGAAAG AGGGGGACAA
1101    AGTGGTCATC TCCGAAATAA CCGCCGCCGA GCAGCAGGAA AGCGGCGAAC
1151    GCGCCCTAGG CGGCCCGCCG CGCCGATAA
```

This encodes a protein having amino acid sequence (SEQ ID NO: 772):

```
  1    MAKMMKWAAV AAVAAAAVWG GWSYLKPEPQ AAYITEAVRR GDISRTVSAT
 51    GEISPSNLVS VGAQASGQIK KLYVKLGQQV KKGDLIAEIN STTQTNTIDM
101    EKSKLETYQA KLVSAQIALG SAEKKYKRQA ALWKDDATSK EDLESAQDAL
```

-continued

```
151 AAAKANVAEL KALIRQSKIS INTAESDLGY TRITATMDGT VVAIPVEEGQ

201 TVNAAQSTPT IVQLANLDMM LNKMQIAEGD ITKVKAGQDI SFTILSEPDT

251 PIKAKLDSVD PGLTTMSSGG YNSSTDTASN AVYYYARSFV PNPDGKLATG

301 MTTQNTVEID GVKNVLLIPS LTVKNRGGKA FVRVLGADGK AVEREIRTGM

351 KDSMNTEVKS GLKEGDKVVI SEITAAEQQE SGERALGGPP RR*
```

ORF85ng (SEQ ID NO: 772) and ORF85-1 (SEQ ID NO: 768) show 96.1% identity in 334 aa overlap:

```
                30        40        50        60        70        80
orf85ng    PQAAYITETVRRGDISRTVSATGEISPSNLVSVGAQASGQIKKLYVKLGQQVKKGDLIAE
                                        ||||||||||| ||||||||||||||||||
orf85-1                             VSVGAQASGQIKILYVKLGQQVKKGDLIAE
                                            10        20        30

90       100       110       120       130       140
orf85ng    INSTTQTNTIDMEKSKLETYQAKLVSAQIALGSAEKKYKRQAALWKDDATSKEDLESAQD
           ||||:||||:: ||||||||||||||||||||||||||||||||::||||||||||||
orf85-1    INSTSQTNTLNTEKSKLETYQAKLVSAQIALGSAEKKYKRQAALWKENATSKEDLESAQD
                40        50        60        70        80        90

150       160       170       180       190       200
orf85ng    ALAAAKANVAELKALIRQSKISINTAESDLGYTRITATMDGTVVAIPVEEGQTVNAAQST
           |:||||||||||||||||||||||||||||:||||||||||||||| ||||||||||||
orf85-1    AFAAAKANVAELKALIRQSKISINTAESELGYTRITATMDGTVVAILVEEGQTVNAAQST
                100       110       120       130       140       150

210       220       230       240       250       260
orf85ng    PTIVQLANLDMMLNKMQIAEGDITKVKAGQDISFTILSEPDTPIKAKLDSVDPGLTTMSS
           ||||||||||||||||||||||||||||||||||||||||||||||||||||||||||||
orf85-1    PTIVQLANLDMMLNKMQIAEGDITKVKAGQDISFTILSEPDTPIKAKLDSVDPGLTTMSS
                160       170       180       190       200       210

270       280       290       300       310       320
orf85ng    GGYNSSTDTASNAVYYYARSFVPNPDGKLATGMTTQNTVEIDGVKNVLLIPSLTVKNRGG
           ||||||||||||||||||||||||||||||||||||||||||||||||:|||||||||||
orf85-1    GGYNSSTDTASNAVYYYARSFVPNPDGKLATGMTTQNTVEIDGVKNVLIIPSLTVKNRGG
                220       230       240       250       260       270

330       340       350       360       370       380
orf85ng    KAFVRVLGADGKAVEREIRTGMKDSMNTEVKSGLKEGDKVVISEITAAEQQESGERALGG
           ||||||||||||:||||||||:||||||||||||||||||||||||||||||||||||||
orf85-1    KAFVRVLGADGKAAEREIRTGMRDSMNTEVKSGLKEGDKVVISEITAAEQQESGERALGG
                280       290       300       310       320       330

390
orf85ng    PPRRX
           |||||
orf85-1    PPRRX
```

In addition, ORF85ng (SEQ ID NO: 772) shows significant homology to an *E.coli* membrane fusion protein (SEQ ID NO: 1161):
gi|1787104 (AE000189) o380; 27% identical (27 gaps) to 332 residues from membrane fusion protein precursor, MTRC_NEIGO SW: P43505 (412 aa) [*Escherichia coli*] Length=380 Score=193 bits (485), Expect=2e-48 Identities= 120/345 (34%), Positives=182/345 (51%), Gaps=13/345 (3%)

```
Query:  29 PQAAYITETVRRGDISRTVSATGEISPSNLVSVGAQASGQIKKLYVKLGQQVKKGDLIAE   88
            P   Y T  VR GD+ ++V ATG++     V VGAQ SGQ+K L V +G +VKK  L+
Sbjct:  41 PVPTYQTLIVRPGDLQQSVLATGKLDALRKVDVGAQVSGQLKTLSVAIGDKVKKDQLLGV  100

Query:  89 INSTTQTNTIDMEKSKLETYQAKLVSAQIALGSAEKKYKRQAALWKDDATSKEXXXXXXX  148
            I+     N I  ++ L  +A+    A+ L A   Y RQ  L + A S++
Sbjct: 101 IDPEQAENQIKEVEATLMELRAQRQQAEAELKLARVTYSRQQRLAQTKAVSQQDLDTAAT  160
```

```
                             -continued
Query: 149 XXXXXXXXXXXXXXXXIRQSKISINTAESDLGYTRITATMDGTVVAIPVEEGQTVNAAQST 208
                           I++++  S++TA+++L YTRI A M G V  I    +GQTV AAQ
Sbjct: 161 EMAVKQAQIGTIDAQIKRNQASLDTAKTNLDYTRIVAPMAGEVTQITTLQGQTVIAAQQA 220

Query: 209 PTIVQLANLDMMLNKMQIAEGDITKVKAGQDISFTILSEPDTPIKAKLDSVDPGLTTMSS 268
           P I+ LA++    ML K Q++E D+  +K GQ    FT+L +P T  + ++  V P
Sbjct: 221 PNILTLADMSAMLVKAQVSEADVIHLKPGQKAWFTVLGDPLTRYEGQIKDVLP------- 273

Query: 269 GGYNSSTDTASNAVYYYARSFVPNPDGKLATGMTTQNTVEIDGVKNVLLIPSLTVKNRGG 328
            + +    ++A++YYAR  VPNP+G L    MT Q  +++  VKNVL IP   + +  G
Sbjct: 274 -----TPEKVNDAIFYYARFEVPNPNGLLRLDMTAQVHIQLTDVKNVLTIPLSALGDPVG 328

Query: 329 KAFVRV-LGADGKAVEREIRTGMKDSMNTEVKSGLKEGDKVVISE                372
            +V L  +G+   ERE+  G ++   + E+  GL+ GD+VVI E
Sbjct: 329 DNRYKVKLLRNGETREREVTIGARNDTDVEIVKGLEAGDEVVIGE                373
```
15

Based on this analysis, it was predicted that the proteins from N.meningitidis and N.gonorrhoeae, and their epitopes, could be useful antigens for vaccines or diagnostics, or for raising antibodies.

ORF85-1 (SEQ ID NO: 768) (40.4 kDa) was cloned in the pGex vectors and expressed in E.coli, as described above. The products of protein expression and purification were analyzed by SDS-PAGE. FIG. 19A shows the results of affinity purification of the GST-fusion protein. Purified GST-fusion protein was used to immunise mice, whose sera were used for Western blot (FIG. 19B), FACS analysis (FIG. 19C), and ELISA (positive result). These experiments confirm that ORF85-1 (SEQ ID NO: 768) is a surface-exposed protein, and that it is a useful immunogen.

Example 92

The following partial DNA sequence was identified in N.meningitidis (SEQ ID NO: 773):

```
  1 ..ATTCCCGCCA CGATGACATT TGAACGCAGC GGCAATGCTT ACAAAATCGT
 51   TTCGACGATT AAAGTGCCGC TATACAATAT CCGTTTCGAG TCCGGCGGTA
101   CGGTTGTCGG CAATACCCTG CACCCTACCT ACTATAGAGA CATACGCAGG
151   GGCAAACTGT ATGCGGAAgc CAAATTCGCC GACgGcAGCG TAACTTACGG
201   CAAAGCGGGC GAGAGCAAAA CCGAGCAAAG CCCCAAGGCT ATGGATTTGT
251   TCACGCTTGC CTGGCAGTTG GCGGCAAATG ACGCGAAACT CCCCCCGGGG
300   CTGAAAATCA CCAACGGCAA AAAACTTTAT TCCGTCGGCG GTTTGAATAA
351   GGCGGGTACA GGAAAATACA GCATAGGCGG CGTGGAAACC GAAGTCGTCA
401   AATATCGGGT GCGGCGCGGC GACGATGCGG TAATGTATTT cTTCGCACCG
451   TCCCTGAACA ATATTCCGGC ACAAATCGGC TATACCGACG ACGGCAAAAC
501   CTATACGCTG AAACTCAAAT CGGTGCAGAT CAACGGCCAG GCAGCCAAAC
551   CGTAA
```

This corresponds to the amino acid sequence (SEQ ID NO: 774; ORF120):

```
  1 ..IPATMTFERS GNAYKIVSTI KVPLYNIRFE SGGTVVGNTL HPTYYRDIRR
 51   GKLYAEAKFA DGSVTYGKAG ESKTEQSPKA MDLFTLAWQL AANDAKLPPG
101   LKITNGKKLY SVGGLNKAGT GKYSIGGVET EVVKYRVRRG DDAVMYFFAP
151   SLNNIPAQIG YTDDGKTYTL KLKSVQINGQ AAKP*
```

Further work revealed the complete nucleotide sequence (SEQ ID NO: 775):

```
  1 ATGATGAAGA CTTTTAAAAA TATATTTTCC GCCGCCATTT TGTCCGCCGC
 51 CCTGCCGTGC GCGTATGCGG CAGGGCTGCC CCAATCCGCC GTGCTGCACT
101 ATTCCGGCAG CTACGGCATT CCCGCCACGA TGACATTTGA ACGCAGCGGC
```

-continued

```
151 AATGCTTACA AAATCGTTTC GACGATTAAA GTGCCGCTAT ACAATATCCG

201 TTTCGAGTCC GGCGGTACGG TTGTCGGCAA TACCCTGCAC CCTACCTACT

251 ATAGAGACAT ACGCAGGGGC AAACTGTATG CGGAAGCCAA ATTCGCCGAC

301 GGCAGCGTAA CTTACGGCAA AGCGGGCGAG AGCAAAACCG AGCAAAGCCC

351 CAAGGCTATG GATTTGTTCA CGCTTGCCTG GCAGTTGGCG GCAAATGACG

401 CGAAACTCCC CCCGGGGCTG AAAATCACCA ACGGCAAAAA ACTTTATTCC

451 GTCGGCGGTT TGAATAAGGC GGGTACAGGA AAATACAGCA TAGGCGGCGT

501 GGAAACCGAA GTCGTCAAAT ATCGGGTGCG GCGCGGCGAC GATGCGGTAA

551 TGTATTTCTT CGCACCGTCC CTGAACAATA TTCCGGCACA AATCGGCTAT

601 ACCGACGACG GCAAAACCTA TACGCTGAAA CTCAAATCGG TGCAGATCAA

651 CGGCCAGGCA GCCAAACCGT AA
```

This corresponds to the amino acid sequence (SEQ ID NO: 776; ORF120-1):

```
  1 MMKTFKNIFS AAILSAALPC AYAAGLPQSA VLHYSGSYGI PATMTFERSG

51 NAYKIVSTIK VPLYNIRFES GGTVVGNTLH PTYYRDIRRG KLYAEAKFAD

101 GSVTYGKAGE SKTEQSPKAM DLFTLAWQLA ANDAKLPPGL KITNGKKLYS

151 VGGLNKAGTG KYSIGGVETE VVKYRVRRGD DAVMYFFAPS LNNIPAQIGY

201 TDDGKTYTLK LKSVQINGQA AKP*
```

Computer analysis of this amino acid sequence gave the following results:
Homology with a Predicted ORF from *N.meningitidis* (Strain A)

ORF120 (SEQ ID NO: 774) shows 92.4% identity over a 184aa overlap with an ORF (ORF120a) (SEQ ID NO: 778) from strain A of *N. meningitidis*:

```
                              10        20        30
orf120.pep                    IPATMTFERSGNAYKIVSTIKVPLYNIRFE
                              |||| :     || ||||||||||||||||
orf120a   SAAILSAALPCAYAAGLPXSAVLHYSGSYGIPATXXXXXXXNAXKIVSTIKVPLYNIRFE
          10        20        30        40        50        60

40        50        60        70        80        90
orf120.pep          SGGTVVGNTLHPTYYRDIRRGKLYAEAKFADGSVTYGKAGESKTEQSPKAMDLFTLAWQL
                    ||||||||||||||||||||||||||||||||||||||||  : ||||||||||||||||
orf120a             SGGTVVGNTLHPTYYRDIRRGKLYAEAKFADGSVTYGKAXXXXXXXQSPKAMDLPTLAWQL
                    70        80        90        100       110       120

100       110       120       130       140       150
orf120pep           AANDAKLPPGLKITNGKKLYSVGGLNKAGTGKYSIGGVETEVVKYRVRRGDDAVMYFFAP
                    ||||||||||||||||||||||||||||||||||||||||||||||||||||||||||||
orf120a             AANDAKLPPGLKITNGKKLYSVGGLNKAGTGKYSIGGVETEVVKYRVRRGDDAVMYFFAP
                    130       140       150       160       170       180

160       170       180
orf120pep           SLNNIPAQIGYTDDGKTYTLKLKSVQINGQAAKPX
                    |||||||||||||||||||||||||||||||||||
orf120a             SLNNIPAQIGYTDDGKTYTLKLKSVQINGQAAKPX
                    190       200       210       220
```

The complete length ORF120a nucleotide sequence (SEQ ID NO: 777) is:

```
  1 ATGATGAAGA CTTTTAAAAA TATATTTTCC GCCGCCATTT TGTCCGCCGC

51 CCTGCCGTGC GCGTATGCGG CAGGGCTGCC CNAATCCGCC GTGCTGCACT

101 ATTCCGGCAG CTACGGCATT CCCGCCACNA NNANNTNNGN ACNNNGNGNC

151 AATGCTTNCA AAATCGTTTC GACGATTAAA GTGCCGCTAT ACAATATCCG

201 TTTCGAGTCC GGCGGTACGG TTGTCGGCAA TACCCTGCAC CCTACCTACT

251 ATAGAGACAT ACGCAGGGGC AAACTGTATG CGGAAGCCAA ATTCGCCGAC

301 GGCAGCGTAA CCTACGGCAA AGCGGNNNNN ANCNNNNNNG NGCAAAGCCC

351 CAAGGCTATG GATTTGTTCA CGCTTGCNTG GCAGTTGGCG GCAAATGACG

401 CGAAACTCCC CCCGGGGCTG AAAATCACCA ACGGCAAAAA ACTTTATTCC

451 GTCGGCGGTT TGAATAAGGC GGGTACAGGA AAATACAGCA TAGGCGGCGT

501 GGAAACCGAA GTCGTCAAAT ATCGGGTGCG GCGCGGCGAC GATGCGGTAA

551 TGTATTTCTT CGCACCGTCC CTGAACAATA TTCCGGCACA AATCGGCTAT

601 ACCGACGACG GCAAAACCTA TACGCTGAAA CTCAAATCGG TGCAGATCAA

651 CGGCCAGGCA GCCAAACCGT AA
```

This encodes a protein having amino acid sequence (SEQ ID NO: 778):

```
  1 MMKTFKNIFS AAILSAALPC AYAAGLPXSA VLHYSGSYGI PATXXXXXXX

51 NAXKIVSTIK VPLYNIRFES GGTVVGNTLH PTYYRDIRRG KLYAEAKFAD

101 GSVTYGKAKX XXXXQSPKAM DLFTLAWQLA ANDAKLPPGL KITNGKKLYS

151 VGGLNKAGTG KYSIGGVETE VVKYRVRRGD DAVMYFFAPS LNNIPAQIGY

201 TDDGKTYTLK LKSVQINGQA AKP*
```

ORF120a (SEQ ID NO: 778) and ORF120-1 (SEQ ID NO: 776).show 93.3% identity in 223 aa overlap:

```
                    10         20         30         40         50         60
orf120a.pep MMKTFKNIFSAAILSAALPCAYAAGLPXSAVLHYSGSYGIPATXXXXXXXXNAXKIVSTIK
            ||||||||||||||||||||||||||| |||||||||||||||  :     || |||||||
orf120-1    MMKTFKNIFSAAILSAALPCAYAAGLPQSAVLHYSGSYGIPATMTFERSGNAYKIVSTIK
                    10         20         30         40         50         60

70         80         90        100        110        120
orf120a.pep VPLYNIRFESGGTVVGNTLHPTYYRDIRRGKLYAEAKFADGSVTYGKAXXXXXXXQSPKAM
            |||||||||||||||||||||||||||||||||||||||||||||||||  :  |||||
orf1201     VPLYNIRFESGGTVVGNTLHPTYYRDIRRGKLYAEAKFADGSVTYGKAGESKTEQSPKAM
                    70         80         90        100        110        120

130        140        150        160        170        180
orf120a.pep DLFTLAWQLAANDAKLPPGLKITNGKKLYSVGGLNKAGTGKYSIGGVETEVVKYRVRRGD
            ||||||||||||||||||||||||||||||||||||||||||||||||||||||||||
orf120-1    DLFTLAWQLAANDAKLPPGLKITNGKKLYSVGGLNKAGTGKYSIGGVETEVVKYRVRRGD
                   130        140        150        160        170        180

190        200        210        220
orf120a.pep DAVMYFFAPSLNNIPAQIGYTDDGKTYTLKLKSVQINGQAAKPX
            |||||||||||||||||||||||||||||||||||||||||||
orf120-1    DAVMYFFAPSLNNIPAQIGYTDDGKTYTLKLKSVQINGQAAKPX
                   190        200        210        220
```

Homology with a Predicted ORF from N.gonorrhoeae
ORF120 (SEQ ID NO: 774) shows 97.8% identity over
184 aa overlap with a Predicted ORF (ORF120ng) (SEQ ID
NO: 780) from N.gonorrhoeae:

```
orf120.pep                              IPATMTFERSGNAYKIVSTIKVPLYNIRFE    30
                                        ||||||||||||||||||||||||||||||
orf120ng     SAAILSAALPCAYAARLPQSAVLHYSGSYGIPATMTFERSGNAYKIVSTIKVPLYNIRFE    69 orf120.pep   SGGTVVGNTLHPTYYRDIRRGKLYAEAKFADGSVTYGKAGESKTEQSPKAMDLFTLAWQL    90
             ||||||||||||:||:||||||||||||||||||||||||||||||||||||||||||||
orf120ng     SGGTVVGNTLHPAYYKDIRRGKLYAEAKFADGSVTYGKAGESKTEQSPKAMDLFTLAWQL   129 orf120.pep   AANDAKLPPGLKITNGKKLYSVGGLNKAGTGKYSIGGVETEVVKYRVRRGDDAVMYFFAP   150
             ||||||||||||||||||||||||||||||||||||||||||||||||||||:| |||||
orf120ng     AANDAKLPPGLKITNGKKLYSVGGLNKAGTGKYSIGGVETEVVKYRVRRGDDTVTYFFAP   189 orf120.pep   SLNNIPAQIGYTDDGKTYTLKLKSVQINGQAAKP                             184
             ||||||||||||||||||||||||||||||||||
orf120ng     SLNNIPAQIGYTDDGKTYTLKLKSVQINGQAAKP                             223
```

The complete length ORF120ng nucleotide sequence
(SEQ ID NO: 779) is:

```
  1 ATGATGAAGA CTTTTAAAAA TATATTTTCC GCCGCCATTT TGTCCGCCGC

51 CCTGCCGTGC GCGTATGCGG CAAGGCTACC CCAATCCGCC GTGCTGCACT

101 ATTCCGGCAG CTACGGCATT CCCGCCACGA TGACATTTGA ACGCAGCGGC

151 AATGCTTACA AAATCGTTTC GACGATTAAA GTGCCGCTAT ACAATATCCG

201 TTTCGAATCC GGCGGTACGG TTGTCGGCAA TACCCTGCAC CCTGCCTACT

251 ATAAAGACAT ACGCAGGGGC AAACTGTATG CGGAAGCCAA ATTCGCCGAC

301 GGCAGCGTAA CCTACGGCAA AGCGGGCGAG AGCAAAACCG AGCAAAGCCC

351 CAAGGCTATG GATTTGTTCA CGCTTGCCTG GCAGTTGGCG GCAAATGACG

401 CGAAACTCCC CCCGGGTCTG AAAATCACCA ACGGCAAAAA ACTTTATTCC

451 GTCGGCGGCC TGAATAAGGC GGGTACGGGA AAATACAGCA TaggCGGCGT

501 GGAAACCGAA GTCGTCAAAT ATCGGGTGCG GCGCGGCGAC GATACGGTAA

551 CGTATTTCTT CGCACCGTCC CTGAACAATA TTCCGGCACA AATCGGCTAT

601 ACCGACGACG GCAAAACCTA TACGCTGAAG CTCAAATCGG TGCAGATCAA

651 CGGACAGGCC GCCAAACCGT AA
```

This encodes a protein having amino acid sequence (SEQ
ID NO: 780):

```
  1  MMKTFKNIFS AAILSAALPC AYAARLPQSA VLHYSGSYGI PATMTFERSG

51  NAYKIVSTIK VPLYNIRFES GGTVVGNTLH PAYYKDIRRG KLYAEAKFAD

101  GSVTYGKAGE SKTEQSPKAM DLFTLAWQLA ANDAKLPPGL KITNGKKLYS

151  VGGLNKAGTG KYSIGGVETE VVKYRVRRGD DTVTYFFAPS LNNIPAQIGY

201  TDDGKTYTLK LKSVQINGQA AKP*
```

In comparison with ORF120-1 (SEQ ID NO: 776), ORF120ng (SEQ ID NO: 780) shows 97.8% identity in 223 aa overlap:

```
                   10         20         30         40         50         60
orf120-1.pep  MMKTFKNIFSAAILSAALPCAYAAGLPQSAVLHYSGSYGIPATMTFERSGNAYKIVSTIK
              ||||||||||||||||||||||| ||||||||||||||||||||||||||||||||||||
orf120ng      MMKTFKNIFSAAILSAALPCAYAARLPQSAVLHYSGSYGIPATMTFERSGNAYKIVSTIK
                   10         20         30         40         50         60

70         80         90        100        110        120
orf120-1.pep  VPLYNIRFESGGTVVGNTLHPTYYRDIRRGKLYAEAKFADGSVTYGKAGESKTEQSPKAM
              |||||||||||||||||||||||:||:|||||||||||||||||||||||||||||||||
orf120ng      VPLYNIRFESGGTVVGNTLHPAYYKDIRRGKLYAEAKFADGSVTYGKAGESKTEQSPKAM
                   70         80         90        100        110        120

130        140        150        160        170        180
orf120-1.pep  DLFTLAWQLAANDAKLPPGLKITNGKKLYSVGGLNKAGTGKYSIGGVETEVVKYRVRRGD
              ||||||||||||||||||||||||||||||||||||||||||||||||||||||||||||
orf120ng      DLFTLAWQLAANDAKLPPGLKITNGKKLYSVGGLNKAGTGKYSIGGVETEVVKYRVRRGD
                  130        140        150        160        170        180

190        200        210        220
orf120-1.pep  DAVMYFFAPSLNNIPAQIGYTDDGKTYTLKLKSVQINGQAAKPX
              |:||||||||||||||||||||||||||||||||||||||||||
orf120ng      DTVTYFFAPSLNNIPAQIGYTDDGKTYTLKLKSVQINGQAAKPX
                  190        200        210        220
```

This analysis, including the presence of a putative leader sequence in the gonococcal protein suggests that the proteins from *N.meningitidis* and *N.gonorrhoeae*, and their epitopes, could be useful antigens for vaccines or diagnostics, or for raising antibodies.

Example 93

The following partial DNA sequence was identified in *N.meningitidis* (SEQ ID NO: 781):

```
  1  ATGTATCGGA GGAAAGGGCG GGGCATCAAG CCGTGGATGG GTGCCGGTGC
 51  .GCGTTTGCC GCCTTGGTCT GGCTGGTTTT CGCGCTCGGC GATACTTTGA
101  CTCCGTTTGC GGTTGCGGCG GTGCTGGCGT ATGTATTGGA CCCTTTGGTC
151  GAATGGTTGC AGAAAAAGGG TTTGAACCGT GCATCCGCTT CGATGTCTGT
201  GATGGTGTTT TCCTTGATTT TGTTGTTGGC ATTATTGTTG ATTATCGTCC
251  CTATGCTGGT CGGGCAGTTC AACAATTTGG CATCGCGCCT GCCCCAATTA
301  ATCGGTTTTA TGCAGAACAC GCTGCTGCCG TGGTTGAAAA ATACAATCGG
351  CGGATATGTG GAAATCGATC AGGCATCTAT TATTGCGTGG CTTCAGGCGC
401  ATACGGGAGA GTTGAGCAAC GCGCTTAAGG CGTGGTTTCC CGTTTTGATG
451  AGGCAGGGCG GCAATATT..
```

This corresponds to the amino acid sequence (SEQ ID NO: 782; ORF121):

```
  1  MYRRKGRGIK PWMGAGXAFA ALVWLVFALG DTLTPFAVAA VLAYVLDPLV
 51  EWLQKKGLNR ASASMSVMVF SLILLLALLL IIVPMLVGQF NNLASRLPQL
101  IGFMQNTLLP WLKNTIGGYV EIDQASIIAW LQAHTGELSN ALKAWFPVLM
151  RQGGNI..
```

Further work revealed the complete nucleotide sequence (SEQ ID NO: 783):

```
   1  ATGTATCGGA GGAAAGGGCG GGGCATCAAG CCGTGGATGG GTGCCGGTGC
  51  GGCGTTTGCC GCCTTGGTCT GGCTGGTTTT CGCGCTCGGC GATACTTTGA
 101  CTCCGTTTGC GGTTGCGGCG GTGCTGGCGT ATGTATTGGA CCCTTTGGTC
 151  GAATGGTTGC AGAAAAAGGG TTTGAACCGT GCATCCGCTT CGATGTCTGT
 201  GATGGTGTTT TCCTTGATTT TGTTGTTGGC ATTATTGTTG ATTATCGTCC
 251  CTATGCTGGT CGGGCAGTTC AACAATTTGG CATCGCGCCT GCCCCAATTA
 301  ATCGGTTTTA TGCAGAACAC GCTGCTGCCG TGGTTGAAAA ATACAATCGG
 351  CGGATATGTG GAAATCGATC AGGCATCTAT TATTGCGTGG CTTCAGGCGC
 401  ATACGGGAGA GTTGAGCAAC GCGCTTAAGG CGTGGTTTCC CGTTTTGATG
 451  AGGCAGGGCG GCAATATTGT CAGCAGTATC GGCAACCTGC TGCTGCTTCC
 501  CTTGCTGCTT TACTATTTCC TGCTGGATTG GCAGCGGTGG TCGTGCGGCA
 551  TTGCCAAACT GGTTCCGAgG CGTTTTGCCG GTGCTTATAC GCGCATTACA
 601  GGCAATTTGA ACGAGGTATT GGGCGAATTT TGCGCGGGC AGCTTCTGGT
 651  AATGCTGATT ATGGGCTTGG TTTACGGTTT GGGATTGGTG CTGGTCGGGC
 701  TGGATTCGGG GTTTGCCATC GGTATGCTTG CCGGTATTTT GGTGTTTGTC
 751  CCTTATCTCG GGCGTTTAC GGGATTGCTG CTTGCCACCG TCGCCGCCTT
 801  GCTCCAGTTC GGTTCGTGGA ACGGCATCCT ATCGGTTTGG GCGGTTTTTG
 851  CCGTAGGACA GTTTCTCGAA AGTTTTTTCA TTACGCCGAA AATCGTGGGA
 901  GACCGTATCG GGCTGTCGCC GTTTTGGGTT ATCTTTTCGC TGATGGCGTT
 951  CGGGCAGCTG ATGGGCTTTG TCGGAATGTT GGCGGGATTG CCTTTGGCCG
1001  CCGTAACCTT GGTCTTGCTT CGCGAGGGCG TGCAGAAATA TTTTGCCGGC
1051  AGTTTTTACC GGGGCAGGTA G
```

This corresponds to the amino acid sequence (SEQ ID NO: 784; ORF121-1):

```
   1  MYRRKGRGIK PWMGAGAAFA ALVWLVFALG DTLTPFAVAA VLAYVLDPLV
  51  EWLQKKGLNR ASASMSVMVF SLILLLALLL IIVPMLVGQF NNLASRLPQL
 101  IGFMQNTLLP WLKNTIGGYV EIDQASIIAW LQAHTGELSN ALKAWFPVLM
 151  RQGGNIVSSI GNLLLLPLLL YYFLLDWQRW SCGIAKLVPR RFAGAYTRIT
 201  GNLNEVLGEF LRGQLLVMLI MGLVYGLGLV LVGLDSGFAI GMLAGILVFV
 251  PYLGAFTGLL LATVAALLQF GSWNGILSVW AVFAVGQFLE SFFITPKIVG
 301  DRIGLSPFWV IFSLMAFGQL MGFVGMLAGL PLAAVTLVLL REGVQKYFAG
 351  SFYRGR*
```

Computer analysis of this amino acid sequence gave the following results:
Homology with a Predicted ORF from *N.meningitidis* (Strain A)

ORF121 (SEQ ID NO: 782) shows 98.7% identity over a 156aa overlap with an ORF (ORF121a) (SEQ ID NO: 786) from strain A of *N. meningitidis*:

```
                      10         20         30         40         50         60
orf121.pep  MYRRKGRGIKPWMGAGXAFAALVWLVFALGDTLTPFAVAAVLAYVLDPLVEWLQKKGLNR
            ||||||||||| || |||||||||||||||||||||||||||||||||||||||||||||
orf121a     MYRRKGRGIKPWMDAGAAFAALVWLVFALGDTLTPFAVAAVLAYVLDPLVEWLQKKGLNR
                      10         20         30         40         50         60
```

```
                       70         80         90        100        110        120
orf121.pep  ASASMSVMVFSLILLLALLLIIVPMLVGQFNNLASRLPQLIGFMQNTLLPWLKNTIGGYV
            ||||||||||||||||||||||||||||||||||||||||||||||||||||||||||||
orf121a     ASASMSVMVFSLILLLALLLIIVPMLVGQFNNLASRLPQLIGFMQNTLLPWLKNTIGGYV
                       70         80         90        100        110        120

130        140        150
orf121.pep  EIDQASIIAWLQAHTGELSNALKAWFPVLMRQGGNI
            ||||||||||||||||||||||||||||||||||||
orf121a     EIDQASIIAWLQAHTGELSNALKAWFPVLMRQGGNIVSSIGNLLLLPLLLYYFLLDWQRW
                      130        140        150        160        170        180 orf121a     SCGIAKLVPRRFAGAYTRITGNLNEVLGEFLRGQLLVMLIMGLVYGLGLVLVGLDSGFAI
                      190        200        210        220        230        240
```

The complete length ORF121a nucleotide sequence (SEQ ID NO: 785) is:

```
   1  ATGTATCGGA GGAAAGGGCG GGGCATCAAG CCGTGGATGG ATGCCGGTGC
  51  GGCGTTTGCC GCCTTGGTCT GGCTGGTTTT CGCGCTCGGC GATACTTTGA
 101  CTCCGTTTGC GGTTGCGGCG GTGCTGGCGT ATGTATTGGA CCCTTTGGTC
 151  GAATGGTTGC AGAAAAAGGG TTTGAACCGT GCATCCGCTT CGATGTCTGT
 201  GATGGTGTTT TCCTTGATTT TGTTGTTGGC ATTATTGTTG ATTATTGTCC
 251  CTATGCTGGT CGGGCAGTTC AACAATTTGG CATCGCGCCT GCCCCAATTA
 301  ATCGGTTTTA TGCAGAACAC GCTGCTGCCG TGGTTGAAAA ATACAATCGG
 351  CGGATATGTG GAAATCGATC AGGCATCTAT TATTGCGTGG CTTCAGGCGC
 401  ATACGGGCGA GTTGAGCAAC GCGCTTAAGG CGTGGTTTCC CGTTTTGATG
 451  AGGCAGGGCG GCAATATTGT CAGCAGTATC GGCAACCTGC TGCTGCTTCC
 501  CTTGCTGCTT TACTATTTCC TGCTGGATTG GCAGCGGTGG TCGTGCGGCA
 551  TTGCCAAACT GGTTCCGAGG CGTTTTGCCG GTGCTTATAC GCGCATTACA
 601  GGCAATTTGA ACGAGGTATT GGGCGAATTT TTGCGCGGGC AGCTTCTGGT
 651  GATGCTGATT ATGGGTTTGG TTTACGGCTT GGGGTTGGTG CTGGTCGGGC
 701  TGGATTCGGG GTTTGCAATC GGTATGGTTG CCGGTATTTT GGTTTTTGTT
 751  CCCTATTTGG GCGCGTTTAC AGGACTGCTG CTGGCAACCG TCGCCGCCTT
 801  GCTCCAGTTC GGTTCGTGGA ACGGCATCTT GGCTGTTTGG GCGGTTTTTG
 851  CCGTAGGACA GTTTCTCGAA AGTTTTTTCA TTACGCCGAA AATCGTGGGA
 901  GACCGTATCG GCCTGTCGCC GTTTTGGGTT ATCTTTTCGC TGATGGCGTT
 951  CGGGCAGCTG ATGGGCTTTG TCGGAATGTT GGCCGGATTG CCTTTGGCCG
1001  CCGTAACCTT GGTCTTGCTT CGCGAGGGCG TGCAGAAATA TTTTGCCGGC
1051  AGTTTTTACC GGGGCAGGTA G
```

This encodes a protein having amino acid sequence (SEQ ID NO: 786):

```
  1  MYRRKGRGIK PWMDAGAAFA ALVWLVFALG DTLTPFAVAA VLAYVLDPLV
 51  EWLQKKGLNR ASASMSVMVF SLILLLALLL IIVPMLVGQF NNLASRLPQL
101  IGFMQNTLLP WLKNTIGGYV EIDQASIIAW LQAHTGELSN ALKAWFPVLM
151  RQGGNIVSSI GNLLLLPLLL YYFLLDWQRW SCGIAKLVPR RFAGAYTRIT
```

-continued

```
201  GNLNEVLGEF LRGQLLVMLI MGLVYGLGLV LVGLDSGFAI GMVAGILVFV

251  PYLGAFTGLL LATVAALLQF GSWNGILAVW AVFAVGQFLE SFFITPKIVG

301  DRIGLSPFWV IFSLMAFGQL MGFVGMLAGL PLAAVTLVLL REGVQKYFAG

351  SFYRGR*
```

ORF121a (SEQ ID NO: 786) and ORF121-1 (SEQ ID NO: 784) show 99.2% identity in 356 aa overlap:

```
                 10         20         30         40         50         60
orf121a.pep  MYRRKGRGIKPWMDAGAAFAALVWLVFALGDTLTPFAVAAVLAYVLDPLVEWLQKKGLNR
             ||||||||||||| ||||||||||||||||||||||||||||||||||||||||||||||
orf121-1     MYRRKGRGIKPWMGAGAAFAALVWLVFALGDTLTPFAVAAVLAYVLDPLVEWLQKKGLNR
                 10         20         30         40         50         60

70         80         90        100        110        120
orf121a.pep  ASASMSVMVFSLILLLALLLIIVPMLVGQFNNLASRLPQLIGFMQNTLLPWLKNTIGGYV
             ||||||||||||||||||||||||||||||||||||||||||||||||||||||||||||
orf121-1     ASASMSVMVFSLILLLALLLIIVPMLVGQFNNLASRLPQLIGFMQNTLLPWLKNTIGGYV
                 70         80         90        100        110        120

130        140        150        160        170        180
orf121a.pep  EIDQASIIAWLQAHTGELSNALKAWFPVLMRQGGNIVSSIGNLLLLPLLLYYFLLDWQRW
             ||||||||||||||||||||||||||||||||||||||||||||||||||||||||||||
orf121-1     EIDQASIIAWLQAHTGELSNALKAWFPVLMRQGGNIVSSIGNLLLLPLLLYYFLLDWQRW
                130        140        150        160        170        180

190        200        210        220        230        240
orf121a.pep  SCGIAKLVPRRFAGAYTRITGNLNEVLGEFLRGQLLVMLIMGLVYGLGLVLVGLDSGFAI
             ||||||||||||||||||||||||||||||||||||||||||||||||||||||||||||
orf121-1     SCGIAKLVPRRFAGAYTRITGNLNEVLGEFLRGQLLVMLIMGLVYGLGLVLVGLDSGFAI
                190        200        210        220        230        240

250        260        270        280        290        300
orf121a.pep  GMVAGILVFVPYLGAFTGLLLATVAALLQFGSWNGILAVWAVFAVGQFLESFFITPKIVG
             ||:|||||||||||||:|||||||||||||||||||:|||||||||||||||||||||||
orf121-1     GMLAGILVFVPYLGAPTGLLLATVAALLQFGSWNGILSVWAVFAVGQFLESFFITPKIVG
                250        260        270        280        290        300

310        320        330        340        350
orf121a.pep  DRIGLSPFWVIFSLMAFGQLMGFVGMLAGLPLAAVTLVLLREGVQKYFAGSFYRGRX
             ||||||||||||||||||||||||||||||||||||||||||||||||||||||||
orf121-1     DRIGLSPFWVIFSLMAFGQLMGFVGMLAGLPLAAVTLVLLREGVQKYFAGSFYRGRX
                310        320        330        340        350
```

Homology with a Predicted ORF from *N.gonorrhoeae*

ORF121 (SEQ ID NO: 782) shows 97.4% identity over a 156 aa overlap with a Predicted ORF (ORF121ng) (SEQ ID NO: 788) from *N.gonorrhoeae*:

```
orf121.pep  MYRRKGRGIKPWMGAGXAFAALVWLVFALGDTLTPFAVAAVLAYVLDPLVEWLQKKGLNR   60
            ||||||||||||||||| ||||||||:|||||||||||||||||||||||||||||||||
orf121ng    MYRRKGRGIKPWMGAGAAFAALVWLVYALGDTLTPFAVAAVLAYVLDPLVEWLQKKGLNR   60 orf121.pep  ASASMSVMVFSLILLLALLLIIVPMLVGQFNNLASRLPQLIGFMQNTLLPWLKNTIGGYV  120
            ||||||||||||||||||||||||||||||||||||||||||||||||||||||||||||
orf121ng    ASASMSVMVFSLILLLALLLIIVPMLVGQFNNLASRLPQLIGFMQNTLLPWLKNTIGGYV  120 orf121.pep  EIDQASIIAWLQAHTGELSNALKAWFPVLMRQGGNI                          156
            ||||||||||:|||||||||||||||||||:|||||
orf121ng    EIDQASIIAWFQAHTGELSNALKAWFPVLMKQGGNIVSTIGNLLLPPLLLYYFLLDWHRW  180
```

An ORF121ng nucleotide sequence (SEQ ID NO: 787) was predicted to encode a protein having amino acid sequence (SEQ ID NO: 788):

```
  1  MYRRKGRGIK PWMGAGAAFA ALVWLVYALG DTLTPFAVAA VLAYVLDPLV

51  EWLQKKGLNR ASASMSVMVF SLILLLALLL IIVPMLVGQF NNLASRLPQL

101  IGFMQNTLLP WLKNTIGGYV EIDQASIIAW FQAHTGELSN ALKAWFPVLM

151  KQGGNIVSTI GNLLLPPLLL YYFLLDWHRW SCGIPKLVPR RFAGAYTRIT

201  GNLNKVWGKF LRGQLLGETE RGAVVCRVGR ECWEGGGARS RPSDDGWPRW

251  GGG*
```

Further work revealed the following gonococcal DNA sequence (SEQ ID NO: 789):

```
   1  ATGTATCGGA GAAAAGGACG GGGCATCAAG CCGTGGATGG GTGCCGGCGC

51  GGCGTTTGCC GCCTTGGTCT GGCTGGTTTA CGCGCTCGGC GATACTTTGA

101  CTCCGTTTGC GGTTGCGGCG GTGCTGGCGT ATGTGTTGGA CCCTTTGGTC

151  GAATGGTTGC AGAAAAAGGG TTTGAACCGT GCATCCGCTT CGATGTCTGT

201  GATGGTGTTT TCCTTGATTT TGTTGTTGGC ATTATTGTTG ATTATTGTCC

251  CTATGCTGGT CGGGCAGTTC AATAATTTGG CATCTCGCCT GCCCCAATTA

301  ATCGGTTTTA TGCAGAACAC GCTGCTGCCG TGGTTGAAAA ATACAATCGG

351  CGGATATGTG GAAATCGATC AGGCATCTAT TATTGCGTGG TTTCAGGCGC

401  ATACGGGCGA GTTGAGCAAC GCGCTTAAGG CGTGGTTTCC CGTTTTGATG

451  AAACAGGGCG GCAATATTGT CAGCAGTATC GGCAACCTGC TGCTGCCGCC

501  CTTGCTGCTT TACTATTTCC TGCTGGATTG GCAGCGCTGG TCGTGCGGCA

551  TCGCCAAACT GGTTCCGAGG CGTTTTGCCG GTGCTTATAC GCGCATTACG

601  GGTAATTTGA ACGAGGTATT GGGCGAATTT TTGCGCGGTC AGCTTCTGGT

651  GATGCTGATT ATGGGCTTGG TTTACGGTTT GGGATTGATG CTAGTCGGAC

701  TGGATTCGGG ATTTGCCATC GGTATGGTTG CCGGTATTTT GGTGTTTGTC

751  CCCTATTTGG GTGCGTTTAC GGGATTGCTG CTTGCCACTG TTGCAGCCTT

801  GCTCCAGTTC GGTTCGTGGA ACGGAATCTT GGCTGTTTGG GCGGTTTTTG

851  CCGTCGGTCA GTTTCTCGAA AGTTTTTTCA TTACGCCGAA AATTGTAGGA

901  GACCGTATCG GCCTGTCGCC GTTTTGGGTT ATCTTTTCGC TGATGGCGTT

951  CGGAGAGCTG ATGGGCTTTG TCGGAATGTT GGCCGGATTG CCTTTGGCCG

1001  CCGTAACCTT GGTCTTGCTT CGCGAGGGCG CGCAGAAATA TTTTGCCGGC

1051  AGTTTTTACC GGGGCAGGTA G
```

This corresponds to the amino acid sequence (SEQ ID NO: 790; ORF121ng-1):

```
  1  MYRRKGRGIK PWMGAGAAFA ALVWLVYALG DTLTPFAVAA VLAYVLDPLV

51  EWLQKKGLNR ASASMSVMVF SLILLLALLL IIVPMLVGQF NNLASRLPQL

101  IGFMQNTLLP WLKNTIGGYV EIDQASIIAW FQAHTGELSN ALKAWFPVLM
```

-continued

```
151 KQGGNIVSSI GNLLLPPLLL YYFLLDWQRW SCGIAKLVPR RFAGAYTRIT

201 GNLNEVLGEF LRGQLLVMLI MGLVYGLGLM LVGLDSGFAI GMVAGILVFV

251 PYLGAFTGLL LATVAALLQF GSWNGILAVW AVFAVGQFLE SFFITPKIVG

301 DRIGLSPFWV IFSLMAFGEL MGFVGMLAGL PLAAVTLVLL REGAQKYFAG

351 SFYRGR*
```

ORF121-1 (SEQ ID NO: 784) show 97.5% identity in 356 aa overlap:

```
                  10         20         30         40         50         60
orf121-1.pep  MYRRKGRGIKPWMGAGAAFAALVWLVFALGDTLTPFAVAAVLAYVLDPLVEWLQKKGLNR
              ||||||||||||||||||||||||||:|||||||||||||||||||||||||||||||||
orf121ng-1    MYRRKGRGIKPWMGAGAAFAALVWLVYALGDTLTPFAVAAVLAYVLDPLVEWLQKKGLNR
                  10         20         30         40         50         60

70         80         90        100        110        120
orf121-1.pep  ASASMSVMVFSLILLLALLLIIVPMLVGQFNNLASRLPQLIGFMQNTLLPWLKNTIGGYV
              ||||||||||||||||||||||||||||||||||||||||||||||||||||||||||||
orf121ng-1    ASASMSVMVFSLILLLALLLIIVPMLVGQFNNLASRLPQLIGFMQNTLLPWLKNTIGGYV
                  70         80         90        100        110        120

130        140        150        160        170        180
orf121-1.pep  EIDQASIIAWLQAHTGELSNALKAWFPVLMRQGGNIVSSIGNLLLLPLLLYYFLLDWQRW
              ||||||||||:||||||||||||||||||||:|||||||||||||| |||||||||||||
orf121ng-1    EIDQASIIAWFQAHTGELSNALKAWFPVLMKQGGNIVSSIGNLLLLPPLLLYYFLLDWQRW
                 130        140        150        160        170        180

190        200        210        220        230        240
orf121-1.pep  SCGIAKLVPRRFAGAYTRITGNLNEVLGEFLRGQLLVMLIMGLVYGLGLVLVGLDSGFAI
              |||||||||||||||||||||||||||||||||||||||||||||||||:||||||||||
orf121ng-1    SCGIAKLVPRRFAGAYTRITGNLNEVLGEFLRGQLLVMLIMGLVYGLGLMLVGLDSGFAI
                 190        200        210        220        230        240

250        260        270        280        290        300
orf121-1.pep  GMLAGILVFVPYLGAFTGLLLATVAALLQFGSWNGILSVWAVFAVGQFLESFFITPKIVG
              ||:|||||||||||||||||||||||||||||||||:|||||||||||||||||||||||
orf121ng-1    GMVAGILVFVPYLGAFTGLLLATVAALLQFGSWNGILAVWAVFAVGQFLESFFITPKIVG
                 250        260        270        280        290        300

310        320        330        340        350
orf121-1.pep  DRIGLSPFWVIFSLMAFGQLMGFVGMLAGLPLAAVTLVLLREGVQKYFAGSFYRGRX
              ||||||||||||||||||:|||||||||||||||||||||||:|||||||||||||
orf121ng-1    DRIGLSPFWVIFSLMAFGELMGFVGMLAGLPLAAVTLVLLREGAQKYFAGSFYRGRX
                 310        320        330        340        350
```

In addition, ORF121ng-1 (SEQ ID NO: 790) shows homology to a permease (SEQ ID NO: 1162) from *H.influenzae*:

```
sp|P43969|PERM_HAEIN PUTATIVE PERMEASE PERM HOMOLOG Length = 349
Score = 69.9 bits (168), Expect = 2e-11
Identities = 67/317 (21%), Positives = 120/317 (37%), Gaps = 7/317 (2%)

Query:  26  VYALGDTLTPFAVAAVLAYVLDPLVEWL-QKKGLNRASASMSVMVFSXXXXXXXXXXXVP   84
            +Y  GD + P   +A VL+Y+L+  + +L Q     R  A++ +              VP
Sbjct:  32  IYFFGDLIAPLLIALVLSYLLEIPINFLNQYLKCPRMLATILIFGSFIGLAAVFFLVLVP   91

Query:  85  MLVGQFNNLASRLPQLIGFMQNTLLPWLKNTIGGYVE-IDQASIIAWFQAHTGELSNALK  143
            ML  Q  +L S LP +     N    WL N     Y E ID + + +F +   ++    +
Sbjct:  92  MLWNQTISLLSDLPAMF----NKSNEWLLNLPKNYPELIDYSMVDSIFNSVREKILGFGE  147

Query: 144  AWFPVLMKQGGNIVSSIGNXXXXXXXXXXXXXXXDWQRWSCGIAKLVPRRFAGAYTRITGNL  203
            +   + +    N+VS                 D     G+++ +P+    A+ R    +
Sbjct: 148  SAVKLSLASIMNLVSLGIYAFLVPLMMFFMLKDKSELLQGVSRFLPKNRNLAFXRWK-EM  206

Query: 204  NEVLGEFLRGQXXXXXXXXXXXXXXXXXXXXXDSGFAIGMVAGILVFVPYXXXXXXXXXX  263
            + +  ++ G+                       +       G+    V VPY
Sbjct: 207  QQQISNYIHGKLLEILIVTLITYIIFLIFGLNYPLLLAFAVGLSVLVPYIGAVIVTIPVA  266
```

-continued

```
sp|P43969|PERM_HAEIN PUTATIVE PERMEASE PERM HOMOLOG Length = 349
Score = 69.9 bits (168), Expect = 2e-11
Identities = 67/317 (21%), Positives = 120/317 (37%), Gaps = 7/317 (2%)

Query: 264  XXXXXQFGSWNGILAVWAVFAVGQFLESFFITPKIVGDRIGLSPFWVIFSLMAFGELMGF  323
                 QFG        +   FAV Q L+   + P +  + + L P    +I S++ FG L GF
Sbjct: 267  LVALFQFGISPTFWYIIIAFAVSQLLDGNLLVPYLFSEAVNLHPLIIIISVLIFGGLWGF  326

Query: 324  VGMLAGLPLAAVTLVLL                                             340
                 G+   +PLA +    ++
Sbjct: 327  WGVFFAIPLATLVKAVI                                             343
```

Based on this analysis, including the presence of a putative leader sequence and transmembrane domains in the two proteins, it is predicted that the proteins from *N.meningitidis* and *N.gonorrhoeae*, and their epitopes, could be useful antigens for vaccines or diagnostics, or for raising antibodies.

Example 94

The following partial DNA sequence was identified in *N.meningitidis* (SEQ ID NO; 791):

```
  1  ..ACTGCTTTTT CGGCGGCGCT GCGCTTGAGT CCATCATGAC TCGTCATATT
 51    TTTGTCCTTT GGGAAACCGT ATCAACAAAC AGCCGCCATC TTAACATTTT
101    TTTGCACGTC CTGCCCGCCG CGTTCAAATG CGTACCAGCA ATACCGCCGC
151    CTGCGCCTCT ATGCCTTCCA TCCGCCCGAG ATAGCCGAGT TTTTCGTTGG
201    TTTTGCCTTT GATGTTGACG CACGAAATGT CTATGCCCAA ATCGGCGGCG
251    ATGTTGGCAC GCATTTGCGG AATGTGCGGC GCGAGTGTGG GTTTCTGTGC
301    AATCACGGTC GTATCGACAT TGACCGCCTG CCAACCCTGC GCCTGAACGC
351    TTTGATACGC CGCACGCAAA AGGACGCGGC TGTCCGCATC TTTGAACTCT
401    GCGGCGGTGT CGGGGAAATG GCTGCCGATA TCGCCCAAAC CTGCCGCACC
451    GAGCAGCGCG TCGGTAACGG CGTGCAGCAG CGCATCGGCA TCGGAGTGTC
501    CGAGCAGCCC TTTTTCAAAT GGGATTTCAA CTCCGCCAAG TATCAG..
```

This corresponds to the amino acid sequence (SEQ ID NO: 792; ORF122):

```
  1  ..TAFSAALRLS PSXLVIFLSF GKPYQQTAAI LTFFCTSCPP RSNAYQQYRR
 51    LRLYAFHPPE IAEFFVGFAF DVDARNVYAQ IGGDVGTHLR NVRRECGFLC
101    NHGRIDIDRL PTLRLNALIR RTQKDAAVRI FELCGGVGEM AADIAQTCRT
151    EQRVGNGVQQ RIGIGVSEQP FFKWDFNSAK YQ..
```

Further work revealed the complete nucleotide sequence (SEQ ID NO: 793):

```
  1  ATATCGTACT GGGCAAGCAG TTCGCCGGAT TTTTTGGAAG TAGATACCGC
 51  GCCTTTGATT TTTTTGCCGC TCTTACCCAA GGCTTCGATG AAAAAGTTGA
101  TGGTCGAGCC GGTACCGATG CCGATATATT CATTTTCGGG TACGAATTCG
151  ACTGCTTTTT CGGCGGCGAT GCGCTTGAGT TCGTCTTGTG TCGTCATATT
201  TTTGTCCTTT GGGAAACCGT ATCAACAAAC AGCCGCCATC TTAACATTTT
251  TTTGCACGTC CTGCCCGCCG CGTTCAAATG CGTACCAGCA ATACCGCCGC
```

-continued
```
301  CTGCGCCTCT ATGCCTTCCA TCCGCCCGAG ATAGCCGAGT TTTTCGTTGG

351  TTTTGCCTTT GATGTTGACG CACGAAATGT CTATGCCCAA ATCGGCGGCG

401  ATGTTGGCAC GCATTTGCGG AATGTGCGGC GCGAGTTTGG GTTTCTGTGC

451  AATCACGGTC GTATCGACAT TGACCGCCTG CCAACCCTGC GCCTGAACGC

501  TTTGATACGC CGCACGCAAA AGGACGCGGC TGTCCGCATC TTTGAACTCT

551  GCGGCGGTGT CGGGGAAATG GCTGCCGATA TCGCCCAAAC CTGCCGCACC

601  GAGCAGCGCG TCGGTAACGG CGTGCAGCAG CGCATCGGCA TCGGAGTGTC

651  CGAGCAGCCC TTTTTCAAAT GGGATTTCAA CTCCGCCAAG TATCAGCTTT

701  CTGCCTTCGG TCAGTTGGTG GACATCGTAG CCCTGTCCGA TACGGATGTT

751  CGTCATCGTT TGTGTTCCTG A
```

This corresponds to the amino acid sequence (SEQ ID NO: 794; ORF122-1):

```
  1  ISYWASSSPD FLEVDTAPLI FLPLLPKASM KKLMVEPVPM PIYSFSGTNS

51  TAFSAAMRLS SSCVVIFLSF GKPYQQTAAI LTFFCTSCPP RSNAYQQYRR

101  LRLYAFHPPE IAEFFVGFAF DVDARNVYAQ IGGDVGTHLR NVRREFGFLC

151  NHGRIDIDRL PTLRLNALIR RTQKDAAVRI FELCGGVGEM AADIAQTCRT

201  EQRVGNGVQQ RIGIGVSEQP FFKWDFNSAK YQLSAFGQLV DIVALSDTDV

251  RHRLCS*
```

Computer analysis of this amino acid sequence gave the following results:
Homology with a Predicted ORF from N.meningitidis (Strain A)

ORF122 (SEQ ID NO: 792) shows 94.0% identity over a 182aa overlap with an ORF (ORF122a) (SEQ ID NO: 796) from strain A of N. meningitidis:

```
                                             10         20         30
orf122.pep                           TAFSAALRLSPSXLVIFLSFGKPYQQTAAI
                                     ||||||:||| | :||||||||||||||||
orf122a    FLPLLPKASMKKLMVEPVPMPMYSFSGTNSTAFSAAARLSSSCVVIFLSFGKPYQQTAAI
                    30         40         50         60         70         80

40         50         60         70         80         90
orf122.pep  LTFFCTSCPPRSNAYQQYRRLRLYAFHPPEIAEFFVGFAFDVDARNVYAQIGGDVGTHLR
            ||||  ||||||||| |||||||||||||| |||:|||||||| ||||||||||||||||
orf122a     LTFFXTSCPPRSNPYGQYRRLRLYAFHAPEITEFFVGFAFXVDARNVYAQIGGDVGTHLR
                    90        100        110        120        130        140

100        110        120        130        140        150
orf122.pep  NVRRECGFLCNHGRIDIDRLPTLRLNALIRRTQKDAAVRIFELCGGVGEMAADIAQTCRT
            |:|||  ||||||||||||||||||||||||||||||||||||||||||||||||||||
orf122a     NMRREFGFLCNHGRIDIDRLPTLRLNALIRRTQKDAAVRIFELCGGVGEMAADIAQTCRT
                   150        160        170        180        190        200

160        170        180
orf122.pep  EQRVGNGVQQRIGIGVSEQPFFKWDFNSAKYQ
            ||||||||||||||||||||||||||||||||
orf122a     EQRVGNGVQQRIGIGVSEQPFFKWDFNSAKYQLSAFGQLVDIVALSDTDVRHRLCSX
                   210        220        230        240        250
```

The complete length ORF122a nucleotide sequence (SEQ ID NO: 795) is:

```
  1  ATATCATATT GGGCAAGCAG TTCACTGGAT TTTTTGGAAG TAGATACCGC

51  GCCTTTGATT TTTTTGCCGC TCTTACCCAA GGCTTCGATG AAAAAGTTGA
```

-continued

```
101  TGGTCGAACC GGTACCGATG CCGATGTATT CGTTTTCGGG TACGAATTCG

151  ACTGCNTTTT CGGCGGCGAT GCGCTTGAGT TCGTCTTGTG TCGTCATATT

201  TTTGTCCTTT GGGAAACCGT ATCAACAAAC AGCCGCCATC TTAACATTTT

251  TTNNNACGTC CTGCCCGCCG CGTTCAAATC CTTACCAGCA ATACCGCCGC

301  CTGCGACTCT ATGCCTTCCA TGCGCCCGAG ATAACCGAGT TTTTCGTTGG

351  TTTTGCCTTT GANGTTGACG CACGAAATGT CTATGCCCAA ATCGGCGGCG

401  ATGTTGGCAC GCATTTGCGG AATATGCGGC GCGAGTTTGG GTTTCTGTGC

451  AATCACGGTC GTATCGACAT TGACCGCCTG CCAACCCTGC GCCTGAACGC

501  TTTGATACGC CGCACGCAAA AGGACGCGGC TGTCCGCATC TTTGAACTCT

551  GCGGCGGTGT CGGGGAAATG GCTGCCGATA TCGCCCAAAC CTGCCGCACC

601  GAGCAGCGCG TCGGTAACGG CGTGCAGCAG CGCATCGGCA TCGGAGTGTC

651  CGAGCAGCCC TTTTTCAAAT GGGATTTCAA CTCCGCCAAG TATCAGCTTT

701  CTGCCTTCGG TCACTTGGTG GACATCGTAG CCCTGTCCGA TACGGATGTT

751  CGTCATCGTT TGTGTTCCTG A
```

This encodes a protein having amino acid sequence (SEQ ID NO: 796):

```
  1  ISYWASSSLD FLEVDTAPLI FLPLLPKASM KKLMVEPVPM PMYSFSGTNS

51  TAFSAAMRLS SSCVVIFLSF GKPYQQTAAI LTFFXTSCPP RSNPYQQYRR

101  LRLYAFHAPE ITEFFVGFAF XVDARNVYAQ IGGDVGTHLR NMRREFGFLC

151  NHGRIDIDRL PTLRLNALIR RTQKDAAVRI FELCGGVGEM AADIAQTCRT

201  EQRVGNGVQQ RIGIGVSEQP FFKWDFNSAK YQLSAFGQLV DIVALSDTDV

251  RHRLCS*
```

ORF122a (SEQ ID NO: 796) and ORF122-1 (SEQ ID NO: 794) show 96.9% identity in 256 aa overlap:

```
                    10         20         30         40         50         60
orf122a.pep ISYWASSSLDFLEVDTAPLIFLPLLPKASMKKLMVEPVPMPMYSFSGTNSTAFSAAMRLS
            ||||||||| ||||||||||||||||||||||||||||||||:|||||||||||||||||
orf122-1    ISYWASSSPDFLEVDTAPLIFLPLLPKASMKKLMVEPVPMPIYSFSGTNSTAFSAAMRLS
                    10         20         30         40         50         60

70         80         90        100        110        120
orf122a.pep SSCVVIFLSFGKPYQQTAAILTFFXTSCPPRSNPYQQYRRLRLYAFHAPEITEFFVGFAF
            |||||||||||||||||||||||| |||||||| |||||||||||||||| :||||||||
orf122-1    SSCVVIFLSFGKPYQQTAAILTFFCTSCPPRSNAYQQYRRLRLYAFHPPEIAEFFVGFAF
                    70         80         90        100        110        120

130        140        150        160        170        180
orf122a.pep XVDARNVYAQIGGDVGTHLRNMRREFGFLCNHGRIDIDRLPTLRLNALIRRTQKDAAVRI
             ||||||||||||||||||||:|||||||||||||||||||||||||||||||||||||
orf122-1    DVDARNVYAQIGGDVGTHLRNVRREFGFLCNHGRIDIDRLPTLRLNALIRRTQKDAAVRI
                   130        140        150        160        170        180

190        200        210        220        230        240
orf122a.pep FELCGGVGEMAADIAQTCRTEQRVGNGVQQRIGIGVSEQPFFKWDFNSAKYQLSAFGQLV
            ||||||||||||||||||||||||||||||||||||||||||||||||||||||||||||
orf122-1    FELCGGVGEMAADIAQTCRTEQRVGNGVQQRIGIGVSEQPFFKWDFNSAKYQLSAFGQLV
                   190        200        210        220        230        240

250
orf122a.pep DIVALSDTDVRHRLCSX
            |||||||||||||||||
orf122-1    DIVALSDTDVRHRLCSX
                   250
```

Homology with a Predicted ORF from *N.gonorrhoeae*
ORF122 (SEQ ID NO: 792) shows 89.6% identity over a
182 aa overlap with a Predicted ORF (ORF122(SEQ ID NO:
798) from *N.gonorrhoeae*:

```
orf122.pep                               TAFSAALRLSPSXLVIFLSFGKPYQQTAAI   30
                                         ||||||:||| | :|||||||||||||||
orf122ng    FLPLLPKASMKKLMVEPVPMPMYSFSGTNSTAFSAAMRLSSSCVVIFLSFGKPYQQTAAI   80 orf122.pep  LTFFCTSCPPRSNAYQQYRRLRLYAFHPPEIAEFFVGFAFDVDARNVYAQIGGDVGTHLR   90
            ||||||| ||||| ||||||||||||||||||||||||||||:||||: :||||||||||
orf122ng    LTFFCTSWPPRSNPYQQYRRLRLYAFHPPEIAEFFVGFAFDIDARNIDTQIGGDVGTHLR  140 orf122.pep  NVRRECGFLCNHGRIDIDRLPTLRLNALIRRTQKDAAVRIFELCGGVGEMAADIAQTCRT  150
            ||| | ||||||||||||||:|||||||||||||||||||||||||||:||||:||||||
orf122ng    NVRCEFGFLCNHGRIDIDHLPTLRLNALIRRTQKDAAVRIFELCGGVGKMAADVAQTCRT  200 orf122.pep  EQRVGNGVQQRIGIGVSEQPFFKWDFNSAKYQ                              182
            ||||||||||:|| : ||||||||||||||||
orf122ng    EQRVGNGVQQRVGIRMPEQPFFKWDFNSAKYQLSAFGQLVDIVALSDTDIRHRLCS      256
```

The complete length ORF122ng nucleotide sequence
(SEQ ID NO: 797) is:

```
  1 ATGTCGTACC GGGCAAGCAG TTCGCCGGAT TTTTTGGAGG TTGAAACCGC
 51 GCCTTTGATT TTTTTACCGC TTTTGCCCAA GGCTTCGATG AAGAAATTGa
101 tgGTCGAACC GgtaCCGATG CCGATGTATT CGTTTTCGGG TACGAATTCG
151 ACTGCTTTTT CGGCGGCGAT GCGCttgAgt TCgtcttgcg TcgTCATATT
201 TTTAtccttt gGGAAaccct atcaAcaAAc agccgccatC TTAACATTTT
251 TTTGCACGtc ctggccgccg cgttcaAATc cgtaccaGca ataccgccgc
201 ctgcgcctCT AtgcCTTCCA TCCGCCCGAG ATAGCCGAGT TTTTCGTTGG
351 TTTTGCCTTT GATatTGACG CACGAAATAT CGatacCCAa atcggcgGCG
401 ATGTTGGCAC GCATTTGCGG AATGTGCGGT GCGAGTTTGG GTTTCTGTGC
451 AATCACGGTC GTATCGACAT TGACCACCTG CCAACCCTGC GCCTGAACGC
501 TTTGATACGC CGCACGCAAA AGGACGCGGC TGTCCGCATC TTTGAACTCT
551 GCGGCGGTGT CGGGAAAATG GCTGCCGATG TCGCCCAAAC CTGCCGCACC
601 GAGCAGCgcg tcggtaaCGG CGTGCAGCAG cgcgTcgGCA TCCGAATGCC
651 CGAGCAGCCC TTTTTCAAAT GGGATTTCAA CTCCGCCAAG TATCAGCTTT
701 CTGCCTTCGG TCAATTGGTG GACATCGTAG CCCTGTCCGA TACGGATATT
751 CGTCATCGTT TGTGTTCCTG A
```

This encodes a protein having amino acid sequence (SEQ
ID NO: 79.8):

```
  1 MSYRASSSPD FLEVETAPLI FLPLLPKASM KKLMVEPVPM PMYSFSGTNS
 51 TAFSAAMRLS SSCVVIFLSF GKPYQQTAAI LTFFCTSWPP RSNPYQQYRR
101 LRLYAFHPPE IAEFFVGFAF DIDARNIDTQ IGGDVGTHLR NVRCEFGFLC
151 NHGRIDIDHL PTLRLNALIR RTQKDAAVRI FELCGGVGKM AADVAQTCRT
201 EQRVGNGVQQ RVGIRMPEQP FFKWDFNSAK YQLSAFGQLV DIVALSDTDI
251 RHRLCS*
```

ORF122ng (SEQ IQ ID NO: 798) and ORF122-1 (SEQ ID NO: 794) show 92.6% identity in 256 aa overlap:

```
                       10         20         30         40         50         60
orf122-1.pep   ISYWASSSPDFLEVDTAPLIFLPLLPKASMKKLMVEPVPMPIYSFSGTNSTAFSAAMRLS
               :||  ||||||||||:||||||||||||||||||||||||||:|||||||||||||||||
orf122ng       MSYRASSSPDFLEVETAPLIFLPLLPKASMKKLMVEPVPMPMYSFSGTNSTAFSAAMRLS
                       10         20         30         40         50         60

70         80         90        100        110        120
orf122-1.pep   SSCVVIFLSFGKPYQQTAAILTFFCTSCPPRSNAYQQYRRLRLYAFHPPEIAEFFVGFAF
               ||||||||||||||||||||||||||| ||||||  |||||||||||||||||||||||
orf122ng       SSCVVIFLSFGKPYQQTAAILTFFCTSWPPRSNPYQQYRRLRLYAFHPPEIAEFFVGFAF
                       70         80         90        100        110        120

130        140        150        160        170        180
orf122-1.pep   DVDARNVYAQIGGDVGTHLRNVRREFGFLCNHGRIDIDRLPTLRLNALIRRTQKDAAVRI
               |:||||: :||||||||||||||||:|||||||||||||:||||||||||||||||||||
orf122ng       DIDARNIDTQIGGDVGTHLRNVRCEFGFLCNHGRIDIDHLPTLRLNALIRRTQKDAAVRI
                      130        140        150        160        170        180

190        200        210        220        230        240
orf122-1.pep   FELCGGVGEMAADIAQTCRTEQRVGNGVQQRIGIGVSEQPFFKWDFNSAKYQLSAFGQLV
               |||||||||:||||:|||||||||||||||||||:|| : |||||||||||||||||||
orf122ng       FELCGGVGKMAADVAQTCRTEQRVGNGVQQRVGIRHPEQPFFKWDFNSAKYQLSAFGQLV
                      190        200        210        220        230        240

250
orf122-1.pep   DIVALSDTDVRHRLCSX
               |||||||||:|||||||
orf122ng       DIVALSDTDIRHRLCSX
                      250
```

Based on this analysis, it is predicted that the proteins from *N.meningitidis* and *N.gonorrhoeae*, and their epitopes, could be useful antigens for vaccines or diagnostics, or for raising antibodies.

Example 95

The following partial DNA sequence was identified in *N.meningitidis* (SEQ ID NO: 799):

```
  1  ..GCCGGCGCGA GTGCGAACAA CATTTCCGCG CGTTTTGCGG AAACACCCGT
 51    CGCTGTCAGC GTTACCCTGA TCGGCACGGT ACTTGCCGTC ATGCTGCCCG
101    TTACCGAATA TGAAAACTTC CTGCTGCTTA TCGGCTCGGT ATTTGCGCCG
151    ATGGGGCGGA TTTTGATTGC CGACTTTTTC GTCTTGAAAC GGCGTGA
```

This corresponds to the amino acid sequence (SEQ ID NO: 800; ORF125):

```
  1  ..AGASANNISA RFAETPVAVS VTLIGTVLAV MLPVTEYENF LLLIGSVFAP
 51    MGGFDCRLFR LETA*
```

Further work revealed the complete nucleotide sequence (SEQ ID NO: 801):

```
  1    ATGTCGGGCA ATGCCTCCTC TCCTTCATCT TCCTCCGCCA TCGGGCTGAT
 51    TTGGTTCGGC GCGGCGGTAT CGATTGCCGA AATCAGCACG GGTACGCTGC
101    TTGCGCCTTT GGGCTGGCAG CGCGGTCTGG CGGCTCTACT TTTGGGTCAT
151    GCCGTCGGCG GCGCGCTGTT TTTTGCGGCG GCGTATATCG GCGCACTGAC
201    CGGACGCAGC TCGATGGAAA GCGTGCGCCT GTCGTTCGGC AAACGCGGTT
251    CAGTGCTGTT TTCCGTGGCG AATATGCTGC AACTGGCCGG CTGGACGGCG
```

-continued

```
 301   GTGATGATTT ACGCCGGCGC AACGGTCAGC TCCGCTTTGG GCAAAGTGTT
 351   GTGGGACGGC GAATCTTTTG TCTGGTGGGC ATTGGCAAAC GGCGCGCTGA
 401   TTGTGCTGTG GCTGGTTTTC GGCGCACGCA AAACAGGCGG GCTGAAAACC
 451   GTTTCGATGC TGCTGATGCT GTTGGCGGTT CTGTGGCTGA GTGCCGAAGT
 501   CTTTTCCACG GCAGGCAGCA CCGCCGCACA GGTTTCAGAC GGCATGAGTT
 551   TCGGAACGGC AGTCGAGCTG TCCGCCGTGA TGCCGCTTTC CTGGCTGCCG
 601   CTTGCCGCCG ACTACACGCG CCACGCGCGC CGCCCGTTTG CGGCAACCCT
 651   GACGGCAACG CTCGCCTACA CGCTGACCGG CTGCTGGATG TATGCCTTGG
 701   GTTTGGCAGC GGCGTTGTTC ACCGGAGAAA CCGACGTGGC AAAAATCCTG
 751   CTGGGCGCAG GTTTGGGTGC GGCAGGCATT TTGGCGGTCG TCCTCTCCAC
 801   CGTTACCACA ACGTTTCTCG ATGCCTATTC CGCCGGCGCG AGTGCGAACA
 851   ACATTTCCGC GCGTTTTGCG GAAACACCCG TCGCTGTCGG CGTTACCCTG
 901   ATCGGCACGG TACTTGCCGT CATGCTGCCC GTTACCGAAT ATGAAAACTT
 951   CCTGCTGCTT ATCGGCTCGG TATTTGCGCC GATGGCGGCG GTTTTGATTG
1001   CCGACTTTTT CGTCTTGAAA CGGCGTGAGG AGATTGAAGG CTTTGACTTT
1051   GCCGGACTGG TTCTGTGGCT TGCGGGCTTC ATCCTCTACC GCTTCCTGCT
1101   CTCGTCCGGC TGGGAAAGCA GCATCGGTCT GACCGCCCCC GTAATGTCTG
1151   CCGTTGCCAT TGCCACCGTA TCGGTACGCC TTTTCTTTAA AAAAACCCAA
1201   TCTTTACAAA GGAACCCGTC ATGA
```

This corresponds to the amino acid sequence (SEQ ID NO: 802; ORF125-1):

```
  1   MSGNASSPSS SSAIGLIWFG AAVSIAEIST GTLLAPLGWQ RGLAALLLGH
 51   AVGGALFFAA AYIGALTGRS SMESVRLSFG KRGSVLFSVA NMLQLAGWTA
101   VMIYAGATVS SALGKVLWDG ESFVWWALAN GALIVLWLVF GARKTGGLKT
151   VSMLLMLLAV LWLSAEVFST AGSTAAQVSD GMSFGTAVEL SAVMPLSWLP
201   LAADYTRHAR RPFAATLTAT LAYTLTGCWM YALGLAAALF TGETDVAKIL
251   LGAGLGAAGI LAVVLSTVTT TFLDAYSAGA SANNISARFA ETPVAVGVTL
301   IGTVLAVMLP VTEYENFLLL IGSVFAPMAA VLIADFFVLK RREEIEGFDF
351   AGLVLWLAGF ILYRFLLSSG WESSIGLTAP VMSAVAIATV SVRLFFKKTQ
401   SLQRNPS*
```

Computer analysis of this amino acid sequence gave the following results:
Homology with a Predicted ORF from *N.meningitidis* (Strain A)

ORF125 (SEQ ID NO: 800) shows 76.5% identity over a 51aa overlap with an ORF (ORF125a) (SEQ ID NO: 804) from strain A of *N. meningitidis*:

```
                              10         20         30
orf125.pep                AGASANNISARFAETPVAVSVTLIGTVLAV
                          ||:||||||:::| |:||:|:::||:|||
orf125a    KILLGAGLGAAGILAVVLSTVTTTFLDAYSAGVSANNISAKLSEIPIAVAVAVVGTLLAV
           250       260       270       280       290       300

40         50         60
orf125.pep  MLPVTEYENFLLLIGSVFAPMGGFDCRLFRLETAX
            :|||||||||||||||||||:
orf125a     LLPVTEYENFLLLIGSVFAPMAAVLIADFFVLKRREEIEG
            310       320       330       340
```

The ORF125a partial nucleotide sequence (SEQ ID NO: 803) is:

```
   1  ATGTCGGGCA ATGCCTCCTC TCNTTCATCT TCCGCCGCCA TCGGGCTGAT
  51  TTGGTTCGGC GCGGCGGTAT CGATTGCCGA AATCAGCACG GGTACACTGC
 101  TTGCGCCTTT GGGCTGGCAG CGCGGTCTGG CNGCTCTGCT TTTGGGTCAT
 151  GCCGTCGGCG GCGCGCTGTT TTTTGCGGCG GCGTATATCG GCGCACTGAC
 201  CGGACNCANC TCGATGGAAA GCGTGCGCCT GTCGTTCGGC AAACGCGGTT
 251  CAGTGCTGTT TTCCGTGGCG AATATGCTGC AACTGGCCGG CTGGACGGCG
 301  GTGATGATTT ACGCCGGCGC AACGGTCAGC TCCGCTTTGG GCAAAGTGTT
 351  GTGGGACGGC GAATCTTTTG TCTGGTGGGC ATTGGCAAAC GGCGCGCTGA
 401  TTGTGCTGTG GCTGGTTTTC GGCGCACGCA AAACAGGCGG GCTGAAAACC
 451  GTTTCGATGC TGCTGATGCT GTTGGCGGTT CTGTGGCTGA GTGCCGAANT
 501  NTTTTCCACG GCAGGCAGCA CCGCCGCANN GGTNNCAGAC GGCATGAGTT
 551  TCGGAACGGC AGTCGAGCTG TCCGCCGTNA TGCCGCTTTC TTGGCTGCCG
 601  CTGGCCGCCG ACTACACGCG CCACGCGCGC CGCCCGTTTG CGGCAACCCT
 651  GACGGCAACG CTCGCCTACA CGCTGACCGG CTGCTGGATG TATGCCTTGG
 701  GTTTGGCAGC GGCGTTGTTC ACCGGAGAAA CCGACGTGGC AAAAATCCTG
 751  CTGGGCGCAG GTTTGGGTGC GGCAGGCATT TTGGCGGTCG TCCTGTCGAC
 801  CGTTACCACC ACTTTTCTCG ATGCNTACTC CGCCGGCGTA AGTGCCAACA
 851  ATATTTCCGC CAAACTTTCG GAAATACCNA TCGCCGTTGC CGTCGCCGTT
 901  GTCGGCACAC TGCTTGCCGT CCTCCTGCCC GTTACCGAAT ATGAAAACTT
 951  CCTGCTGCTT ATCGGCTCGG TATTTGCGCC GATGGCGGCG GTTTTGATTG
1001  CCGACTTTTT CGTCTTGAAA CGGCGTGAGG AGATTGAAGG C..
```

This encodes a protein having the partial amino acid sequence (SEQ ID NO: 804):

```
  1  MSGNASSXSS SAAIGLIWFG AAVSIAEIST GTLLAPLGWQ RGLAALLLGH
 51  AVGGALFFAA AYIGALTGXX SMESVRLSFG KRGSVLFSVA NMLQLAGWTA
101  VMIYAGATVS SALGKVLWDG ESFVWWALAN GALIVLWLVF GARKTGGLKT
151  VSMLLMLLAV LWLSAEXFST AGSTAAXVXD GMSFGTAVEL SAVMPLSWLP
201  LAADYTRHAR RPFAATLTAT LAYTLTGCWM YALGLAAALF TGETDVAKIL
251  LGAGLGAAGI LAVVLSTVTT TFLDAYSAGV SANNISAKLS EIPIAVAVAV
301  VGTLLAVLLP VTEYENFLLL IGSVFAPMAA VLIADFFVLK RREEIEG..
```

ORF125a (SEQ ID NO: 804) and ORF125-1 (SEQ ID NO: 802) show 94.5% identity in 347 aa overlap:

```
                    10         20         30         40         50         60
orf125a.pep MSGNASSXSSSSAAIGLIWFGAAVSIAEISTGTLLAPLGWQRGLAALLLGHAVGGALFFAA
            ||||||| |||:||||||||||||||||||||||||||||||||||||||||||||||||
orf125-1    MSGNASSPSSSSAAIGLIWFGAAVSIAEISTGTLLAPLGWQRGLAALLLGHAVGGALFFAA
                    10         20         30         40         50         60
```

-continued

```
              70        80        90       100       110       120
orf125a.pep  AYIGALTGXXSMESVRLSFGKRGSVLFSVANMLQLAGWTAVMIYAGATVSSALGKVLWDG
             ||||||||  |||||||||||||||||||||||||||||||||||||||||||||||||
orf125-1     AYIGALTGRSSMESVRLSFGKRGSVLFSVANMLQLAGWTAVMIYAGATVSSALGKVLWDG
              70        80        90       100       110       120

130       140       150       160       170       180
orf125a.pep  ESFVWWALANGALIVLWLVFGARKTGGLKTVSMLLMLLAVLWLSAEXFSTAGSTAAXVXD
             |||||||||||||||||||||||||||||||||||||||||||||| ||||||||| | |
orf125-1     ESFVWWALANGALIVLWLVFGARKTGGLKTVSMLLMLLAVLWLSAEVFSTAGSTAAQVSD
             130       140       150       160       170       180

190       200       210       220       230       240
orf125a.pep  GMSFGTAVELSAVMPLSWLPLAADYTRHARRPFAATLTATLAYTLTGCWMYALGLAAALF
             ||||||||||||||||||||||||||||||||||||||||||||||||||||||||||||
orf125-1     GMSFGTAVELSAVMPLSWLPLAADYTRHARRPFAATLTATLAYTLTGCWMYALGLAAALF
             190       200       210       220       230       240

250       260       270       280       290       300
orf125a.pep  TGETDVAKILLGAGLGAAGILAVVLSTVTTTFLDAYSAGVSANNISAKLSEIPIAVAVAV
             ||||||||||||||||||||||||||||||||||||||:||||||:::| |:||:::
orf125-1     TGETDVAKILLGAGLGAAGILAVVLSTVTTTFLDAYSAGASANNISARFAETPVAVGVTL
             250       260       270       280       290       300

310       320       330       340
orf125a.pep  VGTLLAVLLPVTEYENFLLLIGSVFAPMAAVLIADFFVLKRREEIEG
             :||:|||:|||||||||||||||||||||||||||||||||||||||
orf125-1     IGTVLAVMLPVTEYENFLLLIGSVFAPMAAVLIADFFVLKRREEIEGFDFAGLVLWLAGF
             310       320       330       340       350       360
```

Homology with a Predicted ORF from *N.gonorrhoeae*

ORF125 (SEQ ID NO: 800) shows 86.2% identity over a 65aa overlap with a Predicted ORF (ORF125ng) (SEQ ID) NO: 806) from *N.gonorrhoeae*:

```
orf125.pep                           AGASANNISARFAETPVAVSVTLIGTVLAV   30
                                     ||||||||||||| ||||:|||| |||||
orf125ng    KILLGAGLGITGILAVVLSTVTTTFLDTYSAGASANNISARFAEIPVAVGVTLIRTVLAV  308 orf125.pep  MLPVTEYENFLLLIGSVFAPM-GGFDCRLFRLETA                            64
            ||||||||:||||| |||:|| ||||||||| |:||
orf125ng    MLPVTEYKNFLLLIRSVFGPMAGGFDCRLFCLKTA                           343
                                    40
```

An ORF125ng nucleotide sequence (SEQ ID NO: 805) was predicted to encode a protein having amino acid sequence (SEQ ID NO: 806):

```
  1  MSGNASSPSS SAAIGLVWFG AAVSIAEIST GTLLAPLGWQ RGLAALLLGH

51  AVGGALFFAA AYIGALTGRS SMESVRLSFG KCGSVLPSVA NMLQLAGWTA

101  VMIYVGATVS SALGEVLWDG ESFVWWALAN GALIVLWLVF GARRTGGLKT

151  VSMLLMLLAV LWLSVEVFAS SGTNAAPAVS DGMTFGTAVE LSAVMPLSWL

201  PLAADYTRQA RRPFAATLTA TLAYTLTGCW MYALGLAAAL FTGETDVAKI

251  LLGAGLGITG ILAVVLSTVT TTFLDTYSAG ASANNISARF AEIPVAVGVT

301  LIRTVLAVML PVTEYKNFLL LIRSVFGPMA GGFDCRLFCL KTA*
```

Further work revealed the following gonococcal DNA sequence (SEQ ID NO: 807):

```
  1   ATGTCGGGCA ATGCCTCCTC TCCTTCATCT TCCGCCGCCA TCGGGCTGGT

51   TTGGTTCGGC GCGGCGGTAT CGATTGCCGA AATCAGCACG GGTACGCTGC
```

-continued

```
 101   TCGCCCCCTT GGGCTGGCAG CGCGGTCTGG CGGCCCTGCT TTTGGGTCAT
 151   GCCGTCGGCG GCGCGCTGTT TTTTGCGGCG GCGTATATCG GCGCACTGAC
 201   CGGACGCAGC TCGATGGAAA GTGTGCGCCT GTCGTTCGGC AAATGCGGTT
 251   CAGTGCTGTT TTCCGTGGCG AATATGCTGC AACTGGCCGG CTGGACGGCG
 301   GTGATGATTT ACGTCGGCGC AACGGTCAGC TCCGCTTTGG GCAAAGTGTT
 351   GTGGGACGGC GAATCCTTTG TCTGGTGGGC ATTGGCAAAC GGCGCACTGA
 401   TCGTGCTGTG GCTGGTTTTC GGCGCACGCA GAACGGGCGG GCTGAAAACC
 451   GTTTCGATGC TGCTGATGCT GCTTGCCGTG TTGTGGTTGA GCGTCGAAGT
 501   GTTCGCTTCG TCCGGCACAA ACGCCGCGCC CGCCGTTTCA GACGGCATGA
 551   CCTTCGGAAC GGCAGTCGAA CTGTCCGCCG TCATGCCGCT TTCCTGGCTG
 601   CCGCTGGCCG CCGACTACAC GCGCCAAGCA CGCCGCCCGT TGCGGCAAC
 651   CCTGACGGCA ACGCTCGCCT ATACGCTGAC GGGCTGCTGG ATGTATGCCT
 701   TGGGTTTGGC GGCGGCTCTG TTTACCGGAG AAACCGACGT GGCGAAAATC
 751   CTGTTGGGCG CGGGCTTGGG CATAACGGGC ATTCTGGCAG TCGTCCTCTC
 801   CACCGTTACC ACAACGTTTC TCGATACCTA TTCCGCCGGC GCGAGTGCGA
 851   ACAACATTTC CGCGCGTTTT GCGGAAATAC CCGTCGCTGT CGGCGTTACC
 901   CTGATCGGCA CGGTGCTTGC CGTCATGCTG CCCGTTACCG AATATAAAAA
 951   CTTCCTGCTG CTTATCGGCT CGGTATTTGC GCCGATGGCG GCGGTTTTGA
1001   TTGCCGACTT TTTCGTCTTA AAACGGCGTG AGGAGATTGA AGGCTTTGAC
1051   TTTGCCGGAC TGGTTCTGTG GCTGGCAGGC TTCATCCTCT ACCGCTTCCT
1101   GCTCTCGTCC GGTTGGGAAA GCAGCATCGG TCTGACCGCC CCCGTAATGT
1151   CTGCCGTTGC CATTGCCACC GTATCGGTAC GCCTTTTCTT TAAAAAAACC
1201   CAATCTTTAC AAAGGAACCC GTCATGA
```

This corresponds to the amino acid sequence (SEQ ID NO: 808; ORF125ng-1):

```
  1   MSGNASSPSS SAAIGLVWFG AAVSIAEIST GTLLAPLGWQ RGLAALLLGH
 51   AVGGALFFAA AYIGALTGRS SMESVRLSFG KCGSVLFSVA NMLQLAGWTA
101   VMIYVGATVS SALGKVLWDG ESFVWWALAN GALIVLWLVF GARRTGGLKT
151   VSMLLMLLAV LWLSVEVFAS SGTNAAPAVS DGMTFGTAVE LSAVMPLSWL
201   PLAADYTRQA RRPFAATLTA TLAYTLTGCW MYALGLAAAL FTGETDVAKI
251   LLGAGLGITG ILAVVLSTVT TTFLDTYSAG ASANNISARF AEIPVAVGVT
301   LIGTVLAVML PVTEYKNFLL LIGSVFAPMA AVLIADFFVL KRREEIEGFD
351   FAGLVLWLAG FILYRFLLSS GWESSIGLTA PVMSAVAIAT VSVRLFFKKT
401   QSLQRNPS*
```

ORF125ng-1 (SEQ ID NO: 808) and ORF125-1 (SEQ ID NO: 802) show 95.1% identity in 408 aa overlap:

```
                      10         20         30         40         50         60
orf125-1.pep   MSGNASSPSSSAIGLIWFGAAVSIAEISTGTLLAPLGWQRGLAALLLGHAVGGALFFAA
               ||||||||||:||||:||||||||||||||||||||||||||||||||||||||||||||
orf125ng-1     MSGNASSPSSSAAIGLVWFGAAVSIAEISTGTLLAPLGWQRGLAALLLGHAVGGALFFAA
                      10         20         30         40         50         60
```

```
                          -continued
                    70        80        90       100       110       120
orf125-1.pep    AYIGALTGRSSMESVRLSFGKRGSVLFSVANMLQLAGWTAVMIYAGATVSSALGKVLWDG
                |||||||||||||||||||||| |||||||||||||||||||||:||||||||||||||
orf125ng-1      AYIGALTGRSSMESVRLSFGKCGSVLFSVANMLQLAGWTAVMIYVGATVSSALGKVLWDG
                    70        80        90       100       110       120

130       140       150       160       170       179
orf125-1.pep    ESFVWWALANGALIVLWLVFGARKTGGLKTVSMLLMLLAVLWLSAEVFSTAGSTAAQ-VS
                |||||||||||||||||||||||:|||||||||||||||||||||:::|:::|| ||
orf125ng-1      ESFVWWALANGALIVLWLVFGARRTGGLKTVSMLLMLLAVLWLSVEVFASSGTNAAPAVS
                   130       140       150       160       170       180

180       190       200       210       220       230       239
orf125-1.pep    DGMSFGTAVELSAVMPLSWLPLAADYTRHARRPFAATLTATLAYTLTGCWMYALGLAAAL
                |||:||||||||||||||||||||||||:|||||||||||||||||||||||||||||||
orf125ng-1      DGMTFGTAVELSAVMPLSWLPLAADYTRQARRPFAATLTATLAYTLTGCWMYALGLAAAL
                    190       200       210       220       230       240

240       250       260       270       280       290       299
orf125-1.pep    FTGETDVAKILLGAGLGAAGILAVVLSTVTTTFLDAYSAGASANNISARFAETPVAVGVT
                ||||||||||||||||| :|||||||||||||||||:||||||||||||||||| |||||||
orf125ng-1      FTGETDVAKILLGAGLGITGILAVVLSTVTTTFLDTYSAGASANNISARFAEIPVAVGVT
                    250       260       270       280       290       300

300       310       320       330       340       350       359
orf125-1.pep    LIGTVLAVMLPVTEYENFLLLIGSVFAPMAAVLIADFFVLKRREEIEGFDFAGLVLWLAG
                ||||||||||||||:|||||||||||||||||||||||||||||||||||||||||||
orf125ng-1      LIGTVLAVMLPVTEYKNFLLLIGSVFAPMAAVLIADFFVLKRREEIEGFDFAGLVLWLAG
                    310       320       330       340       350       360

360       370       380       390       400
orf125-1.pep    FILYRFLLSSGWESSIGLTAPVMSAVAIATVSVRLFFKKTQSLQRNPSX
                |||||||||||||||||||||||||||||||||||||||||||||||
orf125ng-1      FILYRFLLSSGWESSIGLTAPVMSAVAIATVSVRLFFKKTQSLQRNPSX
                    370       380       390       400
```

Based on this analysis, including the presence of putative leader sequence and transmembrane domains in the gonococcal protein, it is predicted that the proteins from N.meningitidis and N.gonorrhoeae, and their epitopes, could be useful antigens for vaccines or diagnostics, or for raising antibodies.

Example 96

The following partial DNA sequence was identified in N.meningitidis (SEQ ID NO: 809):

```
  1 ATGACCCGTA TCGCCATCCT CGGCGGCGGC CTCTCGGGAA GGCTGACCGC
 51 GTTGCAGCTT GCAGAACAAG GTTATCAGAT TGCACTTTTC GATAAAAGCT
101 GCCGCCGGGG CGAACACGCC GCCGCCTATG TAGCCGCCGC CATGCTCGCG
151 CCTGCAGCGG A.ACGGTCGA AGCCACGCCC GAAGTGGTCA GGCTGGGCAG
201 GCAGAGCATC CCGCTTTGGC GCGGCATCCG ATGCCGTCTG AACACGCACA
251 CGATGATGCA GGAAAACGGC AGCCTGATTG TATGGCACGG GCAGGACAAG
301 CCATTATCCA GCGAGTTCGT CCGCCATCTC AAACGCGGCG GCGT.ACGGA
351 TGACGAAATC GTCCGTTGGC GCGCCGACGA CATCGCCGAA CGCGAACCGC
401 AACTCGGCGG ACGTTTTTAA GACGGCATCT ACCTGCCGAC CGAAGC.CAG
451 CTCGACGGGC GGCAATTATA GTCTGCACTT GCCGACGCTT TGGACGAACT
501 GAACGTCCCC TGCCATTGGG AACACGAATG CGTCCCCGAA GCCTGCAAG..
```

This corresponds to the amino acid sequence (SEQ ID NO: 810; ORF126):

```
  1 MTRLAILGGG LSGRLTALQL AEQGYQIALF DKSCRRGEHA AAYVAAAMLA
 51 PAAXTVEATP EVVRLGRQSI PLWRGIRCRL NTHTMMQENG SLIVWHGQDK
```

-continued

```
101 PLSSEFVRHL KRGGXTDDEI VRWRADDIAE REPQLGGRFX DGIYLPTEXQ

151 LDGRQLXSAL ADALDELNVP CHWEHECVPE ACK...
```

Further work revealed the complete nucleotide sequence (SEQ ID NO: 811):

```
   1 ATGACCCGTA TCGCCATCCT CGGCGGCGGC CTCTCGGGAA GGCTGACCGC

51 GTTGCAGCTT GCAGAACAAG GTTATCAGAT TGCACTTTTC GATAAAGGCT

101 GCCGCCGGGG CGAACACGCC GCCGCCTATG TTGCCGCCGC CATGCTCGCG

151 CCTGCGGCGG AAGCGGTCGA AGCCACGCCC GAAGTGGTCA GGCTGGGCAG

201 GCAGAGCATC CCGCTTTGGC GCGGCATCCG ATGCCGTCTG AACACGCACA

251 CGATGATGCA GGAAAACGGC AGCCTGATTG TGTGGCACGG GCAGGACAAG

301 CCATTATCCA GCGAGTTCGT CCGCCATCTC AAACGCGGCG GCGTAGCGGA

351 TGACGAAATC GTCCGTTGGC GCGCCGACGA CATCGCCGAA CGCGAACCGC

401 AACTCGGCGG ACGTTTTTCA GACGGCATCT ACCTGCCGAC CGAAGGCCAG

451 CTCGACGGGC GGCAAATATT GTCTGCACTT GCCGACGCTT TGGACGAACT

501 GAACGTCCCC TGCCATTGGG AACACGAATG CGTCCCCGAA GGCCTGCAAG

551 CCCAATACGA CTGGCTGATC GACTGCCGCG GCTACGGCGC AAAAACCGCG

601 TGGAACCAAT CCCCCGAGCA CACCAGCACC CTGCGCGGCA TACGCGGCGA

651 AGTGGCGCGG GTTTACACAC CCGAAATCAC GCTCAACCGC CCCGTGCGTC

701 TGCTCCATCC GCGTTATCCG CTCTACATCG CCCCGAAAGA AAACCACGTC

751 TTCGTCATCG GCGCGACCCA AATCGAAAGC GAAAGCCAAG CCCCCGCCAG

801 CGTGCGTTCA GGGTTGGAAC TCTTGTCCGC ACTCTATGCC ATCCACCCCG

851 CCTTCGGCGA AGCCGACATC CTCGAAATCG CCACCGGCCT GCGCCCCACG

901 CTCAACCACC ACAACCCCGA AATCCGTTAC AACCGCGCCC GACGCCTGAT

951 TGAAATCAAC GGCCTTTTCC GCCACGGTTT CATGATCTCC CCGCCGTAA

1001 CCGCCGCCGC CGCCAGATTG GCAGTGGCAC TGTTTGACGG AAAAGACGCG

1051 CCCGAACGCG ATAAAGAAAG CGGTTTGGCG TATATCCGAA GACAAGATTA

1101 A
```

This corresponds to the amino acid sequence (SEQ ID NO: 812; ORF126-1):

```
   1 MTRIAILGGG LSGRLTALQL AEQGYQIALF DKGCRRGEHA AAYVAAAMLA

51 PAAEAVEATP EVVRLGRQSI PLWRGIRCRL NTHTMMQENG SLIVWHGQDK

101 PLSSEFVRHL KRGGVADDEI VRWRADDIAE REPQLGGRFS DGIYLPTEGQ

151 LDGRQILSAL ADALDELNVP CHWEHECVPE GLQAQYDWLI DCRGYGAKTA

201 WNQSPEHTST LRGIRGEVAR VYTPEITLNR PVRLLHPRYP LYIAPKENHV

251 FVIGATQIES ESQAPASVRS GLELLSALYA IHPAFGEADI LEIATGLRPT

301 LNHHNPEIRY NRARRLIEIN GLFRHGFMIS PAVTAAAARL AVALFDGKDA

351 PERDKESGLA YIRRQD*
```

Computer analysis of this amino acid sequence gave the following results:
Homology with a Predicted ORF from *N.meningitidis* (Strain A)

ORF126 (SEQ ID NO: 810) shows 90.0% identity over a 180aa overlap with an ORF (ORF126a) (SEQ ID NO: 814) from strain A of *N. meningitidis*:

```
                    10         20         30         40         50         60
orf126.pep  MTRIAILGGGLSGRLTALQLAEQGYQIALFDKSCRRGEHAAAYVAAAMLAPAAXTVEATP
            ||||||||||||||||||||||||||||||:||||||||||||||||||||:|||||
orf126a     MTRIAILGGGLSGRLTALQLAEQGYQIALFDKGCRRGEHAAAYVAAAMLAPAAEAVEATP
                    10         20         30         40         50         60

70         80         90        100        110        120
orf126.pep  EVVRLGRQSIPLWRGIRCRLNTHTMMQENGSLIVWHGQDKPLSSEFVRHLKRGGXTDDEI
            |||||||| ||||||||||:|:| :|| ||||||||||||||||:||||||||| :|| |
orf126a     EVVRLGRQXIPLWRGIRCHLKTPAMMXENGSLIVWHGQDKPLSNEFVRHLKRGGVADDXI
                    70         80         90        100        110        120

130        140        150        160        170        180
orf126.pep  VRWRADDIAEREPQLGGRFXDGIYLPTEXQLDGRQLXSALADALDELNVPCHWEHECVPE
            |||||||||||||||||||| ||||||||| ||||||: |||||||||||||||||||:||
orf126a     VRWRADDIAEREPQLGGRFSDGIYLPTEGQLDGRQILSALADALDELNVPCHWEHECAPE
                   130        140        150        160        170        180
```

The complete length ORF126a nucleotide sequence (SEQ ID NO: 813) is:

```
   1  ATGACCCGTA TCGCCATCCT CGGCGGCGGC CTCTCNGGAA GGCTGACCGC
  51  ACTGCAGCTT GCAGAACAAG GTTATCAGAT TGCACTTTTC GATAAAGGCT
 101  GCCGCCGGGG CGAACACGCC GCCGCCTATG TTGCCGCCGC CATGCTCGCG
 151  CCTGCGGCGG AAGCGGTCGA AGCCACGCCT GAAGTGGTCA GGCTGGGCAG
 201  GCAGANCATC CCGCTTTGGC GCGGCATCCG ATGCCATCTG AAAACGCCTG
 251  CCATGATGCA NGAAAACGGC AGCCTGATTG TGTGGCACGG GCAGGACAAA
 301  CCTTTATCCA ACGAGTTCGT CCGCCATCTC AAACGCGGCG GCGTAGCGGA
 351  TGACNAAATC GTCCGTTGGC GCGCCGACGA CATCGCCGAA CGCGAACCGC
 401  AACTCGGCGG ACGTTTTTCA GACGGCATCT ACCTGCCGAC CGAAGGCCAG
 451  CTCCACGGGC GGCAAATATT GTCTGCACTT GCCGACGCTT TGGACGAACT
 501  GAACGTCCCC TGCCATTGGG AACACGAATG TGCCCCCGAA GACTTGCAAG
 551  CCCAATACGA CTGGCTGATC GACTGCCGCG GCTACGGCGC AAAAACCGCG
 601  TGGAACCAAT CCCCCGANNA NACCAGCACC CTGCGCGGCA TACGCGGCGA
 651  AGTGGCGCGG GTTTACACAC CCGAAATCAC GCTCAACCGC CCCGTGCGCC
 701  TGCTACACCC GCGCTATCCG CTNTACATCG CCCCGAAAGA AAACCNCGTC
 751  TTCGTCATCG GCGCGACCCA AATCGAAAGC GAAAGCCAAG CACCTGCCAG
 801  CGTGCGTTCC GGGCTGGAAC TCTTATCCGC ACTCTATGCC GTCCACCCCG
 851  CCTTCGGCGA AGCCGACATC CTCGAAATCG CCACCGGCCT GCGCCCCACG
 901  CTCAATCACC ACAACCCCGA AATCCGTTAC AACCGCGCCC GACGCCTGAT
 951  TGAAATCAAC GGCCTTTTCC GCCACGGTTT CATGATCTCC CCCGCCGTAA
1001  CCGCCGCCGC CGTCAGATTG GCAGTGGCAC TGTTTGACGG AAAAGANGCG
1051  CCCGAACGCG ATGAAGAAAG CGGTTTGGCG TATATCCGAA GACAAGATTA
1101  A
```

This encodes a protein having amino acid sequence (SEQ ID NO: 814):

```
  1 MTRIAILGGG LSGRLTALQL AEQGYQIALF DKGCRRGEHA AAYVAAAMLA

51 PAEEAVEATP EVVRLGRQXI PLWRGIRCHL KTPAMMXENG SLIVWHGQDK

101 PLSNEFVRHL KRGGVADDXI VRWRADDIAE REPQLGGRFS DGIYLPTEGQ

151 LDGRQILSAL ADALDELNVP CHWEHECAPE DLQAQYDWLI DCRGYGAKTA

201 WNQSPXXTST LRGIRGEVAR VYTPEITLNR PVRLLHPRYP LYIAPKENXV

251 FVIGATQIES ESQAPASVRS GLELLSALYA VHPAFGEADI LEIATGLRPT

301 LNHHNPEIRY NRARRLIEIN GLFRHGFMIS PAVTAAAVRL AVALFDGKXA

351 PERDEESGLA YIRRQD*
```

ORF126a (SEQ ID NO: 814) and ORF126-1 (SEQ ID NO: 812) show 95.4% identity in 366 aa overlap:

```
                    10         20         30         40         50         60
orf126a.pep MTRIAILGGGLSGRLTALQLAEQGYQIALFDKGCRRGEHAAAYVAAAMLAPAAEAVEATP
            |||||| ||||||||||||||||||||||||||||||||||||||||||||||||||||
orf126-1    MTRIATLGGGLSGRLTALQLAEQGYQIALFDKGCRRGEHAAAYVAAAMLAPAAEAVEATP
                    10         20         30         40         50         60

70         80         90        100        110        120
orf126a.pep EVVRLGRQXIPLWRGIRCHLKTPAMMXENGSLIVWHGQDKPLSNEFVRHLKRGGVADDXI
            |||||||| |||||||||||:|:| :|| ||||||||||||||:||||||||||||| |
orf126-1    EVVRLGRQSIPLWRGIRCRLNTHTMMQENGSLIVWHGQDKPLSSEFVRHLKRGGVADDEI
                    70         80         90        100        110        120

130        140        150        160        170        180
orf126a.pep VRWRADDIAEREPQLGGRFSDGIYLPTEGQLDGRQILSALADALDELNVPCHWEHECAPE
            |||||||||||||||||||||||||||||||||||||||||||||||||||||||||:||
orf126-1    VRWRADDIAEREPQLGGRFSDGIYLPTEGQLDGRQILSALADALDELNVPCHWEHECVPE
                   130        140        150        160        170        180

190        200        210        220        230        240
orf126a.pep DLQAQYDWLIDCRGYGAKTAWNQSPXXTSTLRGIRGEVARVYTPEITLNRPVRLLHPRYP
             |||||||||||||||||||||||  |||||||||||||||||||||||||||||||||
orf126-1    GLQAQYDWLIDCRGYGAKTAWNQSPEHTSTLRGIRGEVARVYTPEITLNRPVRLLHPRYP
                   190        200        210        220        230        240

250        260        270        280        290        300
orf126a.pep LYIAPKENXVFVIGATQIESESQAPASVRSGLELLSALYAVHPAFGEADILEIATGLRPT
            ||||||||| ||||||||||||||||||||||||||||||:|||||||||||||||||||
orf126-1    LYIAPKENHVFVIGATQIESESQAPASVRSGLELLSALYAIHPAFGEADILEIATGLRPT
                   250        260        270        280        290        300

310        320        330        340        350        360
orf126a.pep LNHHNPEIRYNRARRLIEINGLFRHGFMISPAVTAAAVRLAVALFDGKXAPERDEESGLA
            ||||||||||||||||||||||||||||||||||||:|||||||||| ||||:|||||
orf126-1    LNHHNPEIRYNRARRLIEINGLFRHGFMISPAVTAAAARLAVALFDGKDAPERDKESGLA
                   310        320        330        340        350        360 orf126a.pep YIRRQDX
            |||||||
orf126-1    YIRRQDX
```

55

Homology with a Predicted ORF from *N.gonorrhoeae*

ORF126 (SEQ ID NO: 810) shows 90% identity over a 180 aa overlap with a Predicted ORF (ORF126ng) (SEQ ID NO: 816) from *N.gonorrhoeae*:

```
orf126.pep  MTRIAILGGGLSGRLTALQLAEQGYQIALFDKSCRRGEHAAAYVAAAMLAPAAXTVEATP  60
            |||||:|||||||||||||||||||||| ||||: |:|||||||||||||||| :|||||
orf126ng    MTRIAVLGGGLSGRLTALQLAEQGYQIELFDKGTRQGERAAAYVAAAMLAPAAEAVEATP  60
```

```
                   -continued
orf126.pep  EVVRLGRQSIPLWRGIRCRLNTHTMMQENGSLIVWHGQDKPLSSEEVRHLKRGGXTDDEI  120
            ||:||||||||||||||||| ||||||||||||||||||||||||||||||||| :||||
orf126ng    EVIRLGRQSIPLWRGTRCRLNTLTMMQENGSLIVWHGQDKPLSSEFVRHLKRGGVADDEI  120 orf126.pep  VRWRADDIAEREPQLGGRFXDGIYLPTEXQLDGRQLXSALADALDELNVPCHWEHECVPE   180
            ||||||:||||||||||| ||||||||| ||||||: |||||||||||||||||||||:
orf126ng    VRWRADEIAEREPQLGGRFSDGIYLPTEGQLDGRQILSALADALDELNVPCHWEHECAPQ   180
```

An ORF126ng nucleotide sequence (SEQ ID NO: 815) was predicted to encode a protein having amino acid sequence (SEQ ID NO: 816):

```
  1  MTRIAVLGGG LSGRLTALQL AEQGYQIELF DKGTRQGEHA AAYVAAAMLA
 51  PAAEAVEATP EVIRLGRQSI PLWRGIRCRL NTLTMMQENG SLIVWHGQDK
101  PLSSEFVRHL KRGGVADDEI VRWRADEIAE REPQLGGRFS DGIYLPTEGQ
151  LDGRQILSAL ADALDELNVP CHWEHECAPQ DLQAQYDWVI DCRGYGAKTA
201  WNQSPEHTST LRGIRGEVRG FTRPKSRSTA PCACCTRAIR STSPRKKTTS
251  SSSARPKSKA KAKPPPAYVP GWNSYPRSMP STPPSAKPTS SKWRPGLRPT
301  LNHHNPEIRY SRERRLIEIN GLFRHGFMIS PAVTAAAVRL AVALFDGKDA
351  PERDEESGLA YIGRQD*
```

Further work revealed the following gonococcal DNA sequence (SEQ ID NO: 817):

```
   1  ATGACCCGTA TCGCCGTCCT CGGAGGCGGC CTTTCCGGAA GGCTGACCGC
  51  ATTGCAGCTT GCAGAACAAG GTTATCAGAT TGAACTTTTC GACAAGGGCA
 101  CCCGCCAAGG CGAACACGCC GCCGCCTATG TTGCCGCCGC GATGCTCGCG
 151  CCTGCGGCGG AAGCGGTCGA GGCAACGCCC GAAGTCATCA GGCTGGGCAG
 201  GCAGAGCATT CCGCTTTGGC GCGGCATCCG ATGCCGTCTG AACACGCTCA
 251  CGATGATGCA GGAAAACGGC AGCCTGATTG TGTGGCACGG GCAGGACAAG
 301  CCATTATCCA GCGAGTTCGT CCGCCATCTC AAACGCGGCG GCGTAGCGGA
 351  TGACGAAATC GTCCGTTGGC GCGCCGATGA AATCGCCGAA CGCGAACCGC
 401  AACTCGGCGG ACGTTTTTCA GACGGCATCT ACCTGCCGAC CGAAGGCCAG
 451  CTCGACGGGC GGCAAATATT GTCTGCACTT GCCGACGCTT TGGACGAACT
 501  GAACGTCCCT TGCCATTGGG AACACGAATG CGCCCCCCAA GACCTGCAAG
 551  CCCAATACGA CTGGGTAATC GACTGCCGGG GCTACGGCGC GAAAACCGCG
 601  TGGAACCAAT CCCCCGAGCA CACCAGCACC TTGCGCGGCA TACGCGGCGA
 651  AGTGGCGCGG GTTTACACGC CCGAAATCAC GCTCAACCGC CCCGTGCGCC
 701  TGCTGCACCC GCGCTATCCG CTCTACATCG CCCCGAAAGA AAACCACGTC
 751  TTCGTCATCG GCGCGACCCA AATCGAAAGC GAAAGCCAAG CCCCCGCCAG
 801  CGTACGTTCC GGGCTGGAAC TCTTATCCGC GCTCTATGCC GTCCACCCCG
 851  CCTTCGGCGA AGCCGACATC CTCGAAATCG CCGCCGGCCT GCGCCCCACG
 901  CTCAACCACC ACAACCCCGA AATCCGCTAC AGCCGCGAAC GCCGCCTCAT
 951  CGAAATCAAC GGCCTTTTCC GGCACGGCTT TATGATTTCC CCCGCCGTAA
1001  CCGCCGCCGC CGTCAGATTG GCAGTGGCAC TGTTTGACGG AAAAGACGCG
```

-continued

```
1051  CCCGAACGTG ATGAAGAAAG CGGTTTGGCG TATATCGGAA GACAAGATTA

1101  A
```

This corresponds to the amino acid sequence (SEQ ID NO: 818; ORF126ng-1):

```
  1  MTRIAVLGGG LSGRLTALQL AEQGYQIELF DKGTRQGEHA AAYVAAAMLA

51  PAAEAVEATP EVIRLGRQSI PLWRGIRCRL NTLTMMQENG SLIVWHGQDK

101  PLSSEFVRHL KRGGVADDEI VRWRADEIAE REPQLGGRFS DGIYLPTEGQ

151  LDGRQILSAL ADALDELNVP CHWEHECAPQ DLQAQYDWVI DCRGYGAKTA

201  WNQSPEHTST LRGIRGEVAR VYTPEITLNR PVRLLHPRYP LYIAPKENHV

251  FVIGATQIES ESQAPASVRS GLELLSALYA VHPAFGEADI LEIAAGLRPT

301  LNHHNPEIRY SRERRLIEIN GLFRHGFMIS PAVTAAAVRL AVALFDGKDA

351  PERDEESGLA YIGRQD*
```

ORF126ng-1 (SEQ ID NO: 818) and ORF126-1 (SEQ ID NO: 812) show 95.1% identity in 366 aa overlap:

```
                    10         20         30         40         50         60
orf126-1.pep  MTRIAILGGGLSGRLTALQLAEQGYQIALFDKGCRRGEHAAAYVAAAMLAPAAEAVEATP
              |||||:||||||||||||||||||||| ||||| |:||||||||||||||||||||||||
orf126ng-1    MTRIAVLGGGLSGRLTALQLAEQGYQIELFDKGTRQGEHAAAYVAAAMLAPAAEAVEATP
                    10         20         30         40         50         60

70         80         90        100        110        120
orf126-1.pep  EVVRLGRQSIPLWRGIRCRLNTHTMMQENGSLIVWHGQDKPLSSEFVRHLKRGGVADDEI
              ||:|||||||||||||||||||| ||||||||||||||||||||||||||||||||||||
orf126ng-1    EVIRLGRQSIPLWRGIRCRLNTLTMMQENGSLIVWHGQDKPLSSEFVRHLKRGGVADDEI
                    70         80         90        100        110        120

130        140        150        160        170        180
orf126-1.pep  VRWRADDIAEREPQLGGRFSDGIYLPTEGQLDGRQILSALADALDELNVPCHWEHECVPE
              ||||||:|||||||||||||||||||||||||||||||||||||||||||||||||||:|:
orf126ng-1    VRWRADEIAEREPQLGGRFSDGIYLPTEGQLDGRQILSALADALDELNVPCHWEHECAPQ
                   130        140        150        160        170        180

190        200        210        220        230        240
orf126-1.pep  GLQAQYDWLIDCRGYGAKTAWNQSPEHTSTLRGIRGEVARVYTPEITLNRPVRLLHPRYP
              ||||||:|||||||||||||||||||||||||||||||||||||||||||||||||||||
orf126ng-1    DLQAQYDWVIDCRGYGAKTAWNQSPEHTSTLRGIRGEVARVYTPEITLNRPVRLLHPRYP
                   190        200        210        220        230        240

250        260        270        280        290        300
orf126-1.pep  LYIAPKENHVFVIGATQIESESQAPASVRSGLELLSALYAIHPAFGEADILEIATGLRPT
              ||||||||||||||||||||||||||||||||||||||||:|||||||||||||:|||||
orf126ng-1    LYIAPKENHVFVIGATQIESESQAPASVRSGLELLSALYAVHPAFGEADILEIAAGLRPT
                   250        260        270        280        290        300

310        320        330        340        350        360
orf126-1.pep  LNHHNPEIRYNRARRLIEINGLFRHGFMISPAVTAAAARLAVALFDGKDAPERDKESGLA
              ||||||||||:| |||||||||||||||||||||||||:|||||||||||||||:|||||
orf126ng-1    LNHHNPEIRYSRERRLIEINGLFRHGFMISPAVTAAAVRLAVALFDGKDAPERDEESGLA
                   310        320        330        340        350        360 orf126-1.pep  YIRRQDX
              || ||||
orf126ng-1    YIGRQDX
```

Furthermore, ORF126ng-1 (SEQ ID NO: 818) shows homology to a putative Rhizobium oxidase flavoprotein (SEQ ID NO: 1163):

```
gi|2627327 (AF004408) putative amino acid oxidase flavoprotein [Rhizobium etli]
Length = 327
Score = 169 bits (423), Expect = 3e-41
Identities = 112/329 (34%), Positives = 163/329 (49%), Gaps = 25/329 (7%)

Query:    3 RIAVLGGGLSGKLTALQLAEQGYQIELFDKGTRQGEHXXXXXXXXXXXXXXXXXXXXXXX   62
            RI V G G++G   A QL    G+++ L ++    G
Sbjct:    2 RILVNGAGVAGLTVAWQLYRHGFRVTLAERAGTVGA-GASGFAGGMLAPWCERESAEEPV  60

Query:   63 IRLGRQSIPLWRGIRCRLNTLTMMQENGSLIVWHGQDKPLSSEFVRHLKRGGVADDEIVR  122
            +LGR +   W             +   G+L+V G+D      F R   G    DE+
Sbjct:   61 LTLGRLAADWWEAA-----LPGHVHRRGTLVVAGGRDTGELDRFSRRTS-GWEWLDEVA- 113

Query:  123 WRADEIAEREPQLGGRFSDGIYLPTEGQLDGRQILSALADALDELNVPCHWEHECAPQDL  182
                  IA  EP L GRF    ++   E  LD RQ L+ALA  L++  +            +
Sbjct:  114 -----IAALEPDLAGRFRRALFFRQEAHLDPRQALAALAAGLEDARMRLTLG---VVGES  165

Query:  183 QAQYDWVIDCRGYGAKTAWNQSPEHTSTLRGIRGEVARVYTPEITLNRPVRLLHPRYPLY  242
              +D V+DC G              LRG+RGE+  V T E++L+RPVRLLHPR+P+Y
Sbjct:  166 DVDHDRVVDCTGAA-------QIGRLPGLRGVRGEMLCVETTEVSLSRPVRLLHPRHPIY  218

Query:  243 IAPKENHVFVIGATQIESESQAPASVRSGLELLSALYAVHPAFGEADILEIAAGLRPTLN  302
            I P++  + F++GAT IES+    P +RS +ELL+A YA+HPAFGEA +E   AG+RP
Sbjct:  219 IVPRDKNRFMVGATMIESDDGGPITARSLMELLNAAYAMHPAFGEARVTETGAGVRPAYP  278

Query:  303 HHNPEIRYSRERRLIEINGLFRHGFMISP                                331
            + P  R ++E R +  +NGL+RHGF+++P
Sbjct:  279 DNLP--RVTQEGRTLHVNGLYRHGFLLAP                                305
```

This analysis suggests that the proteins from *N.meningitidis* and *N.gonorrhoeae*, and their epitopes, could be useful antigens for vaccines or diagnostics, or for raising antibodies.

Example 97

The following DNA sequence, believed to be complete, was identified in *N.meningitidis* (SEQ ID NO: 819):

```
  1  ATGACTGATA ATCGGGGGTT TACGCTGGTT GAATTAATAT CAGTGGTCTT
 51  GATATTGTCT GTACTTGCTT TAATTGTTTA TCCGAGCTAT CGCAATTATG
101  TTGAGAAAGC AAAGATAAAT GCAGTGCGGG CAGCCTTGTT AGAAAATGCA
151  CATTTTATGG AAAAGTTTTA TCTGCAGAAT GGGAGGTTTA AACAAACATC
201  TACCAAGTGG CCAAGTTTGC CGATTAAAGA GGCAGAAGGC TTTTGTATCC
251  GTTTGAATGG AATCGtCGCG CGGG..GCTT TAGACAGTAA ATTCATGTTG
301  AAGGCGGTAG CCATAGATAA AGATAAAAAT CCTTTTATTA TTAAGATGAA
351  TGAAAATCTA GTAACCTTTA aTTTGCAAGA AGTCCGCCAG TTCGTGTAGT
401  GACGGGCTGG ATTATTTTAA AGGAAATGAT AAGGACTGCA AGTTACTTAA
451  GTAG
```

This corresponds to the amino acid sequence (SEQ ID NO: 820; ORF127):

```
  1  MTDNRGFTLV ELISVVLILS VLALIVYPSY RNYVEKAKIN AVRAALLENA
 51  HFMEKFYLQN GRFKQTSTKW PSLPIKEAEG FCIRLNGIVA RXALDSKFML
101  KAVAIDKDKN PFIIKMNENL VTFICKKSAS SCSDGLDYFK GNDKDCKLLK
151  *
```

Further work revealed the following DNA sequence (SEQ ID NO: 821):

```
  1    ATGACTGATA ATCGGGGGTT TACGCTGGTT GAATTAATAT CAGTGGTCTT
 51    GATATTGTCT GTACTTGCTT TAATTGTTTA TCCGAGCTAT CGCAATTATG
101    TTGAGAAAGC AAAGATAAAT GCAGTGCGGG CAGCCTTGTT AGAAAATGCA
151    CATTTTATGG AAAAGTTTTA TCTGCAGAAT GGGAGGTTTA AACAAACATC
201    TACCAAGTGG CCAAGTTTGC CGATTAAAGA GGCAGAAGGC TTTTGTATCC
251    GTTTGAATGG AATCGCGCGC GGGGCTTTAG ACAGTAAATT CATGTTGAAG
301    GCGGTAGCCA TAGATAAAGA TAAAAATCCT TTTATTATTA AGATGAATGA
351    AAATCTAGTA ACCTTTATTT GCAAGAAGTC CGCCAGTTCG TGTAGTGACG
401    GGCTGGATTA TTTTAAAGGA AATGATAAGG ACTGCAAGTT ACTTAAGTAG
```

The corresponds to the amino acid sequence (SEQ ID NO: 822; ORF127-1):

```
  1    MTDNRGFTLV ELISVVLILS VLALIVYPSY RNYVEKAKIN AVRAALLENA
 51    HFMEKFYLQN GRFKQTSTKW PSLPIKEAEG FCIRLNGIAR GALDSKFMLK
101    AVAIDKDKNP FIIKMNENLV TFICKKSASS CSDGLDYFKG NDKDCKLLK*
```

Computer analysis of this amino acid sequence gave the following results:
Homology with a Predicted ORF from *N.meningitidis* (Strain A)

ORF127 (SEQ ID NO: 820) shows 98.0% identity over a 150aa overlap with an ORF (ORF127a) (SEQ ID NO: 824) from strain A of *N. meningitidis*:

```
                      10         20         30         40         50         60
orf127.pep   MTDNRGFTLVELISVVLILSVLALIVYPSYRNYVEKAKINAVRAALLENAHFMEKFYLQN
             |||||||||||||||||||||||||||||||||||||||:||||||||||||||||||||
orf127a      MTDNRGFTLVELISVVLILSVLALIVYPSYRNYVEKAKINTVRAALLENAHFMEKFYLQN
                      10         20         30         40         50         60

70         80         90        100        110        120
orf127.pep   GRFKQTSTKWPSLPIKEAEGFCIRLNGIVARXALDSKFMLKAVAIDKDKNPFIIKMNENL
             ||||||||||||||||||||||||||||||| || |||||||||||||||||||||||||
orf127a      GRFKQTSTKWPSLPIKEAEGFCIRLNGI-ARGALDSKFMLKAVAIDKDKNPFIIKMNENL
                      70         80         90        100        110

130        140        150
orf127.pep   VTFICKKSASSCSDGLDYFKGNDKDCKLLKX
             ||||||||||||||||||||||||||||||
orf127a      VTFICKKSASSCSDGLDYFKGNDKDCKLLKX
                 120        130        140        150
```

The complete length ORF127a nucleotide sequence (SEQ ID NO: 823) is:

```
  1    ATGACTGATA ATCGGGGGTT TACGCTGGTT GAATTAATAT CAGTGGTCTT
 51    GATATTGTCT GTACTTGCTT TAATTGTTTA TCCGAGCTAT CGCAATTATG
101    TTGAGAAAGC AAAGATAAAT ACAGTGCGGG CAGCCTTGTT AGAAAATGCA
151    CATTTTATGG AAAAGTTTTA TCTGCAGAAT GGGAGATTTA AACAAACATC
201    TACCAAATGG CCAAGTTTGC CGATTAAAGA GGCAGAAGGC TTTTGTATCC
251    GTTTGAATGG AATCGCGCGC GGGGCCTTAG ACAGTAAATT CATGTTGAAG
```

-continued

```
301    GCGGTAGCCA TAGATAAAGA TAAAAATCCT TTTATTATTA AGATGAATGA

351    AAATCTAGTA ACCTTTATTT GCAAGAAGTC CGCCAGTTCG TGTAGTGACG

401    GGCTGGATTA TTTTAAAGGA AATGATAAGG ACTGCAAGTT ACTTAAGTAG
```

This encodes a protein having amino acid sequence (SEQ ID NO: 824):

```
  1    MTDNRGFTLV ELISVVLILS VLALIVYPSY RNYVEKAKIN TVRAALLENA

51    HFMEKFYLQN GRFKQTSTKW PSLPIKEAEG FCIRLNGIAR GALDSKFMLK

101    AVAIDKDKNP FIIKMNENLV TFICKKSASS CSDGLDYFKG NDKDCKLLK*
```

ORF127a (SEQ ID NO: 824) and ORF127-1 (SEQ ID NO: 822) show 99.3% identity in 149 aa overlap:

```
                  10        20        30        40        50        60
orf127.pep  MTDNRGFTLVELISVVLILSVLALIVYPSYRNYPEKAKINTVRAALLENAHFMEKFYLQN
            ||||||||||||||||||||||||||||||||||:|||||||||||||||||||||||||
orf127-1    MTDNRGFTLVELISVVLILSVLALIVYPSYRNYVEKAKINAVRAALLENAHFMEKFYLQN
                  10        20        30        40        50        60

70        80        90       100       110       120
orf127.pep  GRFKQTSTKWPSLPIKEAEGFCIRLNGIARGALDSKFMLKAVAIDKDKNPFIIKMNENLV
            ||||||||||||||||||||||||||||||||||||||||||||||||||||||||||||
orf127-1    GRFKQTSTKWPSLPIKEAEGFCIRLNGIARGALDSKFMLKAVAIDKDKNPFIIKMNENLV
                  70        80        90       100       110       120

130       140       150
orf127.pep  TFICKKSASSCSDGLDYFKGNDKDCKLLKX
            |||||||||||||||||||||||||||||
orf127-1    TFICKKSASSCSDGLDYFKGNDKDCKLLKX
                 130       140       150
```

Homology with a Predicted ORF from *N.gonorrhoeae*

ORF120 (SEQ ID NO: 820) shows 97.3% identity over a 150 aa overlap with a Predicted ORF (ORF127ng) (SEQ ID NO: 826) from *N.gonorrhoeae*:

```
orf127.pep  MTDNRGFTLVELISVVLILSVLALIVYPSYRNYVEKAKINAVRAALLENAHFMEKFYLQN   60
            |||||||||||||||||||||||||||||||||||||||||:||||||||||||||||||
orf127ng    MTDNRGFTLVELISVVLILSVLALIVYPSYRNYVEKAKINAVRAAFLENAHFMEKFYLQN   60 orf127.pep  GRFKQTSTKWPSLPIKEAEGFCIRLNGIVARXALDSKFMLKAVAIDKDKNPFIIKMNENL  120
            |||||||||||||||||||||||||||| || |||||||||||||||||||||||||||
orf127ng    GRFKQTSTKWPSLPIKEAEGFCIRLNGI-ARGALDSKFMLKAVAIDKDKNPFIIKMNENL  119 orf127.pep  VTFICKKSASSCSDGLDYFKGNDKDCKLLK                                150
            |||||||||||| ||||||||||||||||
orf127ng    VTFICKKSASSCSDRLDYFKGNDKDCKLLK                                149
```

The complete length ORF127ng nucleotide sequence (SEQ ID NO: 825) is:

```
  1    ATGACTGATA ATCGGGGGTT TACACTGGTT GAATTAATAT CAGTGGTCTT

51    GATATTGTCT GTACTTGCTT TAATTGTTTA TCCGAGCTAT CGCAATTATG

101    TTGAGAAAGC AAAGATAAAT GCAGTGCGGG CAGCCTTGTT AGAAAATGCA

151    CATTTTATGG AAAAGTTTTA TCTGCAGAAT GGGAGATTTA AACAAACATC

201    TACCAAATGG CCAAGTTTGC CGATTAAAGA GGCAGAAGGC TTTTGTATCC
```

-continued

```
251  GTTTGAATGG AATCGCGCGC GGGGCTTTAG ACAGTAAATT CATGTTGAAG

301  GCGGTAGCCA TAGATAAAGA TAAAAATCCT TTTATTATTA AGATGAATGA

351  AAATCTAGTA ACCTTTATTT GCAAGAAGTC CGCCAGTTCG TGTAGTGACG

401  GGCTGGATTA TTTTAAAGGA AATGATAAGG ACTGCAAGTT ACTTAAGTAG
```

This encodes a protein having amino acid sequence (SEQ ID NO: 826):

```
  1  MTDNRGFTLV ELISVVLILS VLALIVYPSY RNYVEKAKIN AVRAAFLENA

51  HFMEKFYLQN GRFKQTSTKW PSLPIKEAEG FCIRLNGIAR GALDSKFMLK

101  AVAIDKDKNP FIIKMNENLV TFICKKSASS CSDRLDYFKG NDKDCKLLK*
```

ORF127ng (SEQ IQ ID NO: 826) and ORF127-1 (SEQ ID NO: 822) show 100.0% identity in 149 aa overlap:

```
                    10        20        30        40        50        60
orf127-1.pep   MTDNRGFTLVELISVVLILSVLALIVYPSYRNYVEKAKINAVRAALLENAHFMEKFYLQN
               ||||||||||||||||||||||||||||||||||||||||||||||||||||||||||||
orf127ng-1     MTDNRGFTLVELISVVLILSVLALIVYPSYRNYVEKAKINAVRAALLENAHFMEKFYLQN
                    10        20        30        40        50        60

70        80        90       100       110       120
orf127-1.pep   GRFKQTSTKWPSLPIKEAEGFCIRLNGIARGALDSKFMLKAVAIDKDKNPFIIKMNENLV
               ||||||||||||||||||||||||||||||||||||||||||||||||||||||||||||
orf127ng-1     GRFKQTSTKWPSLPIKEAEGFCIRLNGIARGALDSKFMLKAVAIDKDKNPFIIKMNENLV
                    70        80        90       100       110       120

130       140       150
orf127-1.pep   TFICKKSASSCSDGLDYFKGNDKDCKLLKX
               |||||||||||||||||||||||||||||
orf127ng-1     TFICKKSASSCSDGLDYFKGNDKDCKLLKX
                   130       140       150
```

This analysis, including the fact that the predicted transmembrane domain is shared by the meningococcal and gonococcal proteins, suggests that the proteins from *N.meningitidis* and *N.gonorrhoeae*, and their epitopes, could be useful antigens for vaccines or diagnostics, or for raising antibodies.

Example 98

The following partial DNA sequence was identified in *N.meningitidis* (SEQ ID NO: 827)

```
  1  ..GTGTCGCTGG CTTCGGTGAT TGCCTCTCAA ATCTTCCTTT ACGAAGATTT

51  CAACCAAATG CGGAAAACCC GTGGAGCTAT CTGCGGTTTT CTTGTCCAAT

101  ATTTATCTGG GGTTTCAGCA GGGGTATTTC GATTTGAGTG CCGACGAGAA

151  CCCCGTACTG CATATCTGGT CTTTGGCAGT AGAGGAACAG TATTACCTCC

201  TGTATCCCCT TTTGCTGATA TTTTGCTGCA AAAAACCAA ATCGCTACGG

251  GTGCTGCGTA ACATCAGCAT CATCCTGTTT TTGATTTTGA CTGCCTCATC

301  GTTTTTGCCA AGCGGGTTTT ATACCGACAT CCTCAACCAA CCCAATACTT

351  ATTACCTTTC GACACTGAGG TTTCCCGAGC TGTTGGCAGG TTCGCTGCTG

401  GCGGTTTACG GGCAAACGCA AAACGGCAGA CGGCAAACAG CAAATGGAAA

451  ACGGCAGTTG CTTTCATCAC TCTGCTTCGG CGCATTGCTT GCCTGCCTGT

501  TCGTGATTGA CAAACACAAT CCGTTTATCC CGGGAATGAC CCTGCTCCTT
```

-continued
```
551  CCCTGCCTGC TGACGGCACT GCTTATCCGG AGTATGCAAT ACGGGACACT
601  TCCGACCCGC ATCCTGTCGG CAAGCCCCAT CGTATTTGTC GGCAAAATCT
651  CTTATTCCCT ATACCTGTAC CATTGGATTT TTATTGCTTT CGCTCCGCTC
701  ATTAGAGGCG GGAAACAGCT CGGACTGCCT GCCG..
```

This corresponds to the amino acid sequence (SEQ ID NO: 828; ORF128):

```
  1  ..VSLASVIASQ IFLYEDFNQM RKTVELSAVF LSNIYLGFQQ GYFDLSADEN
 51  PVLHIWSLAV EEQYYLLYPL LLIFCCKKTK SLRVLRNISI ILFLILTASS
101  FLPSGFYTDI LNQPNTYYLS TLRFPELLAG SLLAVYGQTQ NGRRQTANGK
151  RQLLSSLCFG ALLACLFVID KHNPFIPGMT LLLPCLLTAL LIRSMQYGTL
201  PTRILSASPI VFVGKISYSL YLYHWIFIAF APLIRGGKQL GLPA..
```

Further work revealed the complete nucleotide sequence (SEQ ID NO: 829):

```
   1 ATGCAAGCTG TCCGATACAG ACCGGAAATT GACGGATTGC GGGCCGTCGC
  51 CGTGCTATCC GTCATGATTT TCCACCTGAA TAACCGCTGG CTGCCCGGAG
 101 GATTCCTGGG GGTGGACATT TTCTTTGTCA TCTCAGGATT CCTCATTACC
 151 GGCATCATTC TTTCTGAAAT ACAGAACGGT TCTTTTTCTT TCCGGGATTT
 201 TTATACCCGC AGGATTAAGC GGATTTATCC TGCCTTTATT GGGGCCGTGT
 251 CGCTGGCTTC GGTGATTGCC TCTCAAATCT TCCTTTACGA AGATTTCAAC
 301 CAAATGCGGA AAACCGTGGA GCTTTCTGCG GTTTTCTTGT CCAATATTTA
 351 TCTGGGGTTT CAGCAGGGGT ATTTCGATTT GAGTGCCGAC GAGAACCCCG
 401 TACTGCATAT CTGGTCTTTG GCAGTAGAGG AACAGTATTA CCTCCTGTAT
 451 CCCCTTTTGC TGATATTTTG CTGCAAAAAA ACCAAATCGC TACGGGTGCT
 501 GCGTAACATC AGCATCATCC TGTTTTTGAT TTTGACTGCC TCATCGTTTT
 551 TGCCAAGCGG GTTTTATACC GACATCCTCA ACCAACCCAA TACTTATTAC
 601 CTTTCGACAC TGAGGTTTCC CGAGCTGTTG GCAGGTTCGC TGCTGGCGGT
 651 TTACGGGCAA ACGCAAAACG GCAGACGGCA AACAGCAAAT GGAAAACGGC
 701 AGTTGCTTTC ATCACTCTGC TTCGGCGCAT TGCTTGCCTG CCTGTTCGTG
 751 ATTGACAAAC ACAATCCGTT TATCCCGGGA ATGACCCTGC TCCTTCCCTG
 801 CCTGCTGACG GCACTGCTTA TCCGGAGTAT GCAATACGGG ACACTTCCGA
 851 CCCGCATCCT GTCGGCAAGC CCCATCGTAT TTGTCGGCAA AATCTCTTAT
 901 TCCCTATACC TGTACCATTG GATTTTTATT GCTTTCGCCC ATTACATTAC
 951 AGGCGACAAA CAGCTCGGAC TGCCTGCCGT ATCGGCGGTT GCCGCGTTGA
1001 CGGCCGGATT TTCCCTGTTG AGTTATTATT TGATTGAACA GCCGCTTAGA
1051 AAACGGAAGA TGACCTTCAA AAAGGCATTT TTCTGCCTCT ATCTCGCCCC
1101 GTCCCTGATA CTTGTCGGTT ACAACCTGTA CGCAAGGGGG ATATTGAAAC
1151 AGGAACACCT CCGCCCGTTG CCCGGCGCGC CCCTTGCTGC GGAAAATCAT
1201 TTTCCGGAAA CCGTCCTGAC CCTCGGCGAC TCGCACGCCG GACACCTGAG
```

-continued

```
1251 GGGGTTTCTG GATTATGTCG GCAGCCGGGA AGGGTGGAAA GCCAAAATCC

1301 TGTCCCTCGA TTCGGAGTGT TTGGTTTGGG TAGATGAGAA GCTGGCAGAC

1351 AACCCGTTAT GTCGAAAATA CCGGGATGAA GTTGAAAAAG CCGAAGCCGT

1401 TTTCATTGCC CAATTCTATG ATTTGAGGAT GGGCGGCCAG CCTGTGCCGA

1451 GATTTGAAGC GCAATCCTTC CTAATACCCG GGTTCCCAGC CCGATTCAGG

1501 GAAACCGTCA AAAGGATAGC CGCCGTCAAA CCCGTCTATG TTTTTGCAAA

1551 CAACACATCA ATCAGCCGTT CGCCCCTGAG GGAGGAAAAA TTGAAAAGAT

1601 TTGCCGCAAA CCAATATCTC CGCCCCATTC AGGCTATGGG CGACATCGGC

1651 AAGAGCAATC AGGCGGTCTT TGATTTGATT AAAGATATTC CCAATGTGCA

1701 TTGGGTGGAC GCACAAAAAT ACCTGCCCAA AAACACGGTC GAAATATACG

1751 GCCGCTATCT TTACGGCGAC CAAGACCACC TGACCTATTT CGGTTCTTAT

1801 TATATGGGGC GGGAATTCCA CAAACACGAA CGCCTGCTTA AATCTTCCCA

1851 CGGCGGCGCA TTGCAGTAG
```

This corresponds to the amino acid sequence (SEQ ID NO: 830; ORF128-1):

```
  1 MQAVRYRPEI DGLRAVAVLS VMIFHLNNRW LPGGFLGVDI FFVISGFLIT

51 GIILSEIQNG SFSFRDFYTR RIKRIYPAFI AAVSLASVIA SQIFLYEDFN

101 QMRKTVELSA VFLSNIYLGF QQGYFDLSAD ENPVLHIWSL AVEEQYYLLY

151 PLLLIFCCKK TKSLRVLRNI SIILFLILTA SSFLPSGFYT DILNQPNTYY

201 LSTLRFPELL AGSLLAVYGQ TQNGRRQTAN GKRQLLSSLC FGALLACLFV

251 IDKHNPFIPG MTLLLPCLLT ALLIRSMQYG TLPTRILSAS PIVFVGKISY

301 SLYLYHWIFI AFAHYITGDK QLGLPAVSAV AALTAGFSLL SYYLIEQPLR

351 KRKMTFKKAF FCLYLAPSLI LVGYNLYARG ILKQEHLRPL PGAPLAAENH

401 FPETVLTLGD SHAGHLRGFL DYVGSREGWK AKILSLDSEC LVWVDEKLAD

451 NPLCRKYRDE VEKAEAVFIA QFYDLRMGGQ PVPRFEAQSF LIPGFPARFR

501 ETVKRIAAVK PVYVFANNTS ISRSPLREEK LKRFAANQYL RPIQAMGDIG

551 KSNQAVFDLI KDIPNVHWVD AQKYLPKNTV EIYGRYLYGD QDHLTYFGSY

601 YMGREFHKHE RLLKSSHGGA LQ*
```

Computer analysis of this amino acid sequence gave the following results:
Homology with Hypothetical Integral Membrane Protein HI0392 of *H.influenzae* (Accession Number U32723) (SEQ ID NO: 1164)
ORF128 (SEQ ID NO: 828) and HI0392 (SEQ ID NO: 1164) show 52% aa identity in 180aa overlap:

```
Orf128:    1 VSLASVIASQIFLYEDFNQMRKTVELSAVFLSNIYLGFQQGYFDLSADENPVLHIWSLAV   60
             ++L S IAS IF+Y DFN++RKT+EL+  FLSN YLG  QGYFDLSA+ENPVLHIWSLAV
HI0392:   46 MALVSFIASAIFIYNDFNKLRKTIELAIAFLSNFYLGLTQGYFDLSANENPVLHIWSLAV  105

Orf128:   61 EEQXXXXXXXXXIFCCKKTKSLRVLRNISIILFLILTASSFLPSGFYTDILNQPNTYYLS  120
              E Q         I   KK + ++VL  I++ILF IL A+SF+ + FY ++L+QPN YYLS
HI0392:  106 EGQYYLIFPLILILAYKKFREVKVLFIITLILFFILLATSFVSANFYKEVLHQPNIYYLS  165
```

-continued

```
Orf128:   121 TLRFPELLAGSLLAVYGQTQNGRRQTANGKRQLLSSLCFGALLACLFVIDKHNPFIPGMT 180
              LRFPELL GSLLA+Y     N + Q +      +L+ L    L +CLF+++ +  FIPG+T
HI0392:   166 NLRFPELLVGSLLAIYHNLSN-KVQLSKQVNNILAILSTLLLFSCLFLMNNNIAFIPGIT 224
```

Homology with a Predicted ORF from *N.meningitidis* (Strain A)

ORF128 (SEQ ID NO: 828) shows 98.0% identity over a 244aa overlap with an ORF (ORF128a) (SEQ ID NO: 832) from strain A of *N. meningitidis*:

```
                                           10        20        30
orf128.pep                         VSLASVIASQIFLYEDFNQMRKTVELSAVF
                                   ||||||||||||||||||||||||||||||
orf128a    ILSEIQNGSFSFRDFYTRRIKRIYPAFIAAVSLASVIASQIFLYEDFNQMRKTVELSAVF
                    60        70        80        90       100       110

40        50        60        70        80        90
orf128.pep LSNIYLGFQQGYFDLSADENPVLHIWSLAVEEQYYLLYPLLLIFCCKKTKSLRVLRNISI
           ||||||||||||||||||||||||||||||||||||||||||||||||||||||||||||
orf128a    LSNIYLGFQQGYFDLSADENPVLHIWSLAVEEQYYLLYPLLLIFCCKKTKSLRVLRNISI
                   120       130       140       150       160       170

100       110       120       130       140       150
orf128.pep ILFLILTASSFLPSGFYTDILNQPNTYYLSTLRFPELLAGSLLAVYGQTQNGRRQTANGK
           ||||||||:|||||||||||||||||||||||||||||||||||||||||||||||||||
orf128a    ILFLILTATSFLPSGFYTDILNQPNTYYLSTLRFPELLAGSLLAVYGQTQNGRRQTANGK
                   180       190       200       210       220       230

160       170       180       190       200       210
orf128.pep RQLLSSLCFGALLACLFVIDKHNPFIPGMTLLLPCLLTALLIRSMQYGTLPTRILSASPI
           ||||||||||||||||||||||||||||||||||||||||||||||||||||||||||||
orf128a    RQLLSSLCFGALLACLFVIDKHNPFIPGMTLLLPCLLTALLIRSMQYGTLPTRILSASPI
                   240       250       260       270       280       290

220       230       240
orf128.pep VFVGKISYSLYLYHWIFIAFAPLIRGGKQLGLPA
           |||||||||||||||||||||||  |  |||||||
orf128a    VFVGKISYSLYLYHWIFIAFAHYITGDKQLGLPAVSAVAALTAGFSLLSYYLIEQPLRKR
                   300       310       320       330       340       350 orf128a    KMTFKKAFFCLYLAPSLILVGYNLYARGILKQEHLRPLPGAPLAAENHFPETVLTLGDSH
                   360       370       380       390       400       410
                                                            40
```

The complete length ORF128a nucleotide sequence (SEQ ID NO: 831) is:

```
  1   ATGCAAGCTG TCCGATACAG ACCGGAAATT GACGGATTGC GGGCCGTCGC
 51   CGTGCTATCC GTCATGATTT TCCACCTGAA TAACCGCTGG CTGCCCGGAG
101   GATTCCTGGG GGTGGACATT TTCTTTGTCA TCTCAGGATT CCTCATTACC
151   GGCATCATTC TTTCTGAAAT ACAGAACGGT TCTTTTTCTT TCCGGGATTT
201   TTATACCCGC AGGATTAAGC GGATTTATCC TGCTTTTATT GCGGCCGTGT
251   CGCTGGCTTC GGTGATTGCC TCTCAAATCT TCCTTTACGA AGATTTCAAC
301   CAAATGCGGA AAACCGTGGA GCTTTCTGCG GTTTTCTTGT CCAATATTTA
351   TCTGGGGTTT CAGCAGGGGT ATTTCGATTT GAGTGCCGAC GAGAACCCCG
401   TACTGCATAT CTGGTCTTTG GCAGTAGAGG AACAGTATTA CCTCCTGTAT
451   CCTCTTTTGC TGATATTTTG CTGCAAAAAA ACAAAATCGC TACGGGTGCT
501   GCGTAACATC AGCATCATCC TATTTCTGAT TTTGACTGCC ACATCGTTTT
551   TGCCAAGCGG GTTTTATACC GATATTCTCA ACCAACCCAA TACTTATTAC
601   CTTTCGACAC TGAGGTTTCC CGAGCTGTTG GCAGGTTCGC TGCTGGCGGT
```

```
 651  TTACGGGCAA ACGCAAAACG GCAGACGGCA AACAGCAAAT GGAAAACGGC
 701  AGTTGCTTTC ATCACTCTGC TTCGGCGCAT TGCTTGCCTG CCTGTTCGTG
 751  ATTGACAAAC ACAATCCGTT TATCCCGGGA ATGACCCTGC TCCTTCCCTG
 801  CCTGCTGACG GCACTGCTTA TCCGGAGTAT GCAATACGGG ACACTTCCGA
 851  CCCGCATCCT GTCGGCAAGC CCCATCGTAT TTGTCGGCAA AATCTCTTAT
 901  TCCCTATACC TGTACCATTG GATTTTTATT GCTTTCGCCC ATTACATTAC
 951  AGGCGACAAA CAGCTCGGAC TGCCTGCCGT ATCGGCGGTT GCCGCGTTGA
1001  CGGCCGGATT TTCCCTGTTG AGTTATTATT TGATTGAACA GCCGCTTAGA
1051  AAACGGAAGA TGACCTTCAA AAAGGCATTT TTCTGCCTCT ATCTCGCCCC
1101  GTCCCTGATA CTTGTCGGTT ACAACCTGTA CGCAAGGGGG ATATTGAAAC
1151  AGGAACACCT CCGCCCGTTG CCCGGCGCGC CCCTTGCTGC GGAAAATCAT
1201  TTTCCGGAAA CCGTCCTGAC CCTCGGCGAC TCGCACGCCG GACACCTGCG
1251  GGGGTTTCTG GATTATGTCG GCAGCCGGGA AGGGTGGAAA GCCAAAATCC
1301  TGTCCCTCGA TTCGGAGTGT TTGGTTTGGG TAGATGAGAA GCTGGCAGAC
1351  AACCCGTTAT GTCGAAAATA CCGGGATGAA GTTGAAAAAG CCGAAGCCGT
1401  TTTCATTGCC CAATTCTATG ATTTGAGGAT GGGCGGCCAG CCCGTGCCGA
1451  GATTTGAAGC GCAATCCTTC CTAATACCCG GGTTCCCAGC CCGATTCAGG
1501  GAAACCGTCA AAAGGATAGC CGCCGTCAAA CCCGTCTATG TTTTTGCAAA
1551  CAACACATCA ATCAGCCGTT CGCCCCTGAG GGAGGAAAAA TTGAAAAGAT
1601  TTGCCGCAAA CCAATATCTC CGCCCCATTC AGGCTATGGG CGACATCGGC
1651  AAGAGCAATC AGGCGGTCTT TGATTTGATT AAAGATATTC CCAATGTGCA
1701  TTGGGTGGAC GCACAAAAAT ACCTGCCCAA AAACACGGTC GAAATATACG
1751  GCCGCTATCT TTACGGCGAC CAAGACCACC TGACCTATTT CGGTTCTTAT
1801  TATATGGGGC GGGAATTTCA CAAACACGAA CGCCTGCTTA AATCTTCTCG
1851  CGACGGCGCA TTGCAGTAG
```

This encodes a protein having amino acid sequence (SEQ ID NO: 832):

```
  1  MQAVRYRPEI DGLRAVAVLS VMIFHLNNRW LPGGFLGVDI FFVISGFLIT
 51  GIILSEIQNG SFSFRDFYTR RIKRIYPAFI AAVSLASVIA SQIFLYEDFN
101  QMRKTVELSA VFLSNIYLGF QQGYFDLSAD ENPVLHIWSL AVEEQYYLLY
151  PLLLIFCCKK TKSLRVLRNI SIILFLILTA TSFLPSGFYT DILNQPNTYY
201  LSTLRFPELL AGSLLAVYGQ TQNGRRQTAN GKRQLLSSLC FGALLACLFV
251  IDKHNPFIPG MTLLLPCLLT ALLIRSMQYG TLPTRILSAS PIVFVGKISY
301  SLYLYHWIFI AFAHYITGDK QLGLPAVSAV AALTAGFSLL SYYLIEQPLR
351  KRKMTFKKAF FCLYLAPSLI LVGYNLYARG ILKQEHLRPL PGAPLAAENH
401  FPETVLTLGD SHAGHLRGFL DYVGSREGWK AKILSLDSEC LVWVDEKLAD
451  NPLCRKYRDE VEKAEAVFIA QFYDLRMGGQ PVPRFEAQSF LIPGFPARFR
501  ETVKRIAAVK PVYVFANNTS ISRSPLREEK LKRFAANQYL RPIQAMGDIG
551  KSNQAVFDLI KDIPNVHWVD AQKYLPKNTV EIYGRYLYGD QDHLTYFGSY
601  YMGREFHKHE RLLKSSHGGA LQ*
```

ORF128a (SEQ ID NO: 832) and ORF128-1 (SEQ ID NO: 830) show 99.5% identity in 622 aa overlap:

```
orf128a.pep  MQAVRYRPEIDGLRAVAVLSVMIFHLNNRWLPGGFLGVDIFFVISGFLITGIILSEIQNG
             ||||||||||||||||||||||||||||||||||||||||||||||||||||||||||||
orf128-1     MQAVRYRPEIDGLRAVAVLSVMIFHLNNRWLPGGFLGVDIFFVISGFLITGIILSEIQNG orf128a.pep  SFSFRDFYTRRIKRIYPAFIAAVSLASVIASQIFLYEDFNQMRKTVELSAVFLSNIYLGF
             ||||||||||||||||||||||||||||||||||||||||||||||||||||||||||||
orf128-1     SFSFRDFYTRRIKRIYPAFIAAVSLASVIASQIFLYEDFNQMRKTVELSAVFLSNIYLGF orf128a.pep  QQGYFDLSADENPVLHIWSLAVEEQYYLLYPLLLIFCCKKTKSLRVLRNISIILFLILTA
             ||||||||||||||||||||||||||||||||||||||||||||||||||||||||||||
orf128-1     QQGYFDLSADENPVLHIWSLAVEEQYYLLYPLLLIFCCKKTKSLRVLRNISIILFLILTA orf128a.pep  TSFLPSGFYTDILNQPNTYYLSTLRFPELLAGSLLAVYGQTQNGRRQTANGKRQLLSSLC
             :|||||||||||||||||||||||||||||||||||||||||||||||||||||||||||
orf128-1     SSFLPSGFYTDILNQPNTYYLSTLRFPELLAGSLLAVYGQTQNGRRQTANGKRQLLSSLC orf128a.pep  FGALLACLFVIDKHNPFIPGMTLLLPCLLTALLIRSMQYGTLPTRILSASPIVFVGKISY
             ||||||||||||||||||||||||||||||||||||||||||||||||||||||||||||
orf128-1     FGALLACLFVIDKHNPFIPGMTLLLPCLLTALLIRSMQYGTLPTRILSASPIVFVGKISY orf128a.pep  SLYLYHWIFIAFAHYITGDKQLGLPAVSAVAALTAGFSLLSYYLIEQPLRKRKMTFKKAF
             ||||||||||||||||||||||||||||||||||||||||||||||||||||||||||||
orf128-1     SLYLYHWIFIAFAHYITGDKQLGLPAVSAVAALTAGFSLLSYYLIEQPLRKRKMTFKKAF orf128a.pep  FCLYLAPSLILVGYNLYARGILKQEHLRPLPGAPLAAENHFPETVLTLGDSHAGHLRGFL
             ||||||||||||||||||||||||||||||||||||||||||||||||||||||||||||
orf128-1     FCLYLAPSLILVGYNLYARGILKQEHLRPLPGAPLAAENHFPETVLTLGDSHAGHLRGFL orf128a.pep  DYVGSREGWKAKILSLDSECLVWVDEKLADNPLCRKYRDEVEKAEAVFIAQFYDLRMGGQ
             ||||||||||||||||||||||||||||||||||||||||||||||||||||||||||||
orf128-1     DYVGSREGWKAKILSLDSECLVWVDEKLADNPLCRKYRDEVEKAEAVFIAQFYDLRMGGQ orf128a.pep  PVPRFEAQSFLIPGFPARFRETVKRIAAVKPVYVFANNTSISRSPLREEKLKRFAANQYL
             ||||||||||||||||||||||||||||||||||||||||||||||||||||||||||||
orf128-1     PVPRFEAQSFLIPGFPARFRETVKRIAAVKPVYVFANNTSISRSPLREEKLKRFAANQYL orf128a.pep  RPIQAMGDIGKSNQAVFDLIKDIPNVHWVDAQKYLPKNTVEIYGRYLYGDQDHLTYFGSY
             ||||||||||||||||||||||||||||||||||||||||||||||||||||||||||||
orf128-1     RPIQAMGDIGKSNQAVFDLIKDIPNVHWVDAQKYLPKNTVEIYGRYLYGDQDHLTYFGSY orf128a.pep  YMGREFHKHERLLKSSRDGALQX
             |||||||||||||||:|||||
orf128-1     YMGREFHKHERLLKSSHGGALQX
```

Homology with a Predicted ORF from N.gonorrhoeae
ORF128 (SEQ ID NO: 828) shows 93.4% identity over 244 aa overlap with a Predicted ORF (ORF128ng) (SEQ ID NO: 834) from N. gonorrhoeae:

```
orf128.pep                         VSLASVIASQIFLYEDFNQMRKTVELSAVF   30
                                   ||||||||||||||||||||||:|||:||
orf128ng    ILSEIQNGSFSFRDFYTRRIKRIYPAFIAAVSLASVIASQIFLYEDFNQMRKTIELSTVF  112 orf128.pep  LSNIYLGFQQGYFDLSADENPVLHIWSLAVEEQYYLLYPLLLIFCCKKTKSLRVLRNISI   90
            ||||||||:||||||||||||||||||||||||||||||||||| ||||||||||||||
orf128ng    LSNIYLGFRLGYFDLSADENPVLHIWSLAVEEQYYLLYPLLLIFCYKKTKSLRVLRNISI  172 orf128.pep  ILFLILTASSFLPSGFYTDILNQPNTYYLSTLRFPELLAGSLLAVYGQTQNGRRQTANGK  150
            ||||||||||:|||||||||||||||||||||||||||:|||||||||||||||||| |||
orf128ng    ILFLILTASSFLPAGFYTDILNQPNTYYLSTLRFPELLVGSLLAVYGQTQNGRRQTENGK  232 orf128.pep  RQLLSSLCFGALLACLFVIDKHNPFIPGMTLLLPCLLTALLIRSMQYGTLPTRILSASPI  210
            ||||| ||||||||:|||||||:|||||:|||||||||||||||||||||||||||||||
orf128ng    RQLLSLCFGALLVCLFVIDKHDPFIPGITLLLPCLLTALLIRSMQYGTLPTRILSASPI  292 orf128.pep  VFVGKISYSLYLYHWIFIAFAPLIRGGKQLGLPA                            244
            ||||||||||||||||||||||  | ||||||||
orf128ng    VFVGKISYSLYLYHWIFIAFAHYITGDKQLGLPAVSAVAALTAGFSLLSYYLIEQPLRKR  352
```

The complete length ORF128ng nucleotide sequence (SEQ ID NO: 833) is:

```
   1   ATGCAAGCTG TCCGATACAG GCCTGAAATT GACGGATTGC GGGCCGTCGC
  51   CGTGCTATCC GTCATTATTT TCCACCTGAA TAACCGCTGG CTGCCCGGAG
 101   GATTCCTGGG GGTGGACATT TTCTTTGTCA TCTCGGGATT CCTCATTACC
 151   AACATCATTC TTTCTGAAAT ACAGAACGGT TCTTTTTCTT TCCGGGATTT
 201   TTATACCCGC AGGATTAAGC GGATTTATCC TGCTTTTATT GCGGCCGTGT
 251   CCCTGGCTTC GGTGATTGCT TCTCAAATCT TCCTTTACGA AGATTTCAAC
 301   CAAATGAGGA AAACCATAGA GCTTTCTACG GTTTTTTTGT CCAATATTTA
 351   TTTGGGGTTC CGATTGGGGT ATTTCGATTT GAGTGCCGAC GAGAACCCCG
 401   TACTGCATAT CTGGTCTTTG GCGGTAGAGG AACAGTATTA CCTCCTGTAT
 451   CCTCTTTTGC TGATATTCTG TTACAAAAAA ACCAAATCAC TACGGGTGCT
 501   GCGTAATATC AGCATCATCC TGTTTCTGAT TTTGACCGCA TCATCGTTTT
 551   TGCCGGCCGG GTTTTATACC GACATCCTCA ACCAACCcaa TACTTATTAC
 601   CTTTCGACAC TGAGGTTTCC CGAGCTGTTG GTGGGTTCGC TGTTGGCGGT
 651   TTACGGGCAA ACGCAAAACG GCAGACGGCA AACAGAAAAT GGAAAACGGC
 701   AGTTGCTTTC ATTACTCTGT TTCGGCGCat tgCTTGTCTG CCTGTTCGTG
 751   ATCGACAAAC ACGATCCGTT TATCCCGGGA ATAACCCTGC TCCTTCCCTG
 801   CCTGCTGACG GCGCTGCTTA TCCGGAGTAT GCAATACGGG ACACTTCCGA
 851   CCCGCATCCT GTCGGCAAGC CCCATCGTAT TTGTCGGCAA AATCTCTTAT
 901   TCCCTATACC TGTACCATTG GATTTTTATT GCCTTCGCCC ATTACATTAC
 951   AGGCGACAAA CAGCTCGGAC TGCCTGCCGT ATCGGCGGTT GCCGCGTTGA
1001   CGGCCGGATT TTCCCTGTTG AGCTATTATT TGATTGAACA GCCGCTTAGA
1051   AAACGGAAGA TGACCTTCAA AAAGGCATTT TTCTGCCTTT ATCTCGCCCC
1101   GTCCCTGATG CTTGTCGGTT ACAACCTGTA TTCAAGAGGG ATATTGAAAC
1151   AGGAACACCT CCGCCCGCTG CCCGGCACGC CCGTTGCTGC GGAAAATAAT
1201   TTTCCGGAAA CCGTCTTGAC CCTCGGCGAC TCGCACGCCG GACACCTGCG
1251   GGGGTTTCTG GATTATGTCG GCGGCAGGGA AGGGTGGAAA GCTAAAATCC
1301   TGTCCCTCGA TTCGGAGTGT TTGGTTTGGG TGGATGAGAA GCTGGCAGAC
1351   AACCCGTTGT GCCGAAAATA CCGGGATGAA GTTGAAAAAG CCGAAGCTGT
1401   TTTCATTGCC CAATTCTATG ATTTGAGGAT GGGCGGCCAG CCCGTGCCGA
1451   GATTTGAAGC GCAATCCTTC CTGATACCCG GGTTCAAAGC CCGATTCAGG
1501   GAAACCGTCA AGAGGATAGC CGCCGTCAAA CCTGTATATG TTTTTGCAAA
1551   CAATACATCA ATCAGCCGTT CTCCCTTGAG GGAGGAAAAA TTGAAAAGAT
1601   TTGCTATAAA CCAATACCTC CGGCCTATTC GGGCTATGGG CGACATCGGC
1651   AAGAGCAATC AGGCGGTCTT TGATTTGGTT AAAGATATTC CAATGTGCA
1701   TTGGGTGGAC GCACAAAAAT ACCTGCCCAA AACACGGTC  GAAATACACG
1751   GACGCTATCT TTACGGCGAC CAAGACCACC TGACCTATTT CGGTTCTTAT
1801   TATATGGGGC GGGAATTTCA CAAACACGAA CGCCTGCTCA AGCATTCCCG
1851   AGGCGGCGCA TTGCAGTAG
```

This encodes a protein having amino acid sequence (SEQ ID NO: 834):

```
  1  MQAVRYRPEI DGLRAVAVLS VIIFHLNNRW LPGGFLGVDI FFVISGFLIT
 51  NIILSEIQNG SFSFRDFYTR RIKRIYPAFI AAVSLASVIA SQIFLYEDFN
101  QMRKTIELST VFLSNIYLGF RLGYFDLSAD ENPVLHIWSL AVEEQYYLLY
151  PLLLIFCYKK TKSLRVLRNI SIILFLILTA SSFLPAGFYT DILNQPNTYY
201  LSTLRFPELL VGSLLAVYGQ TQNGRRQTEN GKRQLLSLLC FGALLVCLFV
251  IDKHDPFIPG ITLLLPCLLT ALLIRSMQYG TLPTRILSAS PIVFVGKISY
301  SLYLYHWIFI AFAHYITGDK QLGLPAVSAV AALTAGFSLL SYYLIEQPLR
351  KRKMTFKKAF FCLYLAPSLM LVGYNLYSRG ILKQEHLRPL PGTPVAAENN
401  FPETVLTLGD SHAGHLRGFL DYVGGREGWK AKILSLDSEC LVWVDEKLAD
451  NPLCRKYRDE VEKAEAVFIA QFYDLRMGGQ PVPRFEAQSF LIPGFKARFR
501  ETVKRIAAVK PVYVFANNTS ISRSPLREEK LKRFAINQYL RPIRAMGDIG
551  KSNQAVFDLV KDIPNVHWVD AQKYLPKNTV EIHGRYLYGD QDHLTYFGSY
601  YMGREFHKHE RLLKHSRGGA LQ*
```

ORF128ng (SEQ ID NO: 834) and ORF128-1 (SEQ ID NO: 830) show 95.7% identity in 622 aa overlap:

```
orf128-1.pep  MQAVRYRPEIDGLRAVAVLSVMIFHLNNRWLPGGFLGVDIFFVISGFLITGIILSEIQNG
              ||||||||||||||||||||||:|||||||||||||||||||||||||||:|||||||||
orf128ng      MQAVRYRPEIDGLRAVAVLSVIIFHLNNRWLPGGFLGVDIFFVISGFLITNIILSEIQNG orf128-1.pep  SFSFRDFYTRRIKRIYPAFIAAVSLASVIASQIFLYEDFNQMRKTVELSAVFLSNIYLGF
              ||||||||||||||||||||||||||||||||||||||||||||||:|||:|||||||||
orf128ng      SFSFRDFYTRRIKRIYPAFIAAVSLASVIASQIFLYEDFNQMRKTIELSTVFLSNIYLGF orf128-1.pep  QQGYFDLSADENPVLHIWSLAVEEQYYLLYPLLLIFCCKKTKSLRVLRNISIILFLILTA
              :|||||||||||||||||||||||||||||||||||:|||||||||||||||||||||||
orf128ng      RLGYFDLSADENPVLHIWSLAVEEQYYLLYPLLLIFCYKKTKSLRVLRNISIILFLILTA orf128-1.pep  SSFLPSGFYTDILNQPNTYYLSTLRFPELLAGSLLAVYGQTQNGRRQTANGKRQLLSSLC
              |||||:||||||||||||||||||||||||||:|||||||||||||||||| |||||:||
orf128ng      SSFLPAGFYTDILNQPNTYYLSTLRFPELLVGSLLAVYGQTQNGRRQTENGKRQLLSLLC orf128-1.pep  FGALLACLFVIDKHNPFIPGMTLLLPCLLTALLIRSMQYGTLPTRILSASPIVFVGKISY
              |||||:||||||||:|||||:|||||||||||||||||||||||||||||||||||||||
orf128ng      FGALLVCLFVIDKHDPFIPGITLLLPCLLTALLIRSMQYGTLPTRILSASPIVFVGKISY orf128-1.pep  SLYLYHWIFIAFAHYITGDKQLGLPAVSAVAALTAGFSLLSYYLIEQPLRKRKMTFKKAF
              ||||||||||||||||||||||||||||||||||||||||||||||||||||||||||||
orf128ng      SLYLYHWIFIAFAHYITGDKQLGLPAVSAVAALTAGFSLLSYYLIEQPLRKRKMTFKKAF orf128-1.pep  FCLYLAPSLILVGYNLYARGILKQEHLRPLPGAPLAAENHFPETVLTLGDSHAGHLRGFL
              ||||||||||:||||||:|||||||||||||:|:||||||||||||||||||||||||||
orf128ng      FCLYLAPSLMLVGYNLYSRGILKQEHLRPLPGTPVAAENNFPETVLTLGDSHAGHLRGFL orf128-1.pep  DYVGSREGWKAKILSLDSECLVWVDEKLADNPLCRKYRDEVEKAEAVFIAQFYDLRMGGQ
              ||||:|||||||||||||||||||||||||||||||||||||||||||||||||||||||
orf128ng      DYVGGREGWKAKILSLDSECLVWVDEKLADNPLCRKYRDEVEKAEAVFIAQFYDLRMGGQ orf128-1.pep  PVPRFEAQSFLIPGFPARFRETVKRIAAVKPVYVFANNTSISRSPLREEKLKRFAANQYL
              ||||||||||||||||:|||||||||||||||||||||||||||||||||||||| ||||
orf128ng      PVPRFEAQSFLIPGFKARFRETVKRIAAVKPVYVFANNTSISRSPLREEKLKRFAINQYL orf128-1.pep  RPIQAMGDIGKSNQAVFDLIKDIPNVHWVDAQKYLPKNTVEIYGRYLYGDQDHLTYFGSY
              |||:||||||||||||||||:|||||||||||||||||||||:|||||||||||||||||
orf128ng      RPIRAMGDIGKSNQAVFDLVKDIPNVHWVDAQKYLPKNTVEIHGRYLYGDQDHLTYFGSY orf128-1.pep  YMGREFHKHERLLKSSHGGALQX
              ||||||||||||||| :||||||
orf128ng      YMGREFHKHERLLKHSRGGALQX
                        610       620
```

In addition, ORF128ng (SEQ ID NO: 834) shows homology to a hypothetical *H.influenzae* protein (SEQ ID NO: 1164):

```
sp|P43993|Y392_HAEIN HYPOTHETICAL PROTEIN HI0392 )gi|1074385|pir||B64007
hypothetical protein HI0392 - Haemophilus influenzae (strain Rd KW20)
)gi|1573364 (U32723) H. influenzae predicted coding region HI0392 [Haemophilus
influenzae] Length = 245
Score = 239 bits (604), Expect = 3e-62
Identities = 124/225 (55%), Positives = 152/225 (67%), Gaps = 1/225 (0%)

Query:  38 VDIFFVISGFLITNIILSEIQNGSFSFRDFYTRRIKRIYPXXXXXXXXXXXXXXXXXFLYE   97
            +DIFFVISGFLIT II++EIQ  SFS + FYTRRIKRIYP                 F+Y
Sbjct:   1 MDIFFVISGFLITGIIITEIQQNSFSLKQFYTRRIKRIYPAFITVMALVSFIASAIFIYN   60

Query:  98 DFNQMRKTIELSTVFLSNIYLGFRLGYFDLSADENPVLHIWSLAVEEQXXXXXXXXXIFC  157
            DFN++RKTIEL+  FLSN YLG   GYFDLSA+ENPVLHIWSLAVE Q         I
Sbjct:  61 DFNKLRKTIELAIAFLSNFYLGLTQGYFGLSANENPVLHIWSLAVEGQYYLIFPLILILA  120

Query: 158 YKKTKSLRVLRNISIILFLILTASSFLPAGFYTDILNQPNTYYLSTLRFPELLVGSLLAV  217
            YKK + ++VL  I++ILF IL A+SF+ A FY ++L+QPN YYLS LRFPELLVGSLLA+
Sbjct: 121 YKKFREVKVLFIITLILFFILLATSFVSANFYKEVLHQPNIYYLSNLRFPELLVGSLLAI  180

Query: 218 YGQTQNGRRQTENGKRQLLSLLCFGALLVCLFVIDKHDPFIPGIT                262
            Y   N + Q        +L++L    L  CLF+++ +  FIPGIT
Sbjct: 181 YHNLSN-KVQLSKQVNNILAILSTLLLFSCLFLMNNNIAFIPGIT                224
```

This analysis, including the identification of several putative transmembrane domains, suggests that these proteins from *N.meningitidis* and *N.gonorrhoeae*, and their epitopes, could be useful antigens for vaccines or diagnostics, or for raising antibodies.

Example 99

The following partial DNA sequence was identified in *N.meningitidis* (SEQ ID NO: 835):

```
  1  ..ATTATTTACG AATACCGCTG GATGTTTCTT TACGGCGCAC TGACGACCTT
 51    GGGGCTGACG GTCGTGGCCA C.GCGGGCGG TTCGGTATTG GGTCTGTTGT
101    TGGCGTTGGC GCGCCTGATT CACTTGGAAA AAGCCGGTGC GCCGATGCGC
151    GTGCTGGCGT GGGCGTTGCG TAAAGTTTCG CTGCTGTATG TTACGCTGTT
201    CCGGGGTACG CCGCTGTTTG TGCAGATTGT GATTTGGGCG TATGTGTGGT
251    TTCCGTTTTT CGTC..
```

This corresponds to the amino acid sequence (SEQ ID NO: 836; ORF129):

```
  1  ..IIYEYRWMFL YGALTTLGLT VVAXAGGSVL GLLLALARLI HLEKAGAPMR
 51    VLAWALRKVS LLYVTLFRGT PLFVQIVIWA YVWFPFFV..
```

Further work revealed the complete nucleotide sequence (SEQ ID NO: 837):

```
  1  ATGGATTTTC GTTTTGACAT TATTTACGAA TACCGCTGGA TGTTTCTTTA
 51  CGGCGCACTG ACGACCTTGG GGCTGACGGT CGTGGCAACG GCGGGCGGTT
101  CGGTATTGGG TCTGTTGTTG GCGTTGGCGC GCCTGATTCA CTTGGAAAAA
151  GCCGGTGCGC CGATGCGCGT GCTGGCGTGG GCGTTGCGTA AAGTTTCGCT
201  GCTGTATGTT ACGCTGTTCC GGGGTACGCC GCTGTTTGTG CAGATTGTGA
251  TTTGGGCGTA TGTGTGGTTT CCGTTTTTCG TCCATCCTTC AGACGGCATT
201  TTGGTCAGCG GCGAGGCGGC AATCGCGCTG CGTCGCGGAT ACGGGCCGCT
```

```
                     -continued
351  GATTGCCGGT TCTTTGGCAC TGATCGCCAA CTCGGGGGCG TATATCTGTG

401  AGATTTTCCG CGCGGGCATC CAGTCTATAG ACAAAGGACA GATGGAGGCG

451  GCGCGTTCTT TGGGGCTGAC CTATCCGCAG GCGATGCGCT ATGTGATTCT

501  GCCGCAGGCA TTGCGCCGCA TGCTGCCGCC TTTGGCGAGC GAGTTCATCA

551  CGCTCTTGAA AGACAGCTCG CTGCTGTCGG TCATTGCTGT GGCGGAGTTG

601  GCGTATGTTC AGAATACGAT TACGGGCCGG TATTCGGTTT ATGAAGAACC

651  GCTTTACACC GTCGCCCTGA TTTATCTGTT GATGACGACT TTCTTAGGCT

701  GGATATTCCT GCGTTTGGAA AAACGTTACA ATCCGCAACA CCGCTGA
```

This corresponds to the amino acid sequence (SEQ ID NO: 838; ORF 129-1):

```
  1  MDFRFDIIYE YRWMFLYGAL TTLGLTVVAT AGGSVLGLLL ALARLIHLEK

51  AGAPMRVLAW ALRKVSLLYV TLFRGTPLFV QIVIWAYVWF PFFVHPSDGI

101  LVSGEAAIAL RRGYGPLIAG SLALIANSGA YICEIFRAGI QSIDKGQMEA

151  ARSLGLTYPQ AMRYVILPQA LRRMLPPLAS EFITLLKDSS LLSVIAVAEL

201  AYVQNTITGR YSVYEEPLYT VALIYLLMTT FLGWIFLRLE KRYNPQHR*
```

Computer analysis of this amino acid sequence gave the following results:
Homology with a Predicted ORF from *N.meningitidis* (Strain A)

ORF129 (SEQ ID NO: 836) shows 98.9% identity over a 88aa overlap with an ORF (ORF129a) (SEQ ID NO: 840) from strain A of *N. meningitidis*:

```
                        10        20        30        40        50
         orf129.pep     IIYEYRWMFLYGALTTLGLTVVAXAGGSVLGLLLALARLIHLEKAGAPMRVLAW
                        |||||||||||||||||||||||:|||||||||||||||||||||||||||||
         orf129a        MDFRFDIIYEYRWMFLYGALTTLGLTVVATAGGSVLGLLLALARLIHLEKAGAPMRVLAW
                                 10        20        30        40        50        60

60        70        80
         orf129.pep     ALRKVSLLYVTLFRGTPLFVQIVIWAYVWFPFFV
                        |||||||||||||||||||||||||||||||||
         orf129a        ALRKVSLLYVTLFRGTPLFVQIVIWAYVWFPFFVHPSDGILVSGEAAIALRRGYGPLIAG
                                 70        80        90       100       110       120 orf129a        SLALIANSGAYICEIFRAGIQSIDKGQMEAARSLGLTYPQAMRYVILPQALRRMLPPLAS
                                130       140       150       160       170       180
```

The complete length ORF129a nucleotide sequence (SEQ ID NO: 839) is:

```
  1  ATGGATTTTC GTTTTGACAT TATTTACGAA TACCGCTGGA TGTTTCTTTA

51  CGGCGCACTG ACGACCTTGG GGCTGACGGT CGTGGCGACG GCGGGCGGTT

101  CGGTATTGGG TCTGTTGTTG GCGTTGGCGC GCCTGATTCA CTTGGAAAAA

151  GCCGGTGCGC CGATGCGCGT GCTGGCGTGG GCGTTGCGTA AGGTTTCGCT

201  GCTGTATGTT ACGCTGTTCC GGGGTACGCC GCTGTTTGTG CAGATTGTGA

251  TTTGGGCGTA TGTGTGGTTT CCGTTTTTCG TCCATCCTTC AGACGGCATT

301  TTGGTTAGCG GCGAGGCGGC AATCGCGCTG CGTCGCGGAT ACGGGCCGCT

351  GATTGCCGGT TCTTTGGCAC TGATCGCCAA CTCGGGGGCG TATATCTGTG

401  AGATTTTCCG CGCGGGCATC CAGTCTATAG ACAAAGGACA GATGGAGGCG
```

```
                    -continued
451  GCGCGTTCTT TGGGGCTGAC CTATCCGCAG GCGATGCGCT ATGTGATTCT

501  GCCGCAGGCA TTGCGCCGTA TGCTGCCGCC TTTGGCGAGC GAGTTCATCA

551  CGCTCTTGAA AGACAGCTCG CTGCTGTCGG TCATTGCTGT GGCGGAGTTG

601  GCGTATGTTC AGAATACGAT TACGGGCCGG TATTCGGTTT ATGAAGAACC

651  GCTTTACACC GTCGCCCTGA TTTATCTGTT GATGACGACT TTCTTAGGCT

701  GGATATTCCT GCGTTTGGAA AAACGTTACA ATCCGCAACA CCGCTGA
```

This encodes a protein having amino acid sequence (SEQ ID NO: 840):

```
  1  MDFRFDIIYE YRWMFLYGAL TTLGLTVVAT AGGSVLGLLL ALARLIHLEK

51  AGAPMRVLAW ALRKVSLLYV TLFRGTPLFV QIVTWAYVWF PFFVHPSDGI

101  LVSGEAAIAL RRGYGPLIAG SLALIANSGA YICEIFRAGI QSIDKGQMEA

151  ARSLGLTYPQ AMRYVILPQA LRRMLPPLAS EFITLLKDSS LLSVIAVAEL

201  AYVQNTITGR YSVYEEPLYT VALIYLLMTT FLGWIFLRLE KRYNPQHR*
```

ORF129a (SEQ ID NO: 840) and ORF129-1 (SEQ ID NO: 838) show 100.0% identity in 248 aa overlap:

```
orf129a.pep  MDFRFDIIYEYRWMFLYGALTTLGLTVVATAGGSVLGLLLALARLIHLEKAGAPMRVLAW
             ||||||||||||||||||||||||||||||||||||||||||||||||||||||||||||
orf129-1     MDFRFDIIYEYRWMFLYGALTTLGLTVVATAGGSVLGLLLALARLIHLEKAGAPMRVLAW orf129a.pep  ALRKVSLLYVTLFRGTPLFVQIVIWAYVWFPFFVHPSDGILVSGEAAIALRRGYGPLIAG
             ||||||||||||||||||||||||||||||||||||||||||||||||||||||||||||
orf129-1     ALRKVSLLYVTLFRGTPLFVQIVIWAYVWFPFFVHPSDGILVSGEAAIALRRGYGPLIAG orf129a.pep  SLALIANSGAYICEIFRAGIQSIDKGQMEAARSLGLTYPQAMRYVILPQALRRMLPPLAS
             ||||||||||||||||||||||||||||||||||||||||||||||||||||||||||||
orf129-1     SLALIANSGAYICEIFRAGIQSIDKGQMEAARSLGLTYPQAMRYVILPQALRRMLPPLAS orf129a.pep  EFITLLKDSSLLSVIAVAELAYVQNTITGRYSVYEEPLYTVALIYLLMTTFLGWIFLRLE
             ||||||||||||||||||||||||||||||||||||||||||||||||||||||||||||
orf129-1     EFITLLKDSSLLSVIAVAELAYVQNTITGRYSVYEEPLYTVALIYLLMTTFLGWIFLRLE orf129a.pep  KRYNPQHRX
             |||||||||
orf129-1     KRYNPQHRX
```

Homology with a Predicted ORF from N.gonorrhoeae
ORF129 (SEQ ID NO: 836) shows 98.9% identity over a 88 aa overlap with a Predicted ORF (ORF129ng) (SEQ ID NO: 842) from N.gonorrhoeae:

```
orf129.pep      IIYEYRWMFLYGALTTLGLTVVAXAGGSVLGLLLALARLIHLEKAGAPMRVLAW   54
                |||||||||||||||||||||||:||||||||||||||||||||||||||||||
orf129ng     MDFRFDIIYEYRWMFLYGALTTLGLTVVATAGGSVLGLLLALARLIHLEKAGAPMRVLAW   60 orf129.pep   ALRKVSLLYVTLFRGTPLFVQIVIWAYVWFPFFV                             88
             |||||||||||||||||||||||||||||||||
orf129ng     ALRKVSLLYVTLFRGTPLFVQIVIWAYVWFPFFVILHTAFLGNAMRQSRRVPDKGRWIAG  120
```

An ORF129ng nucleotide sequence (SEQ ID NO: 841) was predicted to encode a protein having amino acid sequence (SEQ ID NO: 842):

```
  1  MDFRFDIIYE YRWMFLYGAL TTLGLTVVAT AGGSVLGLLL ALARLIHLEK

51  AGAPMRVLAW ALRKVSLLYV TLFRGTPLFV QIVIWAYVWF PFFVILHTAF

101  LGNAMRQSRR VPDKGRWIAG SLELNCQPRG RKTRGEFPPG ESNLGTEPRN

151  PLSMGQRRFP GCENWYPPQN FIKK*
```

Further work revealed the following gonococcal sequence (SEQ ID NO: 843):

```
  1  ATGGATTTTc gtTTTGACAT TATTTAcgaA TACCGCTGGA TGTTTCTTTA

51  CGGCGCACTG Acgaccttgg ggctgacggt cgtggcgacg gCGGGCGGTT

101  CGGtattggG TCTGTTGTTG GCGTTGGCGC GCCTGATTCA CTTGGAAAAA

151  GCCGGTGCGC CGATGCGCGT GCTGGCGTGG GCGTTGCGTA AGGTTTCGCT

201  GCTGTACGTT ACCCTGTTCC GGGGTACGCC GCTGTTTGTG CAGATTGTGA

251  TTTGGGCGTA TGTGTGGTTT CCGTTTTTCG TCCATCCTTC AGACGGCATT

301  TTGGTCAGCG GCGAGGCGGC AATCGCGCTG CGTCGCGGAT ACGGGCCGCT

351  GATTGCCGGT TCTTTGGCAC TGATCGCCAA CTCGGGGGCG TATATCTGTG

401  AGATTTTCCG CGCGGGCATC CAGTCTATAG ACAAAGGACA GATGGAGGCG

451  GCGTGTTCTT TGGGACTGAC CTATCCGCAG GCGATGCGCT ATGTGATTCT

501  GCCGCAGGCA TTGCGCCGTA TGCTGCCGCC TTTGGCGAGC GAGTTCATCA

551  CGCTCTTGAA AGACAGCTCG CTGCTGTCGG TCATTGCTGT GGCGGAGTTG

601  GCGTATGTTC AGAATACGAT TACGGGCCGG TATTCGGTTT ATGAAGAACC

651  GCTTTACACC GCCGCCCTGA TTTATCTGTT GATGACGACT TTCTTAGGCT

701  GGATATTCCT GCGTTTGGAA AAACGTTACA ATCCGCAACA CCGCTGA
```

This corresponds to the amino acid sequence (SEQ ID NO: 844; ORF129ng-1):

```
  1  MDFRFDIIYE YRWMFLYGAL TTLGLTVVAT AGGSVLGLLL ALARLIHLEK

51  AGAPMRVLAW ALRKVSLLYV TLFRGTPLFV QIVIWAYVWF PFFVHPSDGI

101  LVSGEAAIAL RRGYGPLIAG SLALIANSGA YICEIFRAGI QSIDKGQMEA

151  ARSLGLTYPQ AMRYVILPQA LRRMLPPLAS EFITLLKDSS LLSVIAVAEL

201  AYVQNTITGR YSVYEEPLYT VALIYLLMTT FLGWIFLRLE KRYNPQHR*
```

ORF129ng-1 (SEQ ID NO: 844) and ORF129-1 (SEQ ID NO: 838) show 99.2% identity in 248 aa overlap:

```
orf129-1pep    MDFRFDIIYEYRWMFLYGALTTLGLTVVATAGGSVLGLLLALARLIHLEKAGAPMRVLAW
               ||||||||||||||||||||||||||||||||||||||||||||||||||||||||||||
orf129n9-1     MDFRFDIIYEYRWMFLYGALTTLGLTVVATAGGSVLGLLLALARLIHLEKAGAPMRVLAW orf129-1.pep   ALRKVSLLYVTLFRGTPLFVQIVIWAYVWFPFFVHPSDGILVSGEAAIALRRGYGPLIAG
               ||||||||||||||||||||||||||||||||||||||||||||||||||||||||||||
orf129ng-1     ALRKVSLLYVTLFRGTPLFVQIVIWAYVWFPFFVHPSDGILVSGEAAIALRRGYGPLIAG
```

```
                              -continued
orf129-1.pep  SLALIANSGAYICEIFRAGIQSIDKGQMEAARSLGLTYPQAMRYVILPQALRRMLPPLAS
              ||||||||||||||||||||||||||||||| ||||||||||||||||||||||||||||
orf129ng-1    SLALIANSGAYICEIFRAGIQSIDKGQMEAACSLGLTYPQAMRYVILPQALRRMLPPLAS orf129-1.pep  EFITLLKDSSLLSVIAVAELAYVQNTITGRYSVYEEPLYTVALIYLLMTTFLGWIFLRLE
              ||||||||||||||||||||||||||||||||||||||||:|||||||||||||||||||
orf129ng-1    EFITLLKDSSLLSVIAVAELAYVQNTITGRYSVYEEPLYTAALIYLLMTTFLGWIFLRLE orf129-1.pep  KRYNPQHRX
              |||||||||
orf129ng-1    KRYNPQHRX
```

In addition, ORF129ng-1 (SEQ ID NO: 844) is homologous to an ABC transporter (SEQ ID NO: 1165) from *A.fulgidus*:

```
2650409 (AE001090) glutamine ABC transporter, permease protein (glnP) [Archaeoglobus
fulgidus]
Length = 224
Score = 132 bits (329), Expect = 2e-30
Identities = 86/178 (48%), Positives = 103/178 (57%), Gaps = 18/178 (10%)

Query:   65 VSLLYVTLFRGTPLFVQIVIWAYVWFPFFVHPSDGILVSGEAAIALRRGYGPLIAGSLAL    124
            +S  YV + RGTPL VQI+I        +F  P+ GI +  E A            G +AL
Sbjct:   58 ISTAYVEVIRGTPLLVQILI------VYFGLPAIGINLQPEPA------------GIIAL     99

Query:  125 IANSGAYICEIFRAGIQSIDKGQMEAACSLGLTYPQAMRYVILPQALRRMLPPLASEFIT    184
               SGAYI EI RAGI+SI  GQMEAA SLG+TY QAMRYVI PQA R +LP L +EFI
Sbjct:  100 SICSGAYIAEIVRAGIESIPIGQMEAARSLGMTYLQAMRYVIFPQAFRNILPALGNEFIA    159

Query:  185 LLKDSSLLSVIAVAELAYVQNTITGRYSVYEEPLYTAALIYLLMTTFLGWIFLRLEKR     242
            LLFDSSLLSVI++ EL  V   I          P   AL YL+MT  L +      +K+
Sbjct:  160 LLFDSSLLSVISIVELTRVGRQIVNTTFNAWTPFLGVALFYLMMTIPLSRLVAYSQKK     217
```

This analysis, including the identification of transmembrane domains in the two proteins, suggests that the proteins from *N.meningitidis* and *N.gonorrhoeae*, and their epitopes, could be useful antigens for vaccines or diagnostics, or for raising antibodies.

Example 100

The following partial DNA sequence was identified in *N.meningitidis* (SEQ ID NO: 845):

```
  1 ..CTGAAAGAAT GCCGTCTGAA AGACCCTGTT TTTATTCCAA ATATCGTTTA

51   TAAGAACATC GCCATTACTT TCCTGCTCTT GCACGCCGCC GCCGAACTTT

101   GGCTGCCCGC GCAAACCGCC GGTTTTACCG CGCTCGCCGT CGGCTTCATC

151   CTGCTCGCCA AGCTGCGTGA gCTTCACCAT CACGAACTCT TACGTAAACA

201   CTACGTCCGC ACTTATTACy TGCTCCAACT CTTTGCCGCC GCAGgcTAgT

251   TTGTGGACAG GCGCGGCGwA ATTACAAAAC CTGCCCGCyT CCGCGCCCCT

301   GCACCTGATT ACCCTCGGCG GCATGATGGG CGGCGTGATG ATGGTGTGGc

351   TGACCGCCGG ACTGTGGCAC AGCGGCTTTA CCAAACTCGA CTACCCCAAA

401   CTCTGCCGCA TTGCCGTCCC CATCCTTTTC GCCGCCGCCG TCTCGCGCGC

451   TTTCTTGrTG AACGTGAACC CGrTATTTTT CATTACCGTT CCTGCGATTC

501   TGACCGCCGC CGTATTCGTA CTGTATCTTT TCrCGTTTAT ACCGATATTT

551   CGGGCGAATG CGTTTACAGA CGATCCGGAr Tar
```

This corresponds to the amino acid sequence (SEQ ID NO: 846; ORF130):

```
  1  ..LKECRLKDPV FIPNIVYKNI AITFLLLHAA AELWLPAQTA GFTALAVGFI
 51    LLAKLRELHH HELLRKHYVR TYYLLQLFAA AGSLWTGAAX LQNLPASAPL
101    HLITLGGMMG GVMMVWLTAG LWHSGFTKLD YPKLCRIAVP ILFAAAVSRA
151    FLXNVNPXFF ITVPAILTAA VFVLYLFXFI PIFRANAFTD DPE*
```

Further work revealed the complete nucleotide sequence (SEQ ID NO: 847):

```
   1 ATGCGGCCGT TTTTCGTCGG CGCGGCGGTG CTTGCCATAC TCGGTGCGCT
  51 GGTGTTTTTC ATCAACCCCG GTGCCATCGT CCTGCACCGC CAAATTTTCT
 101 TGGAACTTAT GCTGCCGGCG GCATACGGCG GTTTTTTGAC TGCGGCTTTG
 151 TTGGACTGGA CGGGTTTTTC GGGTAACCTG AAACCTGTCG CGACTTTGAT
 201 GGCGGCATTA TTGCTCGCCG CATCCGCTAT ACTGCCCTTT TCGCCGCAAA
 251 CTGCCTCGTT TTTCGTCGCC GCCTATTGGC TGGTGTTGCT GCTGTTCTGC
 301 GCCCGGCTGA TTTGGCTAGA CCGAAACACC GACAACTTCG CCCTGCTAAT
 351 GTTACTTGCC GCGTTCACTG TTTTTCAGAC GGCATATGCC GTCAGCGGCG
 401 ATTTGAACCT GTTGCGCGCG CAAGTGCATC TAAATATGGC GGCGGTGATG
 451 TTCGTATCCG TGCGCGTCAG TATTCTTTTG GGCGCGGAAG CCCTGAAAGA
 501 ATGCCGTCTG AAAGACCCTG TTTTTATTCC AAATATCGTT TATAAAAACA
 551 TCGCCATTAC TTTCCTGCTC TTGCACGCCG CCGCCGAACT TTGGCTGCCC
 601 GCGCAAACCG CCGGTTTTAC CGCGCTCGCC GTCGGCTTCA TCCTGCTCGC
 651 CAAGCTGCGT GAGCTTCACC ATCACGAACT CTTACGTAAA CACTACGTCC
 701 GCACTTATTA CCTGCTCCAA CTCTTTGCCG CCGCAGGCTA TTTGTGGACA
 751 GGCGCGGCGA AATTACAAAA CCTGCCCGCC TCCGCGCCCC TGCACCTGAT
 801 TACCCTCGGC GGCATGATGG GCGGCGTGAT GATGGTGTGG CTGACCGCCG
 851 GACTGTGGCA CAGCGGCTTT ACCAAACTCG ACTACCCCAA ACTCTGCCGC
 901 ATTGCCGTCC CCATCCTTTT CGCCGCCGCC GTCTCGCGCG CTTTCTTGAT
 951 GAACGTGAAC CCGATATTTT TCATTACCGT TCCTGCGATT CTGACCGCCG
1001 CCGTATTCGT ACTGTATCTT TTCACGTTTA TACCGATATT TCGGGCGAAT
1051 GCGTTTACAG ACGATCCGGA ATAA
```

This corresponds to the amino acid sequence (SEQ ID NO: 848; ORF130-1):

```
  1 MRPFPVGAAV LAILGALVFF INPGAIVLHR QIFLELMLPA AYGGFLTAAL
 51 LDWTGFSGNL KPVATLMAAL LLAASAILPF SPQTASFFVA AYWLVLLLFC
101 ARLIWLDRNT DNFALLMLLA AFTVFQTAYA VSGDLNLLRA QVHLNMAAVM
151 FVSVRVSILL GAEALKECRL KDPVFIPNIV YKNIAITFLL LHAAAELWLP
201 AQTAGFTALA VGFILLAKLR ELHHHELLRK HYVRTYYLLQ LFAAAGYLWT
251 GAAKLQNLPA SAPLHLITLG GMMGGVMMVW LTAGLWHSGF TKLDYPKLCR
```

-continued
```
301 IAVPILFAAA VSRAFLMNVN PIFFITVPAI LTAAVFVLYL FTFIPIFRAN

351 AFTDDPE*
```

Computer analysis of this amino acid sequence gave the following results:
Homology with a predicted ORF from *N.meningitidis* (Strain A)

ORF130 (SEQ ID NO: 846) shows 94.3% identity over a 193aa overlap with an ORF (ORF130a) (SEQ ID NO: 850) from strain A of *N. meningitidis*:

```
                                  10         20         30
orf130.pep                 LKECRLKDPVFIPNIVYKNIAITFLLLHAA
                           ||||||||||||||:|||||||||||||||
orf130a    LNLLRAQVHLNMAAVMFVSVRVSILLGAEALKECRLKDPVFIPNVVYKNIAITFLLLHAA
               140       150       160       170       180       190

40         50         60         70         80         90
orf130.pep  AELWLPAQTAGFTALAVGFILLAKLRELHHHELLRKHYVRTYYLLQLFAAAGSLWTGAAX
            ||||||||||||:|||||||||||||||||||||||||||||||||||||||| |||||
orf130a     AELWLPAQTAGFTSLAVGFILLAKLRELHHHELLRKHYVRTYYLLQLFAAAGYLWTGAAK
               200       210       220       230       240       250

100        110        120        130        140        150
orf130.pep  LQNLPASAPLHLITLGGMMGGVMMVWLTAGLWHSGFTKLDYPKLCRIAVPILFAAAVSRA
            |||||||||||||||||||||:||||||||||||||||||||||||||||||||||||||
orf130a     LQNLPASAPLHLITLGGMMGSVMMVWLTAGLWHSGFTKLDYPKLCRIAVPILFAAAVSRA
               260       270       280       290       300       310

160        170        180        190
orf130.pep  FLXNVNPXFFITVPAILTAAVFVLYLFXFIPIFRANAFTDDPEX
            | ||||  ||||||||||||||||||::|:|||||||||||||
orf130a     VLMNVNPIFFITVPAILTAAVFVLYLLTFVPIFRANAFTDDPEX
               320       330       340       350
```

The complete length ORF130a nucleotide sequence (SEQ ID NO: 849) is:

```
  1  ATGCGGCCGT TTTTCGTCGG CGCGGCGGTG CTTGCCATAC TCGGTGCGCT

51  GGTGTTTTTC ATCAACCCCG GTGCCATCGT CCTGCACCGC CAAATTTTCT

101  TGGAACTTAT GCTGCCGGCG GCATACCGCG GTTTTTTGAC TCCGCCTTTG

151  TTGGACTGGA CGGGTTTTTC GGGTAACCTG AAACCTGTCG CGACTTTGAT

201  GGCGGCATTA TTGCTCGCCG CATCCGCTAT ACTGCCCTTT TCGCCGCAAA

251  CTGCCTCGTT TTTCGTCGCC GCCTATTGGC TGGTGTTGCT CCTGTTCTGC

301  GCCCGGCTGA TTTGGCTAGA CCGAAACACC GACAACTTCG CCCTGCTAAT

351  GTTACTTGCC GCGTTCACTG TTTTTCAGAC GGCATATGCC GTCAGCGGCG

401  ATTTGAACCT GTTGCGCGCG CAAGTGCATC TAAATATGGC GGCGGTGATG

451  TTCGTATCCG TGCGCGTCAG TATTCTTTTG GGCGCGGAAG CCCTGAAAGA

501  ATGCCGTCTG AAAGACCCAG TATTCATCCC CAATGTCGTC TATAAAAACA

551  TCGCCATTAC CTTCCTGCTC CTGCACGCCG CCGCCGAACT TTGGCTGCCT

601  GCGCAAACCG CCGGTTTTAC CTCGCTCGCC GTCGGCTTTA TCCTGCTTGC

651  CAAGCTGCGT GAGCTTCACC ATCACGAACT CCTGCGCAAA CACTACGTCC

701  GCACTTATTA CCTGCTCCAA CTCTTTGCCG CCGCAGGCTA TTTGTGGACA

751  GGCGCGGCGA AATTACAAAA CCTGCCCGCC TCCGCGCCCC TGCACCTGAT

801  TACCCTCCGT GGCATCATGG GCAGCGTGAT GATGGTGTGG CTGACTGCCG

851  GACTGTGGCA CAGCGGCTTT ACCAAGCTCG ACTACCCGAA ACTCTGCCGC
```

-continued

```
 901 ATCGCCGTCC CCATCCTNTT CGCCGCCGCC GTTTCGCGCG CTGTTTTAAT

951 GAACGTAAAC CCGATATTCT TCATCACCGT CCCCGCAATT CTGACCGCCG

1001 CCGTGTTCGT GCTTTACCTG CTGACATTCG TACCGATCTT TCGGGCGAAC

1051 GCGTTTACAG ACGATCCGGA ATAA
```

This encodes a protein having amino acid sequence (SEQ ID NO: 850):

```
  1 MRPFFVGAAV LAILGALVFF INPGAIVLHR QIFLELMLPA AYGGFLTAAL

51 LDWTGFSGNL KPVATLMAAL LLAASAILPF SPQTASFFVA AYWLVLLLFC

101 ARLIWLDRNT DNFALLMLLA AFTVFQTAYA VSGDLNLLRA QVHLNMAAVM

151 FVSVRVSILL GAEALKECRL KDPVFIPNVV YKNIAITFLL LHAAAELWLP

201 AQTAGFTSLA VGFILLAKLR ELHHHELLRK HYVRTYYLLQ LFAAAGYLWT

251 GAAKLQNLPA SAPLHLITLG GMMGSVMMVW LTAGLWHSGF TKLDYPKLCR

301 IAVPILFAAA VSRAVLMNVN PIFFITVPAI LTAAVFVLYL LTFVPIFRAN

351 AFTDDPE*
```

ORF130a (SEQ ID NO: 850) and ORF130-1 (SEQ ID NO: 848) show 98.3% identity in 357 aa overlap:

```
orf130a.pep  MRPFFVGAAVLAILGALVFFINPGAIVLHRQIFLELMLPAAYGGFLTAALLDWTGFSGNL
             ||||||||||||||||||||||||||||||||||||||||||||||||||||||||||||
orf130-1     MRPFFVGAAVLAILGALVFFINPGAIVLHRQIFLELMLPAAYGGFLTAALLDWTGFSGNL orf130a.pep  KPVATLMAALLLAASAILPFSPQTASFFVAAYWLVLLLFCARLIWLDRNTDNFALLMLLA
             ||||||||||||||||||||||||||||||||||||||||||||||||||||||||||||
orf130-1     KPVATLMAALLLAASAILPFSPQTASFFVAAYWLVLLLFCARLIWLDRNTDNFALLMLLA orf130a.pep  AFTVFQTAYAVSGDLNLLRAQVHLNMAAVMFVSVRVSILLGAEALKECRLKDPVFIPNVV
             |||||||||||||||||||||||||||||||||||||||||||||||||||||||||||:|
orf130-1     AFTVFQTAYAVSGDLNLLRAQVHLNMAAVMFVSVRVSILLGAEALKECRLKDPVFIPNIV orf130a.pep  YKNIAITFLLLHAAAELWLPAQTAGFTSLAVGFILLAKLRELHHHELLRKHYVRTYYLLQ
             ||||||||||||||||||||||||||||:|||||||||||||||||||||||||||||||
orf130-1     YKNIAITFLLLHAAAELWLPAQTAGFTALAVGFILLAKLRELHHHELLRKHYVRTYYLLQ orf130a-pep  LFAAAGYLWTGAAKLQNLPASAPLHLITLGGMMGSVMMVWLTAGLWHSGFTKLDYPKLCR
             ||||||||||||||||||||||||||||||||||:|||||||||||||||||||||||||
orf130-1     LFAAAGYLWTGAAKLQNLPASAPLHLITLGGMMGGVMMVWLTAGLWHSGFTKLDYPKLCR orf130a.pep  IAVPILFAAAVSRAVLMNVNPIFFITVPAILTAAVFVLYLLTFVPTFRANAFTDDPE
             ||||||||||||| |||||||||||||||||||||||||:||:||||||||||||||
orf130-1     IAVPILFAAAVSRAFLMNVNPIFFITVPAILTAAVFVLYLFTFIPIFRANAFTDDPE
```

Homology with a predicted ORF from N.gonorrhoeae

ORF130 (SEQ ID NO: 846) shows 91.7% identity over a 193 aa overlap with a Predicted ORF (SEQ ID NO: 852) from N.gonorrhoeae:

```
orf130.pep                         LKECRLKDPVFIPNIVYKNIAITFLLLHAA      30
                                   ||||||||||||::||||||  ||||||
orf130ng     LNLLRAQVHLNMAAVMFVSVRVSVLLGTETLKECRLKDPVFIPNVIYKNIAIT-LLLHAA   201 orf130.pep   AELWLPAQTAGFTALAVGFILLAKLRELHHHELLRKHYVRTYYLLQLFAAAGSLWTGAAX    90
             |||||||||||||||||||||||||||||||||||||||||||||||||||| ||||||
orf130ng     AELWLPAQTAGFTALAVGFILLAKLRELHHHELLRKHYVRTYYLLQLFAAAGYLWTGAAK   261 orf130.pep   LQNLPASAPLHLITLGGMMGGVMMVWLTAGLWHSGFTKLDYPKLCRIAVPILFAAAVSRA   150
             ||||||||||||||||||||  ||||||||||||||||||||||||||||| ||||:|||||
orf130ng     LQNLPASAPLHLITLGGMTGGVMMVWLTAGLWHSGFTKLDYPKLCRIAVSILFASAVSRA   321
```

```
                -continued
orf130.pep  FLXNVNPXFFITVPAILTAAVFVLYLFXFIPIFRANAFTDDPE      193
            | ||||  ||||||||  ||||||||:|||::|:||||||||||||
orf130ng    VLMNVNPIFFITVPEILTAAVFMLYLLTFVPIFRANAFTDDPE      364
```

An ORF130ng nucleotide sequence (SEQ ID NO: 851) was predicted to encode a protein having amino acid sequence (SEQ ID NO: 852):

```
  1 MNKFFTHPMR PFFVGAAVLA ILGALVFFHQ PRRYHPAPPN FLGTYAAGCI

51 RRFFDYRFVG PDGFFRQPET CRYFDGVVA CCGCFIAVFT ATCRIFRRRL

101 LAGVAAVLRL ADLARRQHRT LRSVDVTAAF TVFQTAYAVS GDLNLLRAQV

151 HLNMAAVMFV SVRVSVLLGT ETLKECRLKD PVFIPNVIYK NIAITLLLHA

201 AAELWLPAQT AGFTALAVGF ILLAKLRELH HHELLRKHYV RTYYLLQLFA

251 AAGYLWTGAA KLQNLPASAP LHLITLGGMT GGVMMVWLTA GLWHSGFTKL

301 DYPKLCRIAV SILFASAVSR AVLMNVNPIF FITVPEILTA AVFMLYLLTF

351 VPIFRANAFT DDPE*
```

Further work revealed the following gonococcal DNA sequence (SEQ ID NO: 853):

```
   1 ATGCGCCCGT TTTTCGTCGG TGCGGCAGTA CTTGCCATAC TCGGTGCGTT

51 GGTGTTTTTT ATCAACCCCG GCGCTATCAT CCTGCACCGC CAAATTTTCT

101 TGGAACTTAT GCTGCCGGCT GCATACGGCG GTTTTTTGAC TACCGCTTTG

151 TTGGACCGGA CGGGTTTTTC AGGCAACCTG AAACCTGCCG CTACTTTGAT

201 GGCGGTGTTG TTGCTTGTTG CGGCTGTTTT ATTGCCGTTT TTACCGCAAC

251 TTGCCGCATT TTTCGTCGCC GCCTATTGGC TGGTGTTGCT GCTGTTCTGC

301 GCCTGGCTGA TTTGGCTCGA CCGCAACACC GACAACTTCG CTCTGTTGAT

351 GTTACTTGCC GCATTTACCG TTTTTCAGAC GGCCTATGCC GTCAGCGGCG

401 ATTTGAACTT ACTGCGCGCG CAAGTGCATT TGAATATGGC GGCGGTCATG

451 TTCGTATCCG TCCGCGTCAG CGTCCTTTTG GGCACGGAAA CCCTGAAAGA

501 ATGCCGTCTG AAAGACCCCG TATTCATCCC CAACGTTATC TATAAAAACA

551 TCGCCATCAC CCTGCTGCTG CACGCCGCCG CCGAACTTTG GCTGCCCGCG

601 CAAACCGCCG GTTTTACTGC GCTTGCCGTC GGCTTCATCC TGCTCGCCAA

651 GCTGCGCGAA CTGCACCATC ACGAACTCTT ACGCAAACAC TACGTCCGCA

701 CTTATTACCT GCTCCAGCTC TTTGCCGCCG CAGGTTATCT GTGGACAGGC

751 GCGGCGAAAC TGCAAAACCT GCCCGCCTCC GCGCCCCTGC ACCTGATTAC

801 CCTCGGCGGC ATGACGGGTG GCGTGATGAT GGTGTGGCTG ACTGCCGGAC

851 TGTGGCACAG CGGCTTTACC AAACTCGACT ACCCGAAACT CTGCCGCATC

901 GCCGTCTCCA TCCTTTTCGC CTCCGCCGTT TCGCGCGCTG TTTTAATGAA

951 CGTGAATCCG ATATTCTTCA TCACCGTTCC CGAGATTCTG ACCGCCGCCG

1001 TGTTCATGCT TTACCTGCTG ACGTTCGTAC CGATTTTTCG AGCGAACGCG

1051 TTTACAGACG ATCCGGAATA A
```

This corresponds to the amino acid sequence (SEQ ID NO: 854; ORF130ng-1):

```
  1 MRPFFVGAAV LAILGALVFF INPGAIILHR QIFLELMLPA AYGGFLTTAL
 51 LDRTGFSGNL KPAATLMAVL LLVAAVLLPF LPQLAAFFVA AYWLVLLLFC
101 AWLIWLDRNT DNFALLMLLA AFTVFQTAYA VSGDLNLLRA QVHLNMAAVM
151 FVSVRVSVLL GTETLKECRL KDPVFIPNVI YKNIAITLLL HAAAELWLPA
201 QTAGFTALAV GFILLAKLRE LHHHELLRKH YVRTYYLLQL FAAAGYLWTG
251 AAKLQNLPAS APLHLITLGG MTGGVMMVWL TAGLWHSGFT KLDYPKLCRI
301 AVSILFASAV SRAVLMNVNP IFFITVPEIL TAAVFMLYLL TFVPIFRANA
351 FTDDPE*
```

ORF130ng-1 (SEQ ID NO: 854) and ORF130-1 (SEQ ID NO: 848) show 92.4% identity in 357 aa overlap:

```
orf130-1.pep   MRPFFVGAAVLAILGALVFFINPGAIVLHRQIFLELMLPAAYGGFLTAALLDWTGFSGNL
               ||||||||||||||||||||||||||:|||||||||||||||||||||:||||  |||||||
orf130ng-1     MRPFFVGAAVLAILGALVFFINPGAIILHRQIFLELMLPAAYGGFLTTALLDRTGFSGNL orf130-1.pep   KPVATLMAALLLAASAILPFSPQTASFFVAAYWLVLLLFCARLIWLDRNTDNFALLMLLA
               ||:||||:|||:|:::||| || |:|||||||||||||| ||||||||||||||||||||
orf130ng-1     KPAATLMAVLLLVAAVLLPFLPQLAAFFVAAYWLVLLLFCAWLIWLDRNTDNFALLMLLA orf130-1.pep   AFTVFQTAYAVSGDLNLLRAQVHLNMAAVMFVSVRVSILLGAEALKECRLKDPVFIPNIV
               |||||||||||||||||||||||||||||||||||||||:|||:|:||||||||||||||::
orf130ng-1     AFTVFQTAYAVSGDLNLLRAQVHLNMAAVMFVSVRVSVLLGTETLKECRLKDPVFIPNVI orf130-1.pep   YKNIAITFLLLHAAAELWLPAQTAGFTALAVGFILLAKLRELHHHELLRKHYVRTYYLLQ
               |||||| |||||||||||||||||||||||||||||||||||||||||||||||||||||
orf130ng-1     YKNIAIT-LLLHAAAELWLPAQTAGFTALAVGFILLAKLRELHHHELLRKHYVRTYYLLQ orf130-1.pep   LFAAAGYLWTGAAKLQNLPASAPLHLITLGGMMGGVMMVWLTAGLWHSGFTKLDYPKLCR
               |||||||||||||||||||||||||||||||| |||||||||||||||||||||||||||
orf130ng-1     LFAAAGYLWTGAAKLQNLPASAPLHLITLGGMTGGVMMVWLTAGLWHSGFTKLDYPKLCR orf130-1.pep   IAVPILFAAAVSRAFLMNVNPIFFITVPAILTAAVFVLYLFTFIPIFRANAFTDDPEX
               ||| ||||:||||| |||||||||||||| ||||||:|||:||:|||||||||||||
orf130ng-1     IAVSILFASAVSRAVLMNVNPIFFITVPEILTAAVFMLYLLTFVPIFRANAFTDDPEX
```

Based on this analysis, it is predicted that the proteins from N.meningitidis and N.gonorrhoeae, and their epitopes, could be useful antigens for vaccines or diagnostics, or for raising antibodies.

Example 101

The following partial DNA sequence was identified in N.meningitidis (SEQ ID NO: 855):

```
  1 ATGGAAATTC GGGCAATAAA ATATACGGCA ATGGCTGCGT TGCTTGCATT
 51 TACGGTTGCA GGCTGCCGGC TGGCGGGGTG GTATGAGTGT TCGTCCCTCA
101 CCGGCTGGTG TAAGCCGAGA AAACCGGCTG CCATCGATTT TTGGGATATT
151 GGCGGCGAGA GTCCGCCGTC TTTAGGGGAC TACGAGATAC CGCTTTCAGA
201 CGGCAATAGT TCCGTCAGGG CAAACGAATA TGAATCCGCA CAACAATCTT
251 ACTTTTACAG GAAAATAGGG AAGTTTGAAG C.TGCGGGCT GGATTGGCGT
301 ACGCGTGACG GCAAACCTTT GATTGAGACG TTCAAACAGG GAGGATTTGA
351 CTGCTTGGAA AAG..
```

This corresponds to the amino acid sequence (SEQ ID NO: 856; ORF131):

```
  1  MEIRAIKYTA MAALLAFTVA GCRLAGWYEC SSLTGWCKPR KPAAIDFWDI
 51  GGESPPSLGD YEIPLSDGNS SVRANEYESA QQSYFYRKIG KFEXCGLDWR
101  TRDGKPLIET FKQGGFDCLE K..
```

Further work revealed the complete nucleotide sequence (SEQ ID NO: 857):

```
  1  ATGGAAATTC GGGCAATAAA ATATACGGCA ATGGCTGCGT TGCTTGCATT
 51  TACGGTTGCA GGCTGCCGGC TGGCGGGGTG GTATGAGTGT TCGTCCCTCA
101  CCGGCTGGTG TAAGCCGAGA AAACCGGCTG CCATCGATTT TTGGGATATT
151  GGCGGCGAGA GTCCGCCGTC TTTAGGGGAC TACGAGATAC CGCTTTCAGA
201  CGGCAATCGT TCCGTCAGGG CAAACGAATA TGAATCCGCA CAACAATCTT
251  ACTTTTACAG GAAAATAGGG AAGTTTGAAG CCTGCGGGCT GGATTGGCGT
301  ACGCGTGACG GCAAACCTTT GATTGAGACG TTCAAACAGG GAGGATTTGA
351  CTGCTGGGAA AAGCAGGGGT TGCGGCGCAA CGGTCTGTCC GAGCGCGTCC
401  GATGGTAA
```

This corresponds to the amino acid sequence (SEQ ID NO: 858; ORF131-1):

```
  1  MEIRAIKYTA MAALLAFTVA GCRLAGWYEC SSLTGWCKPR KPAAIDFWDI
 51  GGESPPSLGD YEIPLSDGNR SVRANEYESA QQSYFYRKIG KFEACGLDWR
101  TRDGKPLIET FKQGGFDCLE KQGLRRNGLS ERVRW*
```

Computer analysis of this amino acid sequence gave the following results:
Homology with a Predicted ORF from *N.meningitidis* (Strain A)

ORF131 (SEQ ID NO: 856) shows 95.0% identity over a 121aa overlap with an ORF (ORF131a) (SEQ ID NO: 860) from strain A of *N. meningitidis*:

```
                     10         20         30         40         50         60
orf131.pep  MEIRAIKYTAMAALLAFTVAGCRLAGWYECSSLTGWCKPRKPAAIDFWDIGGESPPSLGD
            ||||||||||||||||||||||||||||||:||||||||||||||||||||||||||| |
orf131a     MEIRAIKYTAMAALLAFTVAGCRLAGWYECSSLSGWCKPRKPAAIDFWDIGGESPPSLED
                     10         20         30         40         50         60

70         80         90        100        110        120
orf131.pep  YEIPLSDGNSSVRANEYESAQQSYFYRKIGKFEXCGLDWRTRDGKPLIETFKQGGFDCLE
            ||||||||| |||||||||||||||||||||||| |||||||||||||||||||| |||:
orf131a     YEIPLSDGNRSVRANEYESAQQSYFYRKIGKFEACGLDWRTRDGKPLIETFKQEGFDCLK
                     70         80         90        100        110        120 orf131.pep  K
            |
orf131a     KQGLRRNGLSERVRWX
                    130
```

The complete length ORF131a nucleotide sequence (SEQ ID NO: 859) is:

```
  1  ATGGAAATTC GGGCAATAAA ATATACGGCA ATGGCTGCGT TGCTTGCATT
 51  TACGGTTGCA GGCTGCCGGT TGGCAGGTTG GTATGAGTGT TCGTCCCTGT
101  CCGGCTGGTG TAAGCCGAGA AAACCTGCCG CCATCGATTT TTGGGATATT
```

```
-continued
151  GGCGGCGAGA GTCCTCCGTC TTTAGAGGAC TACGAGATAC CGCTTTCAGA

201  CGGCAATCGT TCCGTCAGGG CAAACGAATA TGAATCCGCA CAACAATCTT

251  ACTTTTACAG GAAAATAGGG AAGTTTGAAG CCTGCGGGTT GGATTGGCGT

301  ACGCGTGACG GCAAACCTTT GATTGAGACG TTCAAACAGG AAGGTTTTGA

351  TTGTTTGAAA AAGCAGGGGT TGCGGCGCAA CGGTCTGTCC GAGCGCGTCC

401  GATGGTAA
```

This encodes a protein having amino acid sequence (SEQ ID NO: 860):

```
  1  MEIRAIKYTA MAALLAFTVA GCRLAGWYEC SSLSGWCKPR KPAAIDFWDI

51  GGESPPSLED YEIPLSDGNR SVRANEYESA QQSYFYRKIG KFEACGLDWR

101  TRDGKPLIET FKQEGFDCLK KQGLRRNGLS ERVRW*
```

ORF131a (SEQ ID NO: 860) and ORF131-1 (SEQ ID NO: 858) show 97.0% identity in 135 aa overlap:

```
orf131a.pep  MEIRAIKYTAMAALLAFTVAGCRLAGWYECSSLSGWCKPRKPAAIDFWDIGGESPPSLED
             ||||||||||||||||||||||||||||||:|||||||||||||||||||||||||||| |
orf131-1     MEIRAIKYTAMAALLAFTVAGCRLAGWYECSSLTGWCKPRKPAAIDFWDIGGESPPSLGD orf131a.pep  YEIPLSDGNRSVRANEYESAQQSYFYRKIGKFEACGLDWRTRDGKPLIETFKQEGFDCLK
             |||||||||||||||||||||||||||||||||||||||||||||||||||||| |||||:
orf131-1     YEIPLSDGNRSVRANEYESAQQSYFYRKIGKFEACGLDWRTRDGKPLIETFKQGGFDCLE orf131a.pep  KQGLRRNGLSERVRWX
             ||||||||||||||||
orf131-1     KQGLRRNGLSERVRWX
```

Homology with a Predicted ORF from N.gonorrhoeae

ORF131 (SEQ ID NO: 856) shows 89.3% identity over 121 aa overlap with a Predicted ORF (ORF131ng) (SEQ ID NO: 862) from N.gonorrhoeae:

```
orf131.pep  MEIRAIKYTAMAALLAFTVAGCRLAGWYECSSLTGWCKPRKPAAIDFWDIGGESPPSLGD  60
            ||||:|||||  |||:|||||||||||||||  ||:||||||||||||||||||||| || |
orf131ng    MEIRVIKYTATAALFAFTVAGCRLAGWYECLSLSGWCKPRKPAAIDFWDIGGESPLSLED  60 orf131.pep  YEIPLSDGNSSVRANEYESAQQSYFYRKIGKFEXCGLDWRTRDGKPLIETFKQGGFDCLE  120
            |||||||||  |||||||||:|||||||||||  |||||||||||||:| |||  ||||||
orf131ng    YEIPLSDGNRSVRANEYESAQKSYFYRKIGKFEACGLDWRTRDGKPLVERFKQEGFDCLE  120 orf131.pep  K                                                             121
            |
orf131ng    KQGLRRNGLSERVRW                                               134
```

A complete length ORF131ng nucleotide sequence (SEQ ID NO: 861) was predicted to encode a protein having amino acid sequence (SEQ ID NO: 862):

```
  1  MEIRVIKYTA TAALFAFTVA GCRLAGWYEC LSLSGWCKPR KPAAIDFWDI

51  GGESPLSLED YEIPLSDGNR SVRANEYESA QKSYFYRKIG KFEACGLDWR

101  TRDGKPLVER FKQEGFDCLE KQGLRRNGLS ERVRW*
```

Further work revealed the following gonococcal DNA sequence (SEQ ID NO: 863):

```
  1 ATGGAAATTC GGGTAATAAA ATATACGGCA ACGGCTGCGT TGTTTGCATT

51 TACGGTTGCA GGCTGCCGGC TGGCGGGGTG GTATGAGTGT TCGTCCTTGT

101 CCGGCTGGTG TAAGCCGAGA AAACCTGCCG CCATCGATTT TTGGGATATT

151 GGCGGCGAGA GtccgctGTC TTTAGAGGAC TACGAGATAC CGCTTTCAGA

201 CGGCAATCGT TCCGTCAGGG CAAACGAATA TGAATCCGCG CAAAAATCTT

251 ACTTTTATAG GAAAATAGGG AAGTTTGAAG CCTGCGGGTT GGATTGGCGT

301 ACGCGTGACG GCAAACCTTT GGTTGAGAGG TTCAAACAGG AAGGTTTCGA

351 CTGTTTGGAA AAGCAGGGGT TGCGGCGCAA CGGCCTGTCC GAGCGCGTCC

401 GATGGTAA
```

This corresponds to the amino acid sequence (SEQ ID NO: 864; ORF131ng-1):

```
  1 MEIRVIKYTA TAALFAFTVA GCRLAGWYEC SSLSGWCKPR KPAAIDFWDI

51 GGESPLSLED YEIPLSDGNR SVRANEYESA QKSYFYRKIG KFEACGLDWR

101 TRDGKPLVER FKQEGFDCLE KQGLRRNGLS ERVRW*
```

ORF131ng-1 (SEQ ID NO: 864) and ORF131-1 (SEQ ID NO: 858) show 92.6% identity in 135 aa overlap:

```
orf131ng-1.pep  MEIRVIKYTATAALFAFTVAGCRLAGWYECSSLSGWCKPRKPAAIDFWDIGGESPLSLED
                ||||:||||| |||:|||||||||||||||||:|||||||||||||||||||||| || |
orf131-1        MEIRAIKYTAMAALLAFTVAGCRLAGWYECSSLTGWCKPRKPAAIDFWDIGGESPPSLGD orf131ng-1.pep  YEIPLSDGNRSVRANEYESAQKSYFYRKIGKFEACGLDWRTRDGKPLVERFKQEGFDCLE
                |||||||||||||||||||||:||||||||||||||||||||||||||:| ||| ||||||
orf131-1        YEIPLSDGNRSVRANEYESAQQSYFYRKIGKFEACGLDWRTRDGKPLIETFKQGGFDCLE orf131ng1.pep   KQGLRRNGLSERVRWX
                ||||||||||||||||
orf131-1        KQGLRRNGLSERVRWX
```

Based on the presence of a predicted prokaryotic membrane lipoprotein lipid attachment site, it is predicted that the proteins from *N.meningitidis* and *N.gonorrhoeae*, and their epitopes, could be useful antigens for vaccines or diagnostics, or for raising antibodies.

Example 102

The following partial DNA sequence was identified in *N.meningitidis* (SEQ ID NO: 865)

```
  1 ATGAAACACA TCCATATTAT CGGTATCGGC GGCACGTTTA TGGGCGGGCT

51 TGCCGCCATT GCCAAAGAAG CGGGGTTTGA AGTCAGCGGT TGCGACGCGA

101 AGATGTATCC GCCGATGAGC ACCCAGCTCG AAGCCTTGGG TATAGACGTG

151 TATGAAGGCT TCGATGCCGC TCAGTTGGAC GAATTTAAAG CCGACGTTTA

201 CGTTATCGGC AATGTCGCCA AGCGCGGGAT GGATGTGGTT GAAGCGATTT

251 TGAACCTCGG CCTGCCtTAT AtTtCCGGCC CGCAATGGCT GTCGGAAAAC

301 GTGCTGCACC ATCATTGGGT ACTCGGTGTG GCGGGGACgC ACGGCAAAAC

351 GACCACCGCC TCCATGCTCG CATGGGTCTT GGAATATgCC GGCCTCGCGC

401 CGGGCTTCCT TATtGGCGGC GTACC.GGAA AATttCGGCG TTTCCGCCCG
```

-continued

```
 451  CCTGCCGCAA ACGCCGCGCC AAGACCCGAA CAGCCAATCG CCGTTTTTcG
 501  TCATCGAAGC CGACGAATAC GACACCGCCT TTtTCGACAA ACGTTCTAAA
 551  TtCGTGCATT ACCGTCCGCG TACCGCCGTG TTGAACAATC TGGAATTCGA
 601  CCACGCCGAC ATCTTTGCCG ACTTGGGCGC GATACAGACc CAGTTCCACT
 651  ACCTCGTGCG TACCGTGCCG TCTGAAGGCT TAATCGTCTG CAACGGACGG
 701  CAGCAAAGCC TGCAAGATAC TTTGGACAAA GGCTGCTGGA CGCCGGTGGA
 751  AAAATTCGGC ACGAAACACG GCTGGCA..
```

This corresponds to the amino acid sequence (SEQ ID NO: 866; ORF132):

```
   1  MKHIHIIGIG GTFMGGLAAI AKEAGFEVSG CDAKMYPPMS TQLEALGIDV
  51  YEGFDAAQLD EFKADVYVIG NVAKRGMDVV EAILNLGLPY ISGPQWLSEN
 101  VLHHHWVLGV AGTHGKTTTA SMLAWVLEYA GLAPGFLIGG VXGKFRRFRP
 151  PAANAAPRPE QPIAVFRHRS RRIRHRLFRQ TFXIRALPSA YRRVEQSGIR
 201  PRRHLCRLGR DTDPVPLPRA YRAVXRLNRL QRTAAKPARY FGQRLLDAGG
 251  KIRHGTRLA..
```

Further work revealed the complete nucleotide sequence (SEQ ID NO: 867):

```
    1  ATGAAACACA TCCATATTAT CGGTATCGGC GGCACGTTTA TGGGCGGGCT
   51  TGCCGCCATT GCCAAAGAAG CGGGGTTTGA AGTCAGCGGT TGCGACGCGA
  101  AGATGTATCC GCCGATGAGC ACCCAGCTCG AAGCCTTGGG TATAGACGTG
  151  TATGAAGGCT TCGATGCCGC TCAGTTGGAC GAATTTAAAG CCGACGTTTA
  201  CGTTATCGGC AATGTCGCCA AGCGCGGGAT GGATGTGGTT GAAGCGATTT
  251  TGAACCTCGG CCTGCCTTAT ATTTCCGGCC CGCAATGGCT GTCGGAAAAC
  301  GTGCTGCACC ATCATTGGGT ACTCGGTGTG GCGGGGACGC ACGGCAAAAC
  351  GACCACCGCC TCCATGCTCG CATGGGTCTT GGAATATGCC GGCCTCGCGC
  401  CGGGCTTCCT TATTGGCGGC GTACCGGAAA ATTTCGGCGT TTCCGCCCGC
  451  CTGCCGCAAA CGCCGCGCCA AGACCCGAAC AGCCAATCGC CGTTTTTCGT
  501  CATCGAAGCC GACGAATACG ACACCGCCTT TTTCGACAAA CGTTCTAAAT
  551  TCGTGCATTA CCGTCCGCGT ACCGCCGTGT TGAACAATCT GGAATTCGAC
  601  CACGCCGACA TCTTTGCCGA CTTGGGCGCG ATACAGACCC AGTTCCACTA
  651  CCTCGTGCGT ACCGTGCCGT CTGAAGGCTT AATCGTCTGC AACGGACGGC
  701  AGCAAAGCCT GCAAGATACT TTGGACAAAG GCTGCTGGAC GCCGGTGGAA
  751  AAATTCGGCA CGGAACACGG CTGGCAGGCC GGCGAAGCCA ATGCCGACGG
  801  CTCGTTCGAC GTGTTGCTCG ACGGCAAAAC CGCCGGACGC GTCAAATGGG
  851  ATTTGATGGG CAGGCACAAC CGCATGAACG CGCTCGCCGT CATTGCCGCC
  901  GCGCGTCATG TCGGTGTCGA TATTCAGACC GCCTGCGAAG CCTTGGGCGC
  951  GTTTAAAAAC GTCAAACGCC GGATGGAAAT CAAAGGCACG GCAAACGGCA
 1001  TCACCGTTTA CGACGACTTC GCCCACCACC CGACCGCCAT CGAAACCACG
```

```
-continued
1051    ATTCAAGGTT TGCGCCAACG CGTCGGCGGC GCGCGCATCC TCGCCGTCCT

1101    CGAACCGCGT TCCAACACGA TGAAGCTGGG CACGATGAAG TCCGCCCTGC

1151    CTGTAAGCCT CAAAGAAGCC GACCAAGTGT TCTGCTACGC CGGCGGCGTG

1201    GACTGGGACG TCGCCGAAGC CCTCGCGCCT TTGGGCGGCA GGCTGAACGT

1251    CGGCAAAGAC TTCGATGCCT TCGTTGCCGA AATCGTGAAA AACGCCGAAG

1301    TAGGCGACCA TATTTTGGTG ATGAGCAACG GCGGTTTCGG CGGAATACAC

1351    GGAAAGCTGC TGGAAGCTTT GAGATAG
```

This corresponds to the amino acid sequence (SEQ ID NO: 868; ORF132-1):

```
  1   MKHIHIIGIG GTFMGGLAAI AKEAGFEVSG CDAKMYPPMS TQLEALGIDV

51   YEGFDAAQLD EFKADVYVIG NVAKRGMDVV EAILNLGLPY ISGPQWLSEN

101   VLHHHWVLGV AGTHGKTTTA SMLAWVLEYA GLAPGFLIGG VPENFGVSAR

151   LPQTPRQDPN SQSPFFVIEA DEYDTAFFDK RSKFVHYRPR TAVLNNLEFD

201   HADIFADLGA IQTQFHYLVR TVPSEGLIVC NGRQQSLQDT LDKGCWTPVE

251   KFGTEHGWQA GEANADGSFD VLLDGKTAGR VKWDLMGRHN RMNALAVIAA

301   ARHVGVDIQT ACEALGAFKN VKRRMEIKGT ANGITVYDDF AHHPTAIETT

351   IQGLRQRVGG ARILAVLEPR SNTMKLGTMK SALPVSLKEA DQVFCYAGGV

401   DWDVAEALAP LGGRLNVGKD FDAFVAEIVK NAEVGDHILV MSNGGFGGIH

451   GKLLEALR*
```

Computer analysis of this amino acid sequence gave the following results:
Homology with the Hypothetical o457 Protein (SEQ ID NO: 1166) of *E.coli* (Accession Number U14003)
ORF132 (SEQ ID NO: 866) and o457 (SEQ ID NO: 1166) show 58% aa identity in 140 aa overlap:

```
Orf132:    4 IHIIGIGGTFMGGLAAIAKEAGFEVSGCDAKMYPPMSTQLEALGIDVYEGFDAAQLDEFK   63
             IHI+GI GTFMGGLA +A++ G EV+G DA +YPPMST LE   GI++ +G+DA+QL+   +
o457:      3 IHILGICGTFMGGLAMLARQLGHEVTGSDANVYPPMSTLLEKQGIELIQGYDASQLEP-Q   61

Orf132:   64 ADVYVIGNVAKRGMDVVEAILNLGLPYISGPQWLSENVLHHHWVLGVAGTHGKTTTASML  123
             D+ +IGN  RG  VEA+L  +PY+SGPQWL + VL   WVL VAGTHGKTTTA M
o457:     62 PDLVIIGNAMTRGNPCVEAVLEKNIPYMSGPQWLHDFVLRDRWVLAVAGTHGKTTTAGMA  121

Orf132:  124 AWVLEYAGLAPGFLIGGVXG                                          143
             W+LE  G  PGF+IGGV G
o457:    122 TWILEQCGYKPGFVIGGVPG                                          141
```

Homology with a Predicted ORF from *N.meningitidis* (Strain A)
ORF132 (SEQ ID NO: 866) shows 74.6% identity over a 189aa overlap with an ORF (ORF132a) (SEQ ID NO: 870) from strain A of *N. meningitidis*:

```
                        10         20         30         40         50         60
orf132.pep   MKHIHIIGIGGTFMGGLAAIAKEAGFEVSGCDAKMYPPMSTQLEALGIDVYEGFDAAQLD
             ||||||||||||||||||:||||||||||| ||||||||||||||||||| ||||||:||||
orf132a      MKHIHIIGIGGTFMGGIAAIAKEAGFEXSGCDAKMYPPMSTQLEALGIGVYEGFDTAQLD
                        10         20         30         40         50         60
```

```
                  -continued
              70         80         90        100        110        120
orf132.pep  EFKADVYVIGNVAKRGMDVVEAILNLGLPYISGPQWLSENVLHHHWVLGVAGTHGKTTTA
            |||||||||||||||||||||||||||| ||||||||||:|| ||||| |||| ||||||||
orf132a     EFKADVYVIGNVAKRGMDVVEAILNRGLPYISGPQWLAENXLHHHWXLGVAXTHGKTTTA
              70         80         90        100        110        120

130        140        150        160
orf132.pep  SMLAWVLEYAGLAPGFLIGGVXGKFR---RFRPPAANAAPRPEQPI----------AVFR
            ||||||||||||||||||| ||||  :|     |: | :    | |  ::|:         ||
orf132a     SMLAWVLEYAGLAPGFXIGGVPENFSVSARL-PQTPRQDPNSQSPFFVIEADEYDTAFFD
             130        140        150        160        170

170        180        190        200        210        220
orf132.pep  HRSRRIRHRLFRQTFXIRALPSAYRRVEQSGIRPRRHLCRLGRDTDPVPLPRAYRAVXRL
            :||: :::|
orf132a     KRSKFVHYRPRTAVLNNLEFDHADIFADLGAIQTQFHHLVRTVPSEGLIVCNGRQQSLQD
             180        190        200        210        220        230
```

The complete length ORF132a nucleotide sequence (SEQ ID NO: 869) is:

```
   1   ATGAAACACA TCCACATTAT CGGTATCGGC GGCACGTTTA TGGGTGGGAT
  51   TGCCGCCATT GCCAAAGAAG CAGGGTTTGA ANTCAGCGGT TGCGATGCGA
 101   AGATGTATCC GCCGATGAGC ACCCAGCTCG AAGCCTTGGG CATAGGCGTG
 151   TATGAAGGCT TCGACACCGC GCACTTGGAC GAATTTAAAG CCGACGTTTA
 201   CGTTATCGGC AATGTCGCCA AGCGCGGGAT GGATGTGGTT GAAGCGATTT
 251   TGAACCGTGG GCTGCCTTAT ATTTCCGGCC CGCAATGGCT GGCTGAAAAC
 301   NTGCTGCACC ATCATTGGNN ACTCGGCGTG GCGGNGACGC ACGGCGAAAC
 351   GACCACCGCG TCTATGCTCG CGTGGGTTTT GGAATATGCC GGACTCGCAC
 401   CGGGCTTCNT TATCGGCGGC GTACCGGAAA ACTTCAGCGT TTCCGCCCGC
 451   CTGCCGCAAA CGCCGCGCCA AGACCCGAAC AGCCAATCGC CGTTTTTCGT
 501   CATTGAAGCC GACGAATACG ACACCGCGTT TTTCGACAAA CGCTCCAAAT
 551   TCGTGCATTA CCGTCCGCGT ACCGCCGTGT TGAACAATCT GGAATTCGAC
 601   CACGCCGACA TCTTCGCCGA TTTGGGCGCG ATACAGACCC AGTTCCACCA
 651   CCTCGTGCGT ACCGTGCCGT CTGAAGGCCT CATCGTCTGC AACGGACGGC
 701   AGCAAAGCCT GCAAGACACT TTGGACAAAG CTGCTGGAC GCCGGTGGAA
 751   AAATTCGGCA CGGAACACGC CTGGCAGGCC GGCGAAGCCA ATGCCGATGG
 801   CTCGTTCGAC GTGTTGCTTG ACGGCAAAAA AGCCGGACAC GTCGCTTGGA
 851   GTTTGATGGG CGGACACAAC CGCATGAACG CGCTCGCNGT CATCGCCGCC
 901   GCGCGTCATG CCGGAGTNGA CATTCAGACG GCCTGCGAAG CCTTGAGCAC
 951   GTTTAAAAAC GTCAAACGCC GCATGGAAAT CAAAGGCACG GCAAACGGTA
1001   TCACCGTTTA CGACGACTTC GCCCACCATC CGACCGCTAT CGAAACCACG
1051   ATTCAAGGTT TGCGCCAGCG CGTCGGCGGC GCGCGCATCC TCGCCGTCCT
1101   CGAACCGCGT TCCAATACGA TGAAGCTGGG TACGATGAAA GCCGCCCTGC
1151   CCGCAAGCCT CAAAGAAGCC GACCAAGTGT TCTGNTACGC CGGCGGCGCG
1201   GACTGGGACG TTGCCGAAGC CCTCGCGCCT TTGGGCGGCA GGCTGCACGT
1251   CGGCAAAGAC TTCGATGCCT TCGTTGCCGA AATCGTGAAA AACGCCGAAG
1301   CAGGCGACCA TATTTTGGTG ATGAGCAACG GCGGTTTCGG CGGAATACAC
1351   ACCAAACTGC TGGACGCTTT GAGATAG
```

This encodes a protein having amino acid sequence (SEQ ID NO: 870):

```
  1  MKHIHIIGIG GTFMGGIAAI AKEAGFEXSG CDAKMYPPMS TQLEALGIGV

51  YEGFDTAQLD EFKADVYVIG NVAKRGMDVV EAILNRGLPY ISGPQWLAEN

101  XLHHHWXLGV AXTHGKTTTA SMLAWVLEYA GLAPGFXIGG VPENFSVSAR

151  LPQTPRQDPN SQSPFFVIEA DEYDTAFFDK RSKFVHYRPR TAVLNNLEFD

201  HADIFADLGA IQTQFHHLVR TVPSEGLIVC NGRQQSLQDT LDKGCWTPVE

251  KFGTEHGWQA GEANADGSFD VLLDGKKAGH VAWSLMGGHN RMNALAVIAA

301  ARHAGVDIQT ACEALSTFKN VKRRMEIKGT ANGITVYDDF AHHPTAIETT

351  IQGLRQRVGG ARILAVLEPR SNTMKLGTMK AALPASLKEA DQVFXYAGGA

401  DWDVAEALAP LGGRLHVGKD FDAFVAEIVK NAEAGDHILV MSNGGFGGIH

451  TKLLDALR*
```

ORF132a (SEQ ID NO: 870) and ORF132-1 (SEQ ID NO: 868) show 93.9% identity in 458 aa overlap:

```
orf132a.pep  MKHIHIIGIGGTFMGGIAAIAKEAGFEXSGCDAKMYPPMSTQLEALGIGVYEGFDTAQLD
             |||||||||||||||:||||||||| |||||||||||||||||||| ||||||:||||
orf132-1     MKHIHIIGIGGTFMGGLAAIAKEAGFEVSGCDAKMYPPMSTQLEALGIDVYEGFDAAQLD orf132a.pep  EFKADVYVIGNVAKRGMDVVEAILNRGLPYISGPQWLAENXLHHHWXLGVAXTHGKTTTA
             ||||||||||||||||||||||||||| |||||||||||:|| ||||  ||| ||||||
orf132-1     EFKADVYVIGNVAKRGMDVVEAILNLGLPYISGPQWLSENVLHHHWVLGVAGTHGKTTTA orf132a.pep  SMLAWVLEYAGLAPGFXIGGVPENFSVSARLPQTPRQDPNSQSPFFVIEADEYDTAFFDK
             |||||||||||||| ||||||||||:||||||||||||||||||||||||||||||||||
orf132-1     SMLAWVLEYAGLAPGFXIGGVPENFGVSARLPQTPRQDPNSQSPFFVIEADEYDTAFFDK orf132a.pep  RSKFVHYRPRTAVLNNLEFDHADIFADLGAIQTQFHHLVRTVPSEGLIVCNGRQQSLQDT
             ||||||||||||||||||||||||||||||||||||:|||||||||||||||||||||
orf132-1     RSKFVHYRPRTAVLNNLEFDHADIFADLGAIQTQFHYLVRTVPSEGLIVCNGRQQSLQDT orf132a.pep  LDKGCWTPVEKFGTEHGWQAGEANADGSFDVLLDGKKAGHVAWSLMGGHNRMNALAVIAA
             |||||||||||||||||||||||||||||||||||:| |:||| ||||||||||||||
orf132-1     LDKGCWTPVEKFGTEHGWQAGEANADGSFDVLLDGKTAGRVKWDLMGRHNRMNALAVIAA orf132a.pep  ARHAGVDIQTACEALSTFKNVKRRMEIKGTANGITVYDDFAHHPTAIETTIQGLRQRVGG
             |||:|||||||::||||||||||||||||||||||||||||||||||||||||||||
orf132-1     ARHVGVDIQTACEALGAFKNVKRRMEIKGTANGITVYDDFAHHPTAIETTIQGLRQRVGG orf132a.pep  ARILAVLEPRSNTMKLGTMKAALPASLKEADQVFXYAGGADWDVAEALAPLGGRLHVGKD
             |||||||||||||||||||:|||:|||||||||:||||||||||||||||||||:||||
orf132-1     ARILAVLEPRSNTMKLGTMKSALPVSLKEADQVFCYAGGVDWDVAEALAPLGGRLNVGKD orf132a.pep  FDAFVAEIVKNAEAGDHILVMSNGGFGGIHTKLLDALRX
             ||||||||||||:||||||||||||||||| ||:||||
orf132-1     FDAFVAEIVKNAEVGDHILVMSNGGFGGIHGKLLEALRX
```

Homology with a Predicted ORF from N.gonorrhoeae
ORF132 (SEQ ID NO: 866) shows 89.6% identity over 259 aa overlap with a Predicted ORF (ORF132ng) (SEQ ID NO: 872) from N. gonorrhoeae:

```
orf132.pep   MKHIHIIGIGGTFMGGLAAIAKEAGFEVSGCDAKMYPPMSTQLEALGIDVYEGFDAAQLD  60
             ||||||||||||||||:||||||||:||||||||||||||||||||| |:||||||||:
orf132ng     MKHIHIIGIGGTFMGGIAAIAKEAGFKVSGCDAKMYPPMSTQLEALGIGVHEGFDAAQLE  60 orf132.pep   EFKADVYVIGNVAKRGMDVVEAILNLGLPYISGPQWLSENVLHHHWVLGVAGTHGKTTTA  120
             ||:||||||||||:||||||||||||||||||||||:|||||||||||||||||||||
orf132ng     EFQADIYVIGNVARRGMDVVEAILNRGLPYISGPQWLAENVLHHHWVLGVAGTHGKTTTA  120
```

```
                        -continued
orf132.pep  SMLAWVLEYAGLAPGFLIGGVXGKFRRFRPPAANAAPRPEQPIAVFRHRSRRIRHRLFRQ   180
            ||||||||||||||||||||||| |||||||:|||| |||| ||||||||||||||||||
orf132ng    SMLAWVLEYAGLAPGFLIGGVPGKFRRFRPPTANAASRPEQQIAVFRHRSRRIRHRLFRQ   180 orf132.pep  TFXIRALPSAYRRVEQSGIRPRRHLCRLGRDTDPVPLPRAYRAVXRLNRLQRTAAKPARY   240
            |: ||||  |||||||||||||||||  ||||||||||||  |||:|:: | :|||||||||||
orf132ng    TLQIRALSPAYRRVEQSGIRPRRHLRRLGRDTDPVPPPRAHRTIRRPHRLQRTAAKPARY   240 orf132.pep  FGQRLLDAGGKIRHGTRLA                                           259
            ||||||||||||||||| ||||
orf132ng    FGQRLLDAGGKIRHRTRLADW                                         261
```

An ORF132ng nucleotide sequence (SEQ ID NO: 871) was predicted to encode a protein having amino acid sequence (SEQ ID NO: 872):

```
  1  MKHIHIIGIG GTFMGGIAAI AKEAGFKVSG CDAKMYPPMS TQLEALGIGV

51  HEGFDAAQLE EFQADIYVIG NVARRGMDVV EAILNRGLPY ISGPQWLAEN

101  VLHHHWVLGV AGTHGKTTTA SMLAWVLEYA GLAPGFLIGG VPGKFRRFRP

151  PTANAASRPE QQIAVFRHRS RRIRHRLFRQ TLQIRALSPA YRRVEQSGIR

201  PRRHLRRLGR DTDPVPPPRA HRTIRRPHRL QRTAAKPARY FGQRLLDAGG

251  KIRHRTRLAD W*
```

Further work revealed the following gonococcal DNA sequence (SEQ ID NO: 873):

```
   1  ATGAAACACA TCCACATTAT CGGTATCGGC GGCACGTTTA TGGGCGGGAT

51  TGCCGCCATT GCCAAAGAAG CCGGGTTCAA AGTCAGCGGT TGCGACGCGA

101  AGATGTATCC GCCGATGAGC ACCCAGCTCG AAGCCTTGGG CATAGGCGTA

151  CACGAAGGCT TCGATGCCGC GCAGTTGGAA GAATTTCAAG CCGATATTTA

201  CGTCATCGGC AATGTCGCCA GGCGCGGGAT GGATGTGGTC GAGGCGATTT

251  TGAACCGTGG GCTGCCTTAT ATTTCCGGCC CGCAATGGCT GGCTGAAAac

301  GTGCtgcacc atcaTTGGgt ACTCGGCGTG GcagggaCGC ACGGcaaAac 351  gaccaCcGcg tCCATGCTCG CCTGGGTCTT GGAATATGCC GGACTCGCGC 401  CGGGCTTCCT CATCGGCGGt gtaccggaAA ATTTCGGCGT TCCGCCCGC

451  CTACCGCAAA CGCCGCGTCA AGACCCGAAC AGCAAATCGC CGTTTTTCGT

501  CATCGAAGCC GACGAATACG ACACCGCCTT TTTCGACAAA CGCTCCAAAT

551  TCGTGCATTA TCGCCCGCGT ACCGCCGTGT TGAACAATCT GGAATTCGAC

601  CACGCCGACA TCTTCGCCGA CTTGGGCGCG ATACAGACCC AGTTCCACCA

651  CCTCGTGCGC ACCGTACCAT CCGAAGGCCT CATCGTCTGC AACGGACAGC

701  AGCAAAGCCT GCAAGATACT TTGGACAAAG GCTGCTGGAC GCCGGTGGAA

751  AAATTCGGCA CCGGACACGG CTGGCAGATT GGTGAAGTCA ATGCCGACGG

801  CTCGTTCGAC GTATTGCTTG ACGGCAAAAA AGCCGGACAC GTCGCATGGG

851  ATTTGATGGG CGGACACAAC CGCATGAACG CGCTCGCCGT CATCGCTGCC

901  GCACGCCATG CCGGAGTCGA TGTTCAGACG GCCTGCGAAG CCTTGGGTGC

951  GTTTAAAAAC GTCAAACGCC GCATGGAAAT CAAAGGCACG GCAAACGGCA

1001  TCACCGTTTA CGACGATTTC GCCCACCACC CGACCGCCAT CGAAACCACG
```

-continued

```
1051  ATTCAAGGTT TGCGCCAACG TGTCGGCGGC GCGCGCATCC TCGCCGTCCT

1101  CGAGCCGCGT TCCAACACCA TGAAACTCGG CACGATGAAG TCCGCCCTGC

1151  CCGCAAGCCT CAAAGAAGCC GACCAAGTGT TCTGCTACGC CGGCGGCGCG

1201  GACTGGGACG TTGCCGAAGC CCTCGCGCCT TTGGGCTGCA GGCTGCGCGT

1251  CGGTAAAGAT TTCGATACCT TCGTTGCCGA AATTGTGAAA AACGCCCGAA

1301  CCGGCGACCA TATTTTGGTG ATGAGCAACG GCGGTTTCGG CGGAATACAC

1351  ACCAAACTGC TGGACGCTTT GAGATAG
```

This corresponds to the amino acid sequence (SEQ ID NO: 874; ORF132ng-1):

```
  1   MKHIHIIGIG GTFMGGIAAI AKEAGFKVSG CDAKMYPPMS TQLEALGIGV

51   HEGFDAAQLE EFQADIYVIG NVARRGMDVV EAILNRGLPY ISGPQWLAEN

101   VLHHHWVLGV AGTHGKTTTA SMLAWVLEYA GLAPGFLIGG VPENFGVSAR

151   LPQTPRQDPN SKSPFFVIEA DEYDTAFFDK RSKFVHYRPR TAVLNNLEFD

201   HADIFADLGA IQTQFHHLVR TVPSEGLIVC NGQQQSLQDT LDKGCWTPVE

251   KFGTGHGWQI GEVNADGSFD VLLDGKKAGH VAWDLMGGHN RMNALAVIAA

301   ARHAGVDVQT ACEALGAFKN VKRRMEIKGT ANGITVYDDF AHHPTAIETT

351   IQGLRQRVGG ARILAVLEPR SNTMKLGTMK SALPASLKEA DQVFCYAGGA

401   DWDVAEALAP LGCRLRVGKD FDTFVAEIVK NARTGDHILV MSNGGFGGIH

451   TKLLDALR*
```

ORF132ng-1 (SEQ ID NO: 874) and ORF132-1 (SEQ ID NO: 868) show 93.2% identity in 458 aa overlap:

```
orf132ng-1.pep  MKHIHIIGIGGTFMGGIAAIAKEAGFKVSGCDAKMYPPMSTQLEALGIGVHEGFDAAQLE
                ||||||||||||||||||:||||||||:|||||||||||||||||||| |:||||||||:
orf132-1        MKHIHIIGIGGTFMGGLAAIAKEAGFEVSGCDAKMYPPMSTQLEALGIDVYEGFDAAQLD orf132ng-1.pep  EFQADIYVIGNVARRGMDVVEAILNRGLPYISGPQWLAENVLHHHWVLGVAGTHGKTTTA
                ||:||:||||||:|||||||||||||| |||||||||:||||||||||||||||||||||
orf132-1        EFKADVYVIGNVAKRGMDVVEAILNLGLPYISGPQWLSENVLHHHWVLGVAGTHGKTTTA orf132ng-1.pep  SMLAWVLEYAGLAPGFLIGGVPENFGVSARLPQTPRQDPNSKSPFFVIEADEYDTAFFDK
                |||||||||||||||||||||||||||||||||||||||||:||||||||||||||||||
orf132-1        SMLAWVLEYAGLAPGFLIGGVPENFGVSARLPQTPRQDPNSQSPFFVIEADEYDTAFFDK orf132ng-1.pep  RSKFVHYRPRTAVLNNLEFDHADIFADLGAIQTQFHHLVRTVPSEGLIVCNGQQQSLQDT
                |||||||||||||||||||||||||||||||||||:||||||||||||||||:|||||||
orf132-1        RSKFVHYRPRTAVLNNLEFDHADIFADLGAIQTQFHYLVRTVPSEGLIVCNGRQQSLQDT orf132ng-1.pep  LDKGCWTPVEKFGTGHGWQIGEVNADGSFDVLLDGKKAGHVAWDLMGGHNRMNALAVIAA
                |||||||||||| |||| ||:|||||||||||| ||:| ||||| ||||||||||||||||
orf132-1        LDKGCWTPVEKFGTEHGWQAGEANADGSFDVLLDGKTAGRVKWDLMGRHNRMNALAVIAA orf132ng-1.pep  ARHAGVDVQTACEALGAFKNVKRRMEIKGTANGITVYDDFAHHPTAIETTIQGLRQRVGG
                |||:|||:||||||||||||||||||||||||||||||||||||||||||||||||||||
orf132-1        ARHVGVDIQTACEALGAFKNVKRRMEIKGTANGITVYDDFAHHPTAIETTIQGLRQRVGG orf132ng-1.pep  ARILAVLEPRSNTMKLGTMKSALPASLKEADQVFCYAGGADWDVAEALAPLGCRLRVGKD
                ||||||||||||||||||||||||:|||||||||||||||:|||||||||||| || ||||
orf132-1        ARILAVLEPRSNTMKLGTMKSALPVSLKEADQVFCYAGGVDWDVAEALAPLGGRLNVGKD orf132ng-1.pep  FDTFVAEIVKNARTGDHILVMSNGGFGGIHTKLLDALRX
                ||:|||||||||::|||||||||||||||| |||:||||
orf132-1        FDAFVAEIVKNAEVGDHILVMSNGGFGGIHGKLLEALRX
```

In addition, ORF132ng-1 (SEQ ID NO: 874) is homologous to a hypothetical *E.coli* protein (SEQ ID NO: 1166):

```
pir||S56459 hypothetical protein o457 - Escherichia coli )gi|537075 (U14003)
ORF_o457 [Escherichia coli] )gi|1790680 (AE000494) hypothetical 48.5 kD protein in
fbp-pmba intergenic region [Escherichia coli]Length = 457
Score = 474 bits (1207), Expect = e-133
Identities = 249/439 (56%), Positives = 294/439 (66%), Gaps = 13/439 (2%)

Query:    22  KEAGFKVSGCDAKMYPPMSTQLEALGIGVHEGFDAAQLEEFQADIYVIGNVARRGMDVVE   81
              ++ G +V+G DA +YPPMST LE   GI + +G+DA+QLE   Q D+ +IGN    RG    VE
Sbjct:    21  RQLGHEVTGSDANVYPPMSTLLEKQGIELIQGYDASQLEP-QPDLVIIGNAMTRGNPCVE   79

Query:    82  ATLNRGLPYISGPQWLAENVLHHHWVLGVAGTHGKTTTASMLAWVLEYAGLAPGFLIGGV  141
              A+L + +PY+SGPQWL + VL    WVL VAGTHGKTTTA M  W+LE   G   PGF+IGGV
Sbjct:    80  AVLEKNIPYMSGPQWLHDFVLRDRWVLAVAGTHGKTTTAGMATWILEQCGYKPGFVIGGV  139

Query:   142  PENFGVSARLPQTPRQDPNSKSPFFVIEADEYDTAFFDKRSKFVHYRPRTAVLNNLEFDH  201
              P NF VSA L             +S FFVIEADEYD AFFDKRSKFVHY PRT +LNNLEFDH
Sbjct:   140  PGNFEVSAHL---------GESDFFVIEADEYDCAFFDKRSKFVHYCPRTLILNNLEFDH  190

Query:   202  ADIFADLGATQTQFHHLVRTVPSEGLTVCNGQQQSLQDTLDKGCWTPVEKFGTGHGWQIG  261
              ADIF DL  AIQ QFHHLVR VP +G I+        +L+ T+   GCW+   E  G    WQ
Sbjct:   191  ADIFDDLKAIQKQFHHLVRIVPGQGRIIWPENDINLKQTMAMGCWSEQELVGEQGHWQAK  250

Query:   262  EVNADGS-FDVLLDGKKAGHVAWDLMGGHNRMNALAVIAAARHAGVDVQTACEALGAFKN  320
              ++   D S ++VLLDG+K G V W L+G HN  N L  IAAARH GV   A  ALG+F N
Sbjct:   251  KLTTDASEWEVLLDGEKVGEVKWSLVGEHNMHNGLMAIAAARHVGVAPADAANALGSFIN  310

Query:   321  VKRRMEIKGTANGITVYDDFAHHPTAIETTIQGLRQRVGG-ARILAVLEPRSNTMKLGTM  379
               +RR+E++G ANG+TVYDDFAHHPTAI   T+   LR +VGG ARI+AVLEPRSNTMK+G
Sbjct:   311  ARRRLELRGEANGVTVYDDFAHHPTAILATLAALRGKVGGTARIIAVLEPRSNTMKMGIC  370

Query:   380  KSALPASLKEADQVF-CYAGGADWDVAEALAPLGCRLRVGKDFDTFVAEIVKNARTGDHI  438
              K  L  SL  AD+VF       W VAE           D DT    +VK A+ GDHI
Sbjct:   371  KDDLAPSLGRADEVFLLQPAHIPWQVAEVAEACVQPAHWSGDVDTLADMVVKTAQPGDHI  430

Query:   439  LVMSNGGFGGIHTKLLDAL                                          457
              LVMSNGGFGGIH KILLD L
Sbjct:   431  LVMSNGGFGGIHQKLLDGL                                          449
```

Based on this analysis, it was predicted that these proteins from *N.meningitidis* and *N.gonorrhoeae*, and their epitopes, could be useful antigens for vaccines or diagnostics, or for raising antibodies.

ORF132-1 (SEQ ID NO: 868) (26.4 kDa) was cloned in pET and pGex vectors and expressed in *E.coli*, as described above. The products of protein expression and purification were analyzed by SDS-PAGE. FIG. 20A shows the results of affinity purification of the His-fusion protein, and FIG. 20B shows the results of expression of the GST-fusion in *E.coli*.

Purified His-fusion protein was used to immunise mice, whose sera were used for FACS analysis (FIG. 20C) and ELISA (positive result). These experiments confirm that ORF132 (SEQ ID NO: 866) is a surface-exposed protein, and that it is a useful immunogen.

Example 103

The following partial DNA sequence was identified in *N.meningitidis* (SEQ ID NO: 875)

```
  1  ..CCGGGCTATT ACGGCTCGGA TGACGAATTT AAGCGGGCAT TCGGAGAAAA
 51    CTCGCCGACA TmCAAGAAAC ATTGCAACCG GAGCTGCGGG ATTTATGAAC
101    CCGTATTGAA AAAATACGGC AAAAAGCGCG CCAACAACCA TTCGGTCAGC
151    ATTAGTGCGG ACTTCGGCGA TTATTTCATG CCGTTCGCCA GCTATTCGCG
201    CACACACCGT ATGCCCAACA TCCAAGAAAT GTATTTTTCC CAAATCGGCG
251    ACTCCGGCGT TCACACCGCC TTAAAACCAG AGCGCGCAAA CACTTGGCAA
301    TTTGGCTTCr ATACCTATAA AAAAGGATTG TTAAAACAAG ATGATACATT
351    AGGATTAAAA CTGGTCGGCT ACCGCAGCCG CATCGACAAC TACATCCACA
401    ACGTTTACGG GAAATGGTGG GATTTGAACG GGGATATTCC GAGCTGGGTC
451    AGCAGCACCG GGCTTGCCTA CACCATCCAA CATCGCrATT TCAwAGACAA
501    AGTGCATCAA nnnnnnnnnn nnnnnnnnnn nnnnTACGAT TATGGGCGTT
```

```
                  -continued
551    TTTTCACCAA CCTTTCTTAC GCCTATCAAA AAAGCACGCA ACCGACCAAC

601    TTCAGCGATG CGAGCGAATC GCCCAACAAT GCGTCCAAAG AAGACCAACT

651    CAAACAAGGT TATGGGTTGA GCAGGGTTTC CGCCCTGCCG CGAGATTACG

701    GACGTTTGGA AGTCGGTACG CGCTGGTTGG GCAACAAACT GACTTTGGGC

751    GGCGCGATGC GCTATTTCGG CAAGAGCATC CGCGCGACGG CTGAAGAACG

801    CTATATCGAC GGCACCAACG GGGGAAATAC CAGCAATTTC CGGCAACTGG

851    GCAAGCGTTC CATCAAACAA ACCGAAACTC TTGCCCGCCA GCCTTTGATT

901    TTwGATTTTa ACGCCGCTTA CGAGCCGAAG AAAAACCTTA TTTTCCGCGC

951    CGAAGTCAAA AATCTGTTCG ACAGGCGTTA TATCGATCCG CTCGATGCGG

1001   GCAATGATGC GGCAAC.GAG CGTTATTACA GCTCGTTCGA CCCGAAAGAC

1051   AAGGACrrAG ACGTAACGTG TAATGCTGAT AAAACGTTGT GCaACGGCAA

1101   ATACGGCGGC ACAAGCAAAA GCGTATTGAC CAATTTTGCA CGCGGACGCA

1151   CCTTTTTgAT GACGATGAGC TACAAGTTTT AA
```

This corresponds to the amino acid sequence (SEQ ID NO: 876; ORF133):

```
  1   ..PGYYGSDDEF KRAFGENSPT XKKHCNRSCG IYEPVLKKYG KKRANNHSVS

51     ISADFGDYFM PFASYSRTHR MPNIQEMYFS QIGDSGVHTA LKPERANTWQ

101     FGFXTYKKGL LKQDDTLGLK LVGYRSRIDN YIHNVYGKWW DLNGDIPSWV

151     SSTGLAYTIQ HRXFXDKVHQ XXXXXXXXYD YGRFFTNLSY AYQKSTQPTN

201     FSDASESPNN ASKEDQLKQG YGLSRVSALP RDYGRLEVGT RWLGNKLTLG

251     GAMRYFGKSI RATAEERYID GTNGGNTSNF RQLGKRSIKQ TETLARQPLI

301     XDFNAAYEPK KNLIFRAEVK NLFDRRYIDP LDAGNDAAXE RYYSSFDPKD

351     KDXDVTCNAD KTLCNGKYGG TSKSVLTNFA RGRTFLMTMS YKF*
```

Further work revealed the further partial DNA sequence (SEQ ID NO: 877):

```
  1   GAGGCGCAGA TACAGGTTTT GGAAGATGTG CACGTCAAGG CGAAGCGCGT

51   ACCGAAAGAC AAAAAAGTGT TTACCGATGC GCGTGCCGTA TCGACCCGTC

101   AGGATATATT CAAATCCAGC GAAAACCTCG ACAACATCGT ACGCAGCATC

151   CCCGGTGCGT TTACACAGCA AGATAAAAGC TCGGGCATTG TGTCTTTGAA

201   TATTCGCGGC GACAGCGGGT TCGGCGGGT CAATACGATG GTGGACGGCA

251   TCACGCAGAC CTTTTATTCG ACTTCTACCG ATGCGGGCAG GGCAGGCGGT

301   TCATCTCAAT TCGGTGCATC TGTCGACAGC AATTTTATTG CCGGACTGGA

351   TGTCGTCAAA GGCAGCTTCA GCGGCTCGGC AGGCATCAAC AGCCTTGCCG

401   GTTCGGCGAA TCTGCGGACT TTAGGCGTGG ATGACGTCGT TCAGGGCAAT

451   AATACCTACG GCCTGCTGCT AAAAGGTCTG ACCGGCACCA ATTCAACCAA

501   AGGTAATGCG ATGGCGGCGA TAGGTGCGCG CAAATGGCTG AAAGCGGAG

551   CATCTGTCGG TGTGCTTTAC GGGCACAGCA GGCGCAGCGT GGCGCAAAAT

601   TACCGCGTGG GCGGCGGCGG GCAGCACATC GGAAATTTTG GCGCGGAATA

651   TTTGGAACGG CGCAAGCAGC GATATTTTGT ACAAGAGGGT GCTTTGAAAT
```

```
                      -continued
 701   TCAATTCCGA CAGCGGAAAA TGGGAGCGGG ATTTACAAAG GCAACAGTGG
 751   AAATACAAGC CGTATAAAAA TTACAACAAC CAAGAACTAC AaAAATACAT
 801   CGAAGAGCAT GACAAAAGCT GGCGGGAAAA CCTg.CaCCG CAATACGACA
 851   TTACCCCCAT CGATCCGTCC AGCCTGAAGC AGCAGTCGGC AGGCAATCTG
 901   TTTAAATTGG AATACGACGG CGTATTCAAT AAATACACGG CGCAATTTCG
 951   CGATTTAAAC ACCAAAATCG GCAGCCGCAA AATCATCAAC CGCAATTATC
1001   AGTTCAATTA CGGTTTGTCT TTGAACCCGT ATACCAACCT CAATCTGACC
1051   GCAGCCTACA ATTCGGGCAG GCAGAAATAT CCGAAAGGGT CGAAGTTTAC
1101   AGGCTGGGGG CTTTTAAAGG ATTTTGAAAC CTACAACAAC GCGAAAATCC
1151   TCGACCTCAA CAACACCGCC ACCTTCCGGC TGCCCCGCGA AACCGAGTTG
1201   CAAACCACTT TGGGCTTCAA TTATTTCCAC AACGAATACG GCAAAAACCG
1251   CTTTCCTGAA GAATTGGGGC TGTTTTTCGA CGGTCCTGAT CAGGACAACG
1301   GGCTTTATTC CTATTTGGGG CGGTTTAAGG GCGATAAAGG GCTGCTGCCC
1351   CAAAAATCAA CCATTGTCCA ACCGGCCGGC AGCCAATATT TCAACACGTT
1401   CTACTTCGAT GCCGCGCTCA AAAAGACAT TTACCGCTTA AACTACAGCA
1451   CCAATACCGT CGGCTACCGT TTCGGCGGCG AATATACGGG CTATTACGGC
1501   TCGGATGACG AATTTAAGCG GGCATTCGGA GAAAACTCGC CGACATACAA
1551   GAAACATTGC AACCGGAGCT GCGGGATTTA TGAACCCGTA TTGAAAAAAT
1601   ACGGCAAAAA GCGCGCCAAC AACCATTCGG TCAGCATTAG TGCGGACTTC
1651   GGCGATTATT TCATGCCGTT CGCCAGCTAT TCGCGCACAC ACCGTATGCC
1701   CAACATCCAA GAAATGTATT TTTCCCAAAT CGGCGACTCC GGCGTTCACA
1751   CCGCCTTAAA ACCAGAGCGC GCAAACACTT GGCAATTTGG CTTCAATACC
1801   TATAAAAAAG GATTGTTAAA ACAAGATGAT ACATTAGGAT TAAAACTGGT
1851   CGGCTACCGC AGCCGCATCG ACAACTACAT CCACAACGTT TACGGGAAAT
1901   GGTGGGATTT GAACGGGGAT ATTCCGAGCT GGGTCAGCAG CACCGGGCTT
1951   GCCTACACCA TCCAACATCG CAATTTCAAA GACAAAGTGC ACAAACACGG
2001   TTTTGAGTTG GAGCTGAATT ACGATTATGG GCGTTTTTTC ACCAACCTTT
2051   CTTACGCCTA TCAAAAAAGC ACGCAACCGA CCAACTTCAG CGATGCGAGC
2101   GAATCGCCCA ACAATGCGTC CAAAGAAGAC CAACTCAAAC AAGGTTATGG
2151   GTTGAGCAGG GTTTCCGCCC TGCCGCGAGA TTACGGACGT TTGGAAGTCG
2201   GTACGCGCTG GTTGGGCAAC AAACTGACTT TGGGCGGCGC GATGCGCTAT
2251   TTCGGCAAGA GCATCCGCGC GACGGCTGAA GAACGCTATA TCGACGGCAC
2301   CAACGGGGGA AATACCAGCA ATTTCCGGCA ACTGGGCAAG CGTTCCATCA
2351   AACAAACCGA AACTCTTGCC CGCCAGCCTT TGATTTTTGA TTTTTACGCC
2401   GCTTACGAGC CGAAGAAAAA CCTTATTTTC CGCGCCGAAG TCAAAAATCT
2451   GTTCGACAGG CGTTATATCG ATCCGCTCGA TGCGGGCAAT GATGCGGCAA
2501   CGCAGCGTTA TTACAGCTCG TTCGACCCGA AGACAAGGA CGAAGACGTA
2551   ACGTGTAATG CTGATAAAAC GTTGTGCAAC GGCAAATACG GCGGCACAAG
2601   CAAAAGCGTA TTGACCAATT TTGCACGCGG ACGCACCTTT TTGATGACGA
2651   TGAGCTACAA GTTTTAA
```

This corresponds to the amino acid sequence (SEQ ID NO: 878; ORF133-1):

```
  1 EAQIQVLEDV HVKAKRVPKD KKVFTDARAV STRQDIFKSS ENLDNIVRSI

51 PGAFTQQDKS SGIVSLNIRG DSGFGRVNTM VDGITQTFYS TSTDAGRAGG

101 SSQFGASVDS NFIAGLDVVK GSFSGSAGIN SLAGSANLRT LGVDDVVQGN

151 NTYGLLLKGL TGTNSTKGNA MAAIGARKWL ESGASVGVLY GHSRRSVAQN

201 YRVGGGGQHI GNFGAEYLER RKQRYFVQEG ALKFNSDSGK WERDLQRQQW

251 KYKPYKNYNN QELQKYIEEH DKSWRENLXP QYDITPIDPS SLKQQSAGNL

301 FKLEYDGVFN KYTAQFRDLN TKIGSRKIIN RNYQFNYGLS LNPYTNLNLT

351 AAYNSGRQKY PKGSKFTGWG LLKDFETYNN AKILDLNNTA TFRLPRETEL

401 QTTLGFNYFH NEYGKNRFPE ELGLFFDGPD QDNGLYSYLG RFKGDKGLLP

451 QKSTIVQPAG SQYFNTFYFD AALKKDIYRL NYSTNTVGYR FGGEYTGYYG

501 SDDEFKRAFG ENSPTYKKHC NRSCGIYEPV LKKYGKKRAN NHSVSISADF

551 GDYFMPFASY SRTHRMPNIQ EMYFSQIGDS GVHTALKPER ANTWQFGFNT

601 YKKGLLKQDD TLGLKLVGYR SRIDNYIHNV YGKWWDLNGD IPSWVSSTGL

651 AYTIQHRNFK DKVHKHGFEL ELNYDYGRFF TNLSYAYQKS TQPTNFSDAS

701 ESPNNASKED QLKQGYGLSR VSALPRDYGR LEVGTRWLGN KLTLGGAMRY

751 FGKSIRATAE ERYIDGTNGG NTSNFRQLGK RSIKQTETLA RQPLIFDFYA

801 AYEPKKNLIF RAEVKNLFDR RYIDPLDAGN DAATQRYYSS FDPKDKDEDV

851 TCNADKTLCN GKYGGTSKSV LTNFARGRTF LMTMSYKF*
```

Computer analysis of this amino acid sequence gave the following results:
Homology with the Probable TonB-dependent Receptor HI121 of *H.influenzae* (Accession Number U32801) (SEQ ID NO: 1167)
ORF133 (SEQ ID NO: 876) and H1121 (SEQ ID NO: 1167) show 57% aa identity in 363aa overlap:

```
Orf133:  31 IYEPVLKKYGKKRANNHSVSISADFGDYFMPFASYSRTHRMPNIQEMYFSQIGDSGVHTA  90
             I EP+L K G K+A NHS ++SA+  DYFMPF +YSRTHRMPNIQEM+FSQ+ ++GV+TA
HI121:  563 INEPILHKSGHKKAFNHSATLSAELSDYFWPFFTYSRTHRNPNIQEMFFSQVSNAGVNTA  622

Orf133:  91 LKPERANTWQFGFXTYKKGLLKQDDTLGLKLVGYRSRIDNYIHNVYGKWWDLNGDIPSWV 150
             LKPE+++T+Q GF TYKKGL QDD LG+KLVGYRS I NYIHNVYG WW      +P+W
HI121:  623 LKPEQSDTYQLGFNTYKKGLFTQDDVLGVKLVGYRSFIKNYIHNVYGVWW--RDGMPTWA 680

Orf133: 151 SSTGLAYTIQHRXFXDKVHXXXXXXXXXYDYGRFFTNLSYAYQKSTQPTNFSDASESPNN 210
                  S G  YTI H+ +    V         YD GRFF N+SYAYQ++ QPTN++DAS  PNN
HI121:  681 ESNGFKYTIAHQNYKPIVKKSGVELEINYDMGRFFANVSYAYQRTNQPTNYADASPRPNN 740

Orf133  211 ASKEDQLKQGYGLSRVSALPRDYGRLEVGTRWLGNKLTLGGAMRYFGKSIRATAEERYID 270
             AS+ED LKQGYGLSRVS LP+DYGRLE+GTRW   KLTLG A RY+GKS RAT EE YI+
HI121:  741 ASQEDILKQGYGLSRVSMLPKDYGRLELGTRWFDQKLTLGLAARYYGKSKRATIEEEYIN 800

Orf133: 271 GTNGGNTSNFRQLGKRSIKQTETLARQPLIXDFNAAYEPKKNLIFRAEVKNLFDRRYIDP 330
             G+     + R+     ++K+TE + +QP+I D + +YEP K+LI +AEV+NL D+RY+DP
HI121:  801 GSR-FKKNTLRRENYYAVKKTEDIKKQPIILDLHVSYEPIKDLIIKAEVQNLLDKRYVDP 859

Orf133: 331 LDAGNDAAXERYYSSFDPKDKDXDVTCNADKTLCNGKYGGTSKSVLTNFARGRTFLMTMS 390
             LDAGNDAA +RYYSS       +  + C  D + C     GG+ K+VL NFARGRT++++++
HI121:  860 LDAGNDAASQRYYSSL-----NNSIECAQDSSAC----GGSDKTVLYNFARGRTYILSLN 910

Orf133: 391 YKF                                                          393
             YKF
HI121:  911 YKF                                                          913
```

Homology with a Predicted ORF from *N.meningitidis* (Strain A)

ORF133 (SEQ ID NO: 876) shows 90.8% identity over a 392aa overlap with an ORF (ORF133a) (SEQ ID NO: 880) from strain A of *N. meningitidis*:

```
                                            10        20        30
orf133.pep                          PGYYGSDDEFKRAFGENSPTXKKHCNRSCGI
                                    |||  |||||||||||||||  ||||:||||
orf133a     FYFDAALKKDIYRLNYSTNTVGYRFGGXYTGYYXSDDEFKRAFGENSPTYXKHCNQSCGI
            450       460       470       480       490       500

40        50        60        70        80        90
orf133.pep  YEPVLKKYGKKRANNHSVSISADFGDYFMPFASYSRTHRMPNIQEMYFSQIGDSGVHTAL
            ||||||||||||||||||||||||||||||||||||||||||||||||||||||||||||
orf133a     YEPVLKKYGKKRANNHSVSISADFGDYFMPFASYSRTHRMPNIQEMYFSQIGDSGVHTAL
            510       520       530       540       550       560

100       110       120       130       140       150
orf133.pep  KPERANTWQFGFXTYKKGLLKQDDTLGLKLVGYRSRIDNYIHNVYGKWWDLNGDIPSWVS
            |||||||||||| |||||||||||||  ||||||||||||| |||||||||||||:|||||
orf133a     KPERANTWQFGFNTYKKGLLKQDDILGLKLVGYRSRIDXYIHNVYGKWWDLNGNIPSWVS
            570       580       590       600       610       620

160       170       180       190       200       210
orf133.pep  STGLAYTIQHRXFXDKVHQXXXXXXXXXYDYGRFFTNLSYAYQKSTQPTNFSDASESPNNA
            ||||||||||| | ||||:         ||| ||||||||||||||||||||||||||||
orf133a     STGLAYTTQHRNFKDKVHKHGFELELNYDYXRFFTNLSYAYQKSTQPTNFSDASESPNNA
            630       640       650       660       670       680

220       230       240       250       260       270
orf133.pep  SKEDQLKQGYGLSRVSALPRDYGRLEVGTRWLGNKLTLGGAMRYFGKSIRATAEERYIDG
            ||||||||||||||||||||||||||||||||||||||||||||||||||||||||||
orf133a     SKEDQLKQGYGLSRVSALPRDYGRLEVGTRWLGNKLTLGGAMRYFGKSIRATAEERYIDX
            690       700       710       720       730       740

280       290       300       310       320       330
orf133.pep  TNGGNTSNFRQLGKRSIKQTETLARQPLIXDFNAAYEPKKNLIFRAEVKNLFDRRYIDPL
            |||   ||||||||||||| ||||||||||| | ||||||| |||||||||||||||||
orf133a     TNGXXTSNFRQLGKRSIXQTETLARQPLIFDXYAAYEPKKXLIFRAEVKNLFDRRYIDPL
            750       760       770       780       790       800

340       350       360       370       380       390
orf133.pep  DAGNDAAXERYYSSFDPKDKDXDVTCNADKTLCNGKYGGTSKSVLTNFARGRTFLMTMSY
            |||||| ::|||||||||||| :||| |:|||||||||||||||||||||| :|||||
orf133a     DAGNDAATQRYYSSFDPKDKDEEVTCNDDNTLCNGKYGGTSKSVLTNFARGXTFLITMSY
            810       820       830       840       850       860 orf133.pep  KFX
            |||
orf133a     KFX
            870
```

A partial ORF133a nucleotide sequence (SEQ ID NO: 879) is:

```
  1  AAAGACAAAA AAGTGTTTAC CGATGCGCGT GCCGTATCGA CCCGTCAGGA

51  TATATTCAAA TCCANCGAAA ACCTCGACAA CATCGTACGC ANCATCCCCG

101  GTGCGTTTAC ACANCAANAT AAAAGCTCGG GCNTTGTGTC TTTGAATATT

151  CGCNGCGACA GCGGGTTCGG GCGGGTCAAT ACNATGGTNG ACGGCATCAC

201  NCANACCTTT TATTCGACTT CTACCGATGC GGGCAGGGCA GGCGGTTCAT

251  CTCAATTCGG TGCATCTGTC GACAGCAATT TTATNGCCGG ACTGGATGTC

301  GTCAAAGGCA GCTTCAGCGG CTCGGCAGGC ATCAACAGCC TTGCCGGTTC

351  GGCGAATCTG CGGACTTTAN GCGTGGATGA TGTCGTTCAG GGCAATANTA

401  CNTACGGCCT GCTGCTAAAA GGTCTGACCG GCACCAATTC AACCAAGGT

451  AATGCGATGG CGGCGATAGG TGCGCGCAAA TGGCTGGAAA GCGGAGCATC
```

-continued

```
 501  TGTCGGTGTG CTTTACGGGC ACAGCAGGCG CAGCGTGGCG CAAAATTACC
 551  GCGTGGGCGG CGGCGGGCAG CACATCGGAA ATTTTGGCGC GGAATATCTG
 601  GAACGACGCA AGCAACGATA TTTTGAGCAA GAAGGCGGGT TGAAATTCAA
 651  TTCCAACAGC GGAAAATGGG AGCGGGATTT CCAAAAGTCG TACTGGAAAA
 701  CCAAGTGGTA TCAAAAATAC GATGCCCCCC AAGAACTGCA AAAATACATC
 751  GAAGGTCATG ATAAAAGCTG GCGGGAAAAC CTGGCGCCGC AATACGACAT
 801  CACCCCCATC GATCCGTCCA GCCTGAAGCN GCAGTCGGCA GGCAACCTGT
 851  TTAAATTGGA ATACGACGGC GTATTCAATA AATACACGGC GCAATTTCGC
 901  GATTTAAACA CCAAAATCGG CAGCCGCAAA ATCATCAACC GCAATTATCA
 951  ATTCAATTAC GGTTTGTCTT TGAACCCGTA TACCAACCTC AATCTGACCG
1001  CAGCCTACAA TTCGGGCAGG CAGAAATATC CGAAAGGGTC GAAGTTTACA
1051  GGCTGGGGGC TTTTNAAAGA TTTTGAAACC TACAACAACG CAAAAATCCT
1101  CGACCTCANC AACACCTCCA CCTTCCGGCT GCCCCGTGAA ACCGAGTTGC
1151  AAACCACTTT GGGCTTCAAT TATTTCCACA ACGAATACGG CAAAAACCGC
1201  TTTCCTGAAG AATTGGGGCT GTTTTTCGAC GGTCCGGATC ANGACAACGG
1251  GCTTTATTCC TATTTGGGGC GGTTTAAGGG CGATAAAGGG CTGCTGCCCC
1301  AAAAATCAAC CATTGTCCAA CCGGCCGGCA GCCAATATTT CAACACGTTC
1351  TACTTCGATG CCGCGCTCAA AAAAGACATT TACCGCTTAA ACTACAGCAC
1401  CAATACCGTC GGCTACCGTT TCGGCGGCNA ATATACGGGC TATTACNGCT
1451  CGGATGACGA ATTTAAGCGG GCATTCGGAG AAAACTCGCC GACATACANG
1501  AAACATTGCA ACCAGAGCTG CGGGATTTAT GAACCCGTAT TGAAAAAATA
1551  CGGCAAAAAG CGCGCCAACA ACCATTCGGT CAGCATTAGT GCGGACTTCG
1601  GCGATTATTT CATGCCGTTC GCCAGCTATT CGCGCACACA CCGTATGCCC
1651  AACATCCAAG AAATGTATTT TTCCCAAATC GGCGACTCCG GCGTTCACAC
1701  CGCCTTAAAA CCAGAGCGCG CAAACACTTG GCAATTTGGC TTCAATACCT
1751  ATAAAAAAGG ATTGTTAAAA CAAGATGATA TATTAGGATT AAAACTGGTC
1801  GGCTACCGCA GCCGCATCGA CNACTACATC CACAACGTTT ACGGGAAATG
1851  GTGGGATTTG AACGGGAATA TTCCGAGCTG GGTCAGCAGC ACCGGGCTTG
1901  CCTACACCAT CCAACACCGC AATTTCAAAG ACAAAGTGCA CAAACACGGT
1951  TTTGAGTTGG AGCTGAATTA CGATTATNGG CGTTTTTTCA CCAACCTTTC
2001  TTACGCCTAT CAAAAAAGCA CGCAACCGAC CAACTTCAGC GATGCGAGCG
2051  AATCGCCCAA CAATGCGTCC AAAGAAGACC AACTCAAACA AGGTTATGGG
2101  TTGAGCAGGG TTTCCGCCCT GCCGCGAGAT TACGGACGTT TGGAAGTCGG
2151  TACGCGCTGG TTGGGCAACA AACTGACTTT GGGCGGCGCG ATGCGCTATT
2201  TCGGCAAGAG CATCCGCGCG ACGGCTGAAG AACGCTATAT CGACGNCACC
2251  AATGGGGNAN NTACCAGCAA TTTCCGAAAA CTGGGCAAGC GTTCCATCAN
2301  ACAAACCGAA ACCCTTGCCC GCCAGCCTTT GATTTTTGAT TTNTACGCCG
2351  CTTACGAGCC GAAGAAAAAN CTTATTTTCC GCGCCGAAGT CAAAAATCTG
2401  TTCGACAGGC GTTATATCGA TCCGCTCGAT GCGGGCAATG ATGCGGCAAC
2451  GCAGCGTTAT TACAGTTCGT TCGACCCGAA AGACAAGGAC GAAGAAGTAA
```

```
                         -continued
2501  CGTGTAATGA TGATAACACG TTATGCAACG GCAAATACGG CGGCACAAGC

2551  AAAAGCGTAT TGACCAATTT TGCACGCGGA CNCACCTTTT TGATAACGAT

2601  GAGCTACAAG TTTTAA
```

This encodes a protein having (partial) amino acid sequence (SEQ ID NO: 880):

```
  1  KDKKVFTDAR AVSTRQDIFK SXENLDNIVR XIPGAFTXQX KSSGXVSLNI

51  RXDSGFGRVN TMVDGITXTF YSTSTDAGRA GGSSQFGASV DSNFXAGLDV

101  VKGSFSGSAG INSLAGSANL RTLXVDDVVQ GNXTYGLLLK GLTGTNSTKG

151  NAMAAIGARK WLESGASVGV LYGHSRRSVA QNYRVGGGGQ HIGNFGAEYL

201  ERRKQRYFEQ EGGLKFNSNS GKWERDFQKS YWKTKNYQKY DAPQELQKYI

251  EGRDKSWREN LAPQYDITPI DPSSLKXQSA GNLFKLEYDG VFNKYTAQFR

301  DLNTKIGSRK IINRNYQFNY GLSLNPYTNL NLTAAYNSGR QKYPKGSKFT

351  GWGLXKDFET YNNAKILDLX NTSTFRLPRE TELQTTLGFN YFMNEYGKNR

401  FPEELGLFFD GPDXDNGLYS YLGRFKGDKG LLPQKSTIVQ PAGSQYFNTF

451  YFDAALKKDI YRLNYSTNTV GYRFGGXYTG YYXSDDEFKR AFGENSPTYX

501  KHCNQSCGIY EPVLKKYGKK RANNHSVSIS ADFGDYFMPF ASYSRTHRMP

551  NIQEMYFSQI GDSGVHTALK PERANTWQFG FNTYKKGLLK QDDILGLKLV

601  GYRSRIDXYI HNVYGKWWDL NGNIPSWVSS TGLAYTIQHR NFKDKVHKHG

651  FELELNYDYX RFFTNLSYAY QKSTQPTNFS DASESPNNAS KEDQLKQGYG

701  LSRVSALPRD YGRLEVGTRW LGNKLTLGGA MRYFGKSIRA TAEERYIDXT

751  NGXXTSNFRQ LGKRSIXQTE TLARQPLIFD XYAAYEPKKX LIFRAEVKNL

801  FDRRYIDPLD AGNDAATQRY YSSFDPKDKD EEVTCNDDNT LCNGKYGGTS

851  KSVLTNFARG XTFLITMSYK F*
```

ORF133a (SEQ ID NO: 880) and ORF133-1 (SEQ ID NO: 878) show 94.3% identity in 871 aa overlap:

```
                         10         20         30         40
orf133a.pep             KDKKVFTDARAVSTRQDIFKSXENLDNIVRXIPGAFTXQXKS
                        ||||||||||||||||||||| |||||||| |||||| | ||
orf133-1    EAQIQVLEDVHVKAKRVPKDKKVFTDARAVSTRQDIFKSSENLDNIVRSIPGAFTQQDKS
                    10         20         30         40         50         60

50         60         70         80         90        100
orf133a.pep  SGXVSLNIRXDSGFGRVNTMVDGITXTFYSTSTDAGRAGGSSQFGASVDSNFXAGLDVVK
             || |||||| |||||||||||||||| |||||||||||||||||||||||||| ||||||
orf133-1     SGIVSLNIRGDSGFGRVNTMVDGITQTFYSTSTDAGRAGGSSQFGASVDSNFIAGLDVVK
                    70         80         90        100        110        120

110        120        130        140        150        160
orf133a.pep  GSFSGSAGINSLAGSANLRTLXVDDVVQGNXTYGLLLKGLTGTNSTKGNAMAAIGARKWL
             ||||||||||||||||||||| ||||||||| |||||||||||||||||| |||||||||
orf133-1     GSFSGSAGINSLAGSANLRTLGVDDVVQGNNTYGLLLKGLTGTNSTKGNANAAIGARKWL
                   130        140        150        160        170        180

170        180        190        200        210        220
orf133a.pep  ESGASVGVLYGHSRRSVAQNYRVGGGGQHIGNFGAEYLERRKQRYFEQEGGLKFNSNSGK
             |||||||||||||||||||||||||||||||||||||||||||||||:||||:|||:|||
orf133-1     ESGASVGVLYGHSRRSVAQNYRVGGGGQHIGNFGAEYLERRKQRYFVQEGALKFNSDSGK
                   190        200        210        220        230        240
```

```
                    -continued
            230       240       250       260       270       280
orf133a.pep WERDFQKSYWKTKWYQKYDAPQELQKYIEGHDKSWRENLAPQYDITPIDPSSLKXQSAGN
            ||||:|:: ||  |  |::|:  ||||||||| |||||||||| |||||||||||||| |||||
orf133-1    WERDLQRQQWKYKPYKNYNN-QELQKYIEEHDKSWRENLXPQYDITPIDPSSLKQQSAGN
               250       260       270       280       290

290       300       310       320       330       340
orf133a.pep LFKLEYDGVFNKYTAQFRDLNTKIGSRKIINRNYQFNYGLSLNPYTNLNLTAAYNSGRQK
            ||||||||||||||||||||||||||||||||||||||||||||||||||||||||||||
orf133-1    LFKLEYDGVFNKYTAQFRDLNTKIGSRKIINRNYQFNYGLSLNPYTNLNLTAAYNSGRQK
            300       310       320       330       340       350

350       360       370       380       390       400
orf133a.pep YPKGSKFTGWGLXKDFETYNNAKILDLXNTSTFRLPRETELQTTLGFNYFHNEYGKNRFP
            ||||||||||| |||||||||||||| ||:||||||||||||||||||||||||| ||||
orf133-1    YPKGSKFTGWGLLKDFETYNNAKILDLNNTATFRLPRETELQTTLGFNYFHNEYGHNRFP
               360       370       380       390       400       410

410       420       430       440       450       460
orf133a.pep EELGLFFDGPDXDNGLYSYLGRFKGDKGLLPQKSTIVQPAGSQYFNTFYFDAALKKDIYR
            |||||||||||| |||||||||||||||||||||||||||||||||||||||||||||||
orf133-1    EELGLFFDGPDQDNGLYSYLGRFKGDKGLLPQKSTIVQPAGSQYFNTFYFDAALKKDIYR
            420       430       440       450       460       470

470       480       490       500       510       520
orf133a.pep LNYSTNTVGYRFGGXYTGYYXSDDEFKRAFGENSPTYXKHCNQSCGIYEPVLKKYGKKRA
            |||||||||||||| ||||| ||||||||||||||||| ||||:||||||||||||||||
orf133-1    LNYSTNTVGYRFGGEYTGYYGSDDEPKRAFGENSPTYKKHCNRSCGIYEPVLKKYGKKRA
            480       490       500       510       520       530

530       540       550       560       570       580
orf133a.pep NNHSVSISADFGDYFMPFASYSRTHRMPNIQEMYFSQIGDSGVHTALKPERANTWQFGFN
            ||||||||||||||||||||||||||||||||||||||||||||||||||||||||||||
orf133-1    NNHSVSISADFGDYFMPFASYSRTHRMPNIQEMYFSQIGDSGVHTALKPERANTWQFGFN
            540       550       560       570       580       590

590       600       610       620       630       640
orf133a.pep TYKKGLLKQDDILGLKLVGYRSRIDXYIHNVYGKWWDLNGNIPSWVSSTGLAYTIQHRNF
            |||||||||||| |||||||||||||| |||||||||||||:|||||||||||||||||
orf133-1    TYKKGLLKQDDTLGLKLVGYRSRIDNYIHNVYGKWWDLNGDIPSWVSSTGLAYTIQHRNF
            600       610       620       630       640       650

650       660       670       680       690       700
orf133a.pep KDKVHKHGFELELNYDYXRFFTNLSYAYQKSTQPTNFSDASESPNNASKEDQLKQGYGLS
            ||||||||||||||||| ||||||||||||||||||||||||||||||||||||||||||
orf133-1    KDKVHKHGFELELNYDYGRFFTNLSYAYQKSTQPTNFSDASESPNNASKEDQLKQGYGLS
            660       670       680       690       700       710

710       720       730       740       750       760
orf133a.pep RVSALPRDYGRLEVGTRWLGNKLTLGGAMRYFGKSIRATAEERYIDXTNGXXTSNFRQLG
            |||||||||||||||||||||||||||||||||||||||||||||| ||| |||||||||
orf133-1    RVSALPRDYGRLEVGTRWLGNKLTLGGAMRYFGKSIRATAEERYIDGTNGGNTSNFRQLG
            720       730       740       750       760       770

770       780       790       800       810       820
orf133a.pep KRSIXQTETLARQPLIFDXYAAYEPKKXLIFRAEVKNLFDRRYIDPLDAGNDAATQRYYS
            ||||  |||||||||| ||||||||||| |||||||||||||||||||||||||||||||
orf133-1    KRSIKQTETLARQPLIFDFYAAYEPKKNLIFRAEVKNLFDRRYIDPLDAGNDAATQRYYS
            780       790       800       810       820       830

830       840       850       860       870
orf133a.pep SFDPKDKDEEVTCNDDNTLCNGKYGGTSKSVLTNFARGXTFLITMSYKFX
            |||||||||:|||  |:||||||||||||||||||||| ||| |||||||
orf133-1    SFDPKDKDEDVTCNADKTLCNGKYGGTSKSVLTNFARGRTFLMTMSYKFX
            840       850       860       870       880
                                  55
```

Homology with a Predicted ORF from *N.gonorrhoeae*
ORF133 (SEQ ID NO: 876) shows 92.3% identity over 392 aa overlap with a predicted ORF (ORF133ng) (SEQ ID NO: 882) from *N. gonorrhoeae*:

```
orf133.pep              PGYYGSDDEFKRAFGENSPTXKKHCNRSCGI                       31
                        |||||::|||||||||||| :|||  |||:
orf133ng    FYFDAALKKDIYRLNYSTNAINYRFGGEYTGYYGSENEFKRAFGENSPAYKEHCDPSCGL 560
```

```
                            -continued
orf133.pep  YEPVLKKYGKKRANNHSVSISADFGDYFMPFASYSRTHRMPNIQEMYFSQIGDSGVHTAL   91
            |||||||||||||||||||||||||||||||||:||||||||||||||||||||||||||
orf133ng    YEPVLKKYGKKRANNHSVSISADFGDYFMPFAGYSRTRRMPNIQEMYFSQIGDSGVHTAL  620 orf133.pep  KPERANTWQFGFXTYKKGLLKQDDTLGLKLVGYRSRIDNYIHNVYGKWWDLNGDIPSWVS  151
            |||||||||||| |||||||||||||||| ||||||||||||||||||||||||||||:
orf133ng    KPERANTWQFGFNTYKKGLLKQDDILGLKLVGYRSRIDNYIHNVYGKWWDLNGDIPSWVG  680 orf133.pep  STGLAYTIQHRXFXDKVHQXXXXXXXXXYDYGRFFTNLSYAYQKSTQPTNFSDASESPNNA  211
            ||||||||:|| | ||||: |||||||||||||||||||||||||||||
orf133ng    STGLAYTIRHRNFKDKVHKHGFELELNYDYGRFFTNLSYAYQKSTQPTNFSDASESPNNA  740 orf133.pep  SKEDQLKQGYGLSRVSALPRDYGRLEVGTRWLGNKLTLGGAMRYFGKSIRATAEERYIDG  271
            ||||||||||||||||||||||||||||||||||||||||||||||||||||||||||||
orf133ng    SKEDQLKQGYGLSRVSALPRDYGRLEVGTRWLGNKLTLGGAMRYFGKSIRATAEERYIDG  800 orf133.pep  TNGGNTSNFRQLGKRSIKQTETLARQPLIXDFNAAYEPKKNLIFRAEVKNLFDRRYIDPL  331
            |||||||| ||||||||||||||||||||| || ||||||||||||||||||||||||||
orf133ng    TNGGNTSNVRQLGKRSIKQTETLARQPLIFDFYAAYEPKKNLIFRAEVKNLFDRRYIDPL  860 orf133.pep  DAGNDAAXERYYSSFDPKDKDXDVTCNADKTLCNGKYGGTSKSVLTNFARGRTFLMTMSY  391
            |||||||::|||||||||||||| |||||||||||||||||||||||||||||||||||
orf133ng    DAGNDAATQRYYSSFDPKDKDEDVTCNADKTLCNGKYGGTSKSVLTNFARGRTFLMTMSY  920 orf133.pep  KF  393
            ||
orf133ng    KF  922
```

The complete length ORF133ng nucleotide sequence (SEQ ID NO: 881) is predicted to encode a protein having amino acid sequence (SEQ ID NO: 882):

```
  1  MRSSFRLKPI CFYLMGVMLY HHSYAEDAGR AGSEAQIQVL EDVHVKAKRV

51  PKDKKVFTDA RAVSTRQDVF KSGENLDNIV RSIPGAFTQQ DKSSGIVSLN

101  IRGDSGFGRV NTMVDGITQT FYSTSTDAGR AGGSSQFGAS VDSNFIAGLD

151  VVKGSFSGSA GINSLAGSAN LRTLGVDDVV QGNNTYGLLL KGLTGTNSTK

201  GNAMAAIGAR KWLESGASVG VLYGHSRRGV AQNYRVGGGG QHIGNFGEEY

251  LERRKQQYFV QEGGLKFNAG SGKWERDLQR QYWKTKWYKK YEDPQELQKY

301  IEEHDKSWRE NLAPQYDITP IDPSGLKQQS AGNLLNLEYD GVFNKYTAQF

351  RDLNTRIGSR KIINRNYQFN YGLSLNPYTN LNLTAAYNSG RQKYPKGAKF

401  TGWGLLKDFE TYNNAKILDL NNTATFRLPR ETELQTTLGF NYFHNEYGKN

451  RFPEELGLFF DGPDQDNGLY SYLGRFKGDK GLLPQKSTIV QPAGSQYFNT

501  FYFDAALKKD IYRLNYSTNA INYRFGGEYT GYYGSENEFK RAFGENSPAY

551  KEHCDPSCGL YEPVLKKYGK RANNHSVSI SADFGDYFMP FAGYSRTHRM

601  PNIQEMYFSQ IGDSGVHTAL KPERANTWQF GFNTYKKGLL QDDILGLKL

651  VGYRSRIDNY IHNVYGKWWD LNGDIPSWVG STGLAYTIRH RNFKDKVHKH

701  GFELELNYDY GRFFTNLSYA YQKSTQPTNF SDASESPNNA SKEDQLKQGY

751  GLSRVSALPR DYGRLEVGTR WLGNKLTLGG AMRYFGKSIR ATAEERYIDG

801  TNGGNTSNVR QLGKRSIKQT ETLARQPLIF DFYAAYEPKK NLIFRAEVKN

851  LFDRRYIDPL DAGNDAATQR YYSSFDPKDK DEDVTCNADK TLCNGKYGGT

901  SKSVLTNFAR GRTFLMTMSY KF*
```

A variant was also identified, being encoded by the gonococcal DNA sequence (SEQ ID NO: 883):

```
   1  ATGAGATCTT CTTTCCGGTT GAAGCCGATT TGTTTTTATC TTATGGGTGT
  51  TATGCTATAT CATCATAGTT ATGCCGAAGA TGCAGGGCGC GCGGGCAGCG
 101  AGGCGCAGAT ACAGGTTTTG GAAGATGTGC ACGTCAAGGC GAAGCGCGTA
 151  CCGAAAGACA AAAAGTGTT TACCGATGCG CGTGCCGTAT CGACCCGTCa
 201  gGATGTGTTC AAATCCGGCG AAAACCTCGA CAACATCGTA CGCAGCATAC
 251  CCGGTGCGTT TACACAGCAA GATAAAAGCT CGGGCATTGT GTCTTTGAAT
 301  ATTCGCGGCG ACAGCGGGTT CGGGCGGGTC AATACGATGG TGGACGGCAT
 351  CACGCAGACC TTTTATTCGA CTTCTACCGA TGCGGGCAGG GCAGGCGGTT
 401  CATCTCAATT CGGTGCATCT GTCGACAGCA ATTTTATTGC CGGACTGGAT
 451  GTCGTCAAAG GCAGCTTCAG CGGCTCGGCA GGCATCAACA GCCTTGCCGG
 501  TTCGGCGAAT CTGCGGACTT TAGGCGTGGA TGACGTCGTT CAGGGCAATA
 551  ATACCTACGG CCTGCTGCTA AAAGGTCTGA CCGGCACCAA TTCAACCAAA
 601  GGTAATGCGA TGGCGGCGAT AGGTGCGCGC AAATGGCTGG AAAGCGGAGC
 651  GTCTGTCGGT GTGCTTTACG GCACAGCAG GCGCGGCGTG GCGCAAAATT
 701  ACCGCGTGGG CGGCGGCGGG CAGCACATCG GAAATTTTGG TGAAGAATAT
 751  CTGGAACGGC GCAAACAGCA ATATTTTGTA CAAGAGGGTG GTTTGAAATT
 801  CAATGCCGGC AGCGGAAAAT GGGAACGGGA TTTGCAAAGG CAATACTGGA
 851  AAACAAAGTG GTATAAAAAA TACGAAGACC CCCAAGAACT GCAAAAATAC
 901  ATCGAAGAGC ATGATAAAAG CTGGCGGGAA AACCTGGCGC CGCAATACGA
 951  CATCACCCCC ATCGATCCGT CCGGCCTGAA GCAGCAGTCG GCAGGCAATC
1001  TGTTTAAATT GGAATACGAC GGCGTATTCA ATAAATACAC GGCGCAATTT
1051  CGCGATTTAA ACACCAGAAT CGGCAGCCGC AAAATCATCA ACCGCAATTA
1101  CCGCAGCCTA CAATTCGGGC AGGCAGAAAT ATCCGAAAGG GGCGAAGTTT
1201  ACAGGCTGGG GGCTTTTAAA AGATTTTGAA ACCTACAACA ACGCGAAAAT
1251  CCTCGACCTC AACAACACCG CCACCTTCCG GCTGCCCCGC GAAACCGAGT
1301  TGCAAACCAC TTTGGGCTTC AATTATTTCC ACAACGAATA CGGCAAAAAC
1351  CGCTTTCCTG AAGAATTGGG GCTGTTTTTC GACGGTCCTG ATCAGGACAA
1401  CGGGCTTTAT TCCTATTTGG GGCGGTTTAA GGGCGATAAA GGGCTGTTGC
1451  CTCAAAAATC AACCATTGTC CAACCGGCCG GCAGCCAATA TTTCAACACG
1501  TTCTACTTCG ATGCCGCGCT CAAAAAAGAC ATTTACCGCT TAAACTACAG
1551  CACCAATGCA ATCAACTACC GTTTCGGCGG CGAATATACG GGCTATTACG
1601  GCTCGGAAAA CGAATTTAAG CGGGCATTCG GAGAAAACTC GCCGGCATAC
1651  AAGGAACATT GCGACCCGAG CTGCGGGCTT TATGAACCCG TATTGAAAAA
1701  ATACGGCAAA AAGCGCGCCA ACAACCATTC GGTCAGCATT AGTGCGGACT
1751  TCGGCGATTA TTTCATGCCG TTCGCCGGCT ATTCGCGCAC ACACCGTATG
1801  CCCAACATCC AAGAAATGTA TTTTTCCCAA ATCGGCGACT CCGGCGTTCA
1851  CACCGCCTTA AAACCAGAGC GCGCAAACAC TTGGCAATTT GGCTTCAATA
1901  CCTATAAAAA AGGATTGTTA AAACAAGATG ATATATTAGG ATTGAAACTG
```

```
-continued
1951  GTCGGCTACC GCAGCCGCAT TGACAACTAC ATCCACAACG TTTACGGGAA
2001  ATGGTGGGAT TTGAACGGGG ATATTCCGAG CTGGGTCGGC AGCACCGGGC
2051  TTGCCTACAC CATCCGACAC CGCAATTTCA AGACAAAGT GCACAAACAC
2101  GGTTTTGAGC TGGAGCTGAA TTACGATTAT GGGCGTTTTT TCACCAACCT
2151  TTCTTACGCC TATCAAAAAA GCACGCAACC GACCAATTTC AGCGATGCGA
2201  GCGAATCGCC CAACAATGCC tccaaAGAAG ACCAACTCAA ACAAGGTTAT
2251  GGGCTGAGCA GGGTTTCCGC CCTGCCGCGA GATTACGGAC GTTTGGAAGT
2301  CGGTACGCGC TGGTTGGGCA ACAAACTGAC TTTGGGCGGC GCGAtgcGCT
2351  ATTTCGGCAA GAGCATCCGC GCGACGGCTG AAGAACGCTA TATCGACGGC
2401  ACCAACGGGG GAAATACCAG CAATGTCCGG CAACTGGGCA AGCGTTCCAT
2451  CAAACAAACC GAAACCCTTG CCCGACAGCC TTTGATTTTT GATTTTTACG
2501  CCGCTTACGA GCCGAAGAAA AACCTTATTT TCCGCGCCGA AGTCAAAAAC
2551  CTGTTCGACA GGCGTTATAT CGATCCGCTC GATGCGGGCA ATGATGCGGC
2601  AACGCAGCGT TATTACAGCT CGTTCGACCC GAAAGACAAG GACGAAGACG
2651  TAACGTGTAA TGCTGATAAA ACGTTGTGCA ACGGCAAATA CGGCGGCACA
2701  AGCAAAAGCG TATTGACCAA TTTCGCACGC GGACGCACCT TCTTGATGAC
2751  GATGAGCTAC AAGTTTTAA
```

This corresponds to the amino acid sequence (SEQ ID NO: 884; ORF133ng-1):

```
  1  MRSSFRLKPI CFYLMGVMLY HHSYAEDAGR AGSEAQIQVL EDVKVKAKRV
 51  PKDKKVFTDA RAVSTRQDVF KSGENLDNIV RSIPGAFTQQ DKSSGIVSLN
101  IRGDSGFGRV NTMVDGITQT FYSTSTDAGR AGGSSQFGAS VDSNFIAGLD
151  VVKGSFSGSA GINSLAGSAN LRTLGVDDVV QGNNTYGLLL KGLTGTNSTK
201  GNAMAAIGAR KWLESGASVG VLYGHSRRGV AQNYRVGGGG QHIGNFGEEY
251  LERRKQQYFV QEGGLKFNAG SGKWERDLQR QYWKTKWYKX YEDPQELQKY
301  IEEHDKSWRE NLAPQYDITP IDPSGLKQQS AGNLFKLEYD GVFNKYTAQF
351  RDLTTRIGSR KIINRNYQFN YGLSLNPYTN LNLTAAYNSG RQKYPKGAKF
401  TGWGLLKDFE TYNNAKILDL NNTATFRLPR ETELQTTLGF NYFHNEYGKN
451  RFPEELGLFF DGPDQDNGLY SYLGRFKGDK GLLPQKSTIV QPAGSQYFNT
501  FYFDAALKKD IYRLNYSTNA INYRFGGEYT GYYGSENEFK RAFGENSPAY
551  KEHCDPSCGL YEPVLKKYGK KRARWHSVSI SADFGDYFMP FAGYSRTHRM
601  PNIQEMYFSQ IGDSGVHTAL KPERANTWQF GFNTYKKGLL KQDDILGLKL
651  VGYRSRIDNY IHNVYGKWWD LNGDIPSWVG STGLAYTIRH RNFKDKVHKH
701  GFELELNYDY GRFFTNLSYA YQKSTQPTNF SDASESPNNA SKEDQLKQGY
751  GLSRVSALPR DYGRLEVGTR WLGNKLTLGG AMRYFGKSIR ATAEERYIDG
801  TNGGNTSNVR QLGKRSIKQT ETLARQPLIP DFYAAYEPKK NLIFRAEVKN
851  LFDRRYIDPL DAGNDAATQR YYSSFDPKDK DEDVTCNADK TLCNGKYGGT
901  SKSVLTNFAR GRTFLTMSY KF*
```

ORF133ng-1 (SEQ ID NO: 884) and ORF133-1 (SEQ ID NO: 878) show 96.2% identity in 889 aa overlap:

```
                       10        20        30        40        50        60
orf133ng-1.pep  SFRLKPICFYLMGVMLYHHSYAEDAGRAGSEAQIQVLEDVHVKAKRVPKDKKVFTDARAV
                                              ||||||||||||||||||||||||||||||
orf133-1                                      EAQIQVLEDVHVKAKRVPKDKKVFTDARAV
                                                      10        20        30

70        80        90       100       110       120
orf133ng-1.pep  STRQDVFKSGENLDNIVRSIPGAFTQQDKSSGIVSLNIRGDSCGGRVNTMVDGITQTFYS
                ||||| :|||:|||||||||||||||||||||||||||||| ||||||||||||||||||
orf133-1        STRQDIFKSSENLDNIVRSIPGAFTQQDKSSGIVSLNIRGDSGFGRVNTMVDGITQTFYS
                        40        50        60        70        80        90

130       140       150       160       170       180
orf133ng-1.pep  TSTDAGRAGGSSQPGASVDSNFIAGLDVVKGSFSGSACINSLAGSANLRTLGVDDVVQGN
                |||||||||||| ||||||||||||||||||||||| |||||||||||||||||||||||
orf133-1        TSTDAGRAGGSSQFGASVDSNFIAGLDVVKGSFSGSAGINSLAGSANLRTLGVDDVVQGN
                       100       110       120       130       140       150

190       200       210       220       230       240
orf133ng-1.pep  NTYGLLLKGLTGTNSTKGNAMAAIGARKWLESGASVGVLYGHSRRGVAQNYRVGGGGQHI
                ||||||||||||||||||||||||||||||||||||||||||||| :||||||||||||
orf133-1        NTYGLLLKGLTGTNSTKGNAMAAIGARKWLESGASVGVLYGHSRRSVAQNYRVGGGGQHI
                       160       170       180       190       200       210

250       260       270       280       290       300
orf133ng-1.pap  GNFGEEYLERRKQQYFVQEGGLKFNAGSGKWERDLQRQYWKTKWYKKYEDPQELQKYIEE
                ||||  ||||||||:||||||:||||: ||||||||||||  || | ||:|:: ||||||
orf133-1        GNFGAEYLERRKQRYFVQEGALKFNSDSGKWERDLQRQWKYKPYKNYNN-QELQKYIEE
                       220       230       240       250       260

310       320       330       340       350       360
orf133ng-1.pep  HDKSWRENLAPQYDITPIDPSGLKQQSAGNLPKLEYDGVFNKYTAQFRDLNTRIGSRKII
                |||||||||| ||||||||||| |||||||||||||||||||||||||||||:||||||
orf133-1        HDSKWRENLXPQYDITPIDPSSLKQQSAGNLPKLEYDGVFNKYTAQFRDLNTKIGSRKII
                270       280       290       300       310       320

370       380       390       400       410       420
orf133ng-1.pep  NRNYQFNYGLSLNPYTNLNLTAAYNSGRQKYPKGAKFTGWGLLKDFETYNNAKILDLNNT
                |||||||||||||||||||||||||||||||||||:||||||||||||||||||||||||
orf133-1        NRNYQFNYGLSLNPYTNLNLTAAYNSGRQKYPKGSKFTGWGLLKDFETYNNAKILDLNNT
                330       340       350       360       370       380

430       440       450       460       470       480
orf133ng-1.pep  ATFRLPRETELQTTLGFNYFHNEYGKNRFPEELGLFFDGPDQDNGLYSYLGRFKGDKGLL
                ||||||||||||||||||||||||||:|||||||||||||||||||||||||||||||||
orf133-1        ATFRLPRETELQTTLGFNYFHNEYGRNRFPEELGLFFDGPDQDNGLYSYLGRFKGDKGLL
                390       400       410       420       430       440

490       500       510       520       530       540
orf133ng-1.pep  PQKSTIVQPAGSQYFNTFYFDAALKKDIYRLNYSTNAINYRFGGEYTGYYGSENEFKRAF
                ||||||||||||||||||||||||||||||||||||:::||||||||||||::|||||
orf133-1        PQKSTIVQPAGSQYFNTFYFDAALKKDIYRLNYSTNTVGYRFGGEYTGYYGSDDEFKRAF
                450       460       470       480       490       500

550       560       570       580       590       600
orf133ng-1.pep  GENSPAYKEHCDPSCGLYEPVLKKYGKKRANNHSVSISADFGDYFMPFAGYSRTHRMPNI
                |||||:||:||:||:|||||||||||||||||||||||||||||||||:|||||||||
orf133-1        GENSPTYKKHCNRSCGIYEPVLKKYGKKRANNHSVSISADFGDYFMPFASYSRTHRMPNI
                510       520       530       540       550       560

610       620       630       640       650       660
orf133ng-1.pep  QEMYFSQIGDSGVHTALKPERANTWQFGFNTYKKGLLKQDDILGLKLVGYRSRIDNYIHN
                ||||||||||||||||||||||||||||||||||||||||||| ||||||||||||||||
orf133-1        QEMYFSQIGDSGVHTALKPERANTWQFGFNTYKKGLLKQDDTLGLKLVGYRSRIDNYIHN
                570       580       590       600       610       620

670       680       690       700       710       720
orf133ng-1.pep  TYGKWWDLNGDIPSWVGSTGLAYTIRHRNFKDKVHKHGFELELNYDYGRFFTNLSYAYQK
                 ||||||||||||||| ||||||||:|||||||||||||||||||||||||||||||||
orf133-1        VYGKWWDLNGDIPSWVSSTGLAYTIQHRNFKDKVHKHGFELELNYDYGRFFTNLSYAYQK
                630       640       650       660       670       680

730       740       750       760       770       780
orf133ng-1.pep  STQPTNFSDASESPNNASKEDQLKQGYGLSRVSALPRDYGRLEVGTRWLGNKLTLGGAMR
                ||||||||||||||||||||||||||||||||||||||||||||||||||||||||||||
orf133-1        STQPTNFSDASESPNNASKEDQLKQGYGLSRVSALPRDYGRLEVGTRWLGNKLTLGGAMR
                690       700       710       720       730       740
```

```
                  790        800        810        820        830        840
orf133ng-1.pep  YFGKSIRATAEERYIDGTNGGNTSNVRQLGKRSIKQTETLARQPLIFDFYAAYEPKKNLI
                |||||||| |||||||||||||||| ||||||||||||||||||||||||||||||||
orf133-1        YFGKSTRATAEERYIDGTNGGNTSNFRQLGKRSIKQTETLARQPLIFDFYAAYEPKKNLI
                  750        760        770        780        790        800

850        860        870        880        890        900
orf133ng-1.pep  FRAEVKNLFDRRYIDPLDAGNDAATQRYYSSFDPKDKDEDVTCNADKTLCNGKYGGTSKS
                ||||||||||||||||||||||||||||||||||||||||||||||||||||||||||||
orf133-1        FRAEVKNLFDRRYIDPLDAGNDAATQRYYSSFDPKDKDEDVTCNADKTLCNGKYGGTSKS
                  810        820        830        840        850        860

910        920
orf133ng-1.pep  VLTNFARGRTFLMTMSYKFX
                ||||||||||||||||||||
orf133-1        VLTNFARGRTFLMTMSYKFX
                  870        880
```

In addition, ORF133ng-1 (SEQ ID NO: 884) is homologous to a TonB-dependent receptor (SEQ ID NO: 1167) in *H.influenzae*:

```
sp|P45114|YC17_HAEIN PROBABLE TONE-DEPENDENT RECEPTOR HI1217 PRECURSOR
)gi|1075372|pir||G64110 transferrin binding protein 1 precursor (tbp1) homolog -
Haemophilus influenzae (strain Rd KW20) )gi|1574147 (U32801) transferrin binding
protein 1 precursor (tbp1) [Haemophilus influenzae] Length = 913
Score = 930 bits (2377), Expect = 0.0
Identities = 476/921 (51%), Positives = 619/921 (66%), Gaps = 72/921 (7%)

Query:  38 QVLEDVHVKAKRVPKDKKVFTDARAVSTRQDVFKSGENLDNIVRSIPGAFTQQDKSSGIV   97
            + L  + V  K +  DKK FT+A+A STR++VFK   +D ++RSIPGAFTQQDK SG+V
Sbjct:  29 ETLGQIDVVEKVISNDKKPFTEAKAKSTRENVFKETQTIDQVIRSIPGAFTQQDKGSGVV   88

Query:  98 SLNIRGDSGFGRVNTMVDGITQTFYSTSTDAGRAGGSSQFGASVDSNFIAGLDVVKGSFS  157
            S+NIRG++G GRVNTMVDG+TQTFYST+ D+G++GGSSQFGA++D NFIAG+DV D +FS
Sbjct:  89 SVNIRGENGLGRVNTMVDGVTQTFYSTALDSGQSGGSSQFGAAIDPNFIAGVDVNKSNFS  148

Query: 158 GSAGINSLAGSANLRTLGVDDVVQXXXXXXXXXXXXXXXXXXXXXAMAAIGARKWLESGA  217
            G++GIN+LAGSAN RTLGV+DV+                     M   RKWL++G
Sbjct: 149 GASGINALAGSANFRTLGVNDVITDDKPFGIILKGMTGSNATKSNFMTMAAGRKWLDNGG  208

Query: 218 SVGVLYGHSRRGVAQNYRVGGGGQHIGNFGEEYLERRKQQYFVQEGGLKFNAGSGKWERD  277
               VGV+YG+S+R V+Q+YR+ GGG+ +  G++ L + K+ YF + G  N  G+W  D
Sbjct: 209 YVGVVYGYSQREVSQDYRI-GGGERLASLGQDILAKEKEAYF-RNAGYILNP-EGQWTPD  265

Query: 278 LQRQYWK-----------TKWY--------------------KKYEDPQELQK---YIEE  303
            L +++W           +Y                    KK +D ++LQK    IEE
Sbjct: 266 LSKKHWSCNKPDYQKNGDCSYYRIGSAAKTRREILQELLTNGKKPKDIEKLQKGNDGIEE  325

Query: 304 HDKSWRENLAPQYDITPIDPSGLKQQSAGNLFKLEYDGVFNKYTAQFRDLNTRIGSRKII  363
            DKS+  N   QY + PI+P  L+ +S  +L K EY       AQ R L+  +IGSRKI
Sbjct: 326 TDKSFERN-KDQYSVAPIEPGSLQSRSRSHLLKFEYGDDHQNLGAQLRTLDNKIGSRKIE  384

Query: 364 NRNYQFNYGLSLNPYTNLNLTAAYNSGRQKYPKGAKFTGWGLLKDFETYNNAKILDLNNT  423
            NRNYQ NY + N Y +LNL AA+N G+  YPKG F GW +    T N A I+D+NN+
Sbjct: 385 NRNYQVNYNFNNNSYLDLNLMAAHNIGKTIYPKGGFFAGWQVADKLITKNVANIVDINNS  444

Query: 424 ATFRLPRETELQTTLGFNYFHNEYGKNRFPEELGLFFDGPDQDNGLYSY--LGRFKGDKG  481
             TF LP+E +L+TTLGFNYF NEY KNRFPEEL LF++    D GLYS+    GR+ G K
Sbjct: 445 HTFLLPKEIDLKTTLGFNYFTNEYSKNRFPEELSLFYNDASHDQGLYSHSKRGRYSGTKS  504

Query: 482 LLPQKSTIVQPAGSQYFNTFYFDAALKKDIYRLNYSTNAINYRFGGEYTGYYGSENEFKR  541
            LLPQ+S I+PQ+G Q F T YFD AL K IY LNYS N  +Y F GEY GY
Sbjct: 505 LLPQRSVILQPSGKQKFKTVYFDTALSKGIYHLNYSVNFTHYAFNGEYGY---------  555

Query: 542 AFGENSPAYKEHCDPSCGLYEPVLKKYGKKRANNHSVSISADFGDYFMPFAGYSRTHRMP  601
                EN+          + EP+L K G K+A NHS ++SA+ DYFMPF  YSRTHRMP
Sbjct: 556 ---ENTAGQQ--------INEPILHKSGHKKAFNHSATLSAELSDYFMPFFTYSRTHRMP  604

Query: 602 NIQEMYFSQIGDSGVHTALKPERANTWQFGFNTYKKGLLKQDDILGLKLVGYRSRIDNYI  661
            NIQEM+FSQ+ ++GV+TALKPE+++T+Q GFNTYKKGL  QDD+LG +LVGYRS I NYI
Sbjct: 605 NIQEMFFSQVSNAGVNTALKPEQSDTYQLGFNTYKKGLFTQDDVLGVKLVGYRSFIKNYI  664

Query: 662 HNVYGKWWDLNGDIPSWVGSTGLAYTIRHRNFKDKVHKHGFELELNYDYGRFFTNLSYAY  721
            HNVYG WW     +P+W  S G YTI H+N K  V K G ELE+NYD GRFF N+SYAY
Sbjct: 665 HNVYGVWW--RDGMPTWAESNGFKYTIAHQNYKPIVKKSGVELEINYDMGRFFANVSYAY  722
```

```
                             -continued
Query: 722 QKSTQPTNFSDASESPNNASKEDQLKQGYGLSRVSALPRDYGRLEVGTRWLGNKLTLGGA 781
           Q++ QPTN++DAS  PNNAS+ED LKQGYGLSRVS LP+DYGRLE+GTRW   KLTLG A
Sbjct: 723 QRTNQPTNYADASPRPNNASQEDILKQGYGLSRVSMLPKDYGRLELGTRWFDQKLTLGLA 782

Query: 782 MRYFGKSIRATAEERYIDGTNGGNTSNVRQLGKRSIKQTETLARQPLIFDFYAAYEPKKN 841
           RY+GKS RAT EE YI+G+     + +R+    ++K+TE + +QP+I D + +YEP K+
Sbjct: 783 ARYYGKSKRATIEEEYINGSR-FKKNTLRRENYYAVKKTEDIKKQPIILDLHVSYEPIKD 841

Query: 842 LIFRAEVKNLFDRRYIDPLDAGNDAATQRYYSSFDPKDKDEDVTCNADKTLCNGKYGGTS 901
           LI +AEV+NL D+RY+DPLDAGNDAA+QRYYSS     +  + C  D + C    GG+
Sbjct: 842 LIIKAEVQNLLDKRYVDPLDAGNDAASQRYYSSL-----NNSIECAQDSSAC----GGSD 892

Query: 902 KSVLTNFARGRTFLMTMSYKF 922
           K+VL NFARGRT++++++YKF
Sbjct: 893 KTVLYNFARGRTYILSLNYKF 913
```

The underlined motif in the gonococcal protein (also present in the meningococcal protein) is predicted to be an ATP/GTP-binding site motif A (P-loop), and the analysis suggests that these proteins from *N.meningitidis* and *N.gonorrhoeae*, and their epitopes, could be useful antigens for vaccines or diagnostics, or for raising antibodies.

Example 104

The following partial DNA sequence was identified in *N.meningitidis* (SEQ ID NO: 885)

```
  1 ATGAACCTGA TTTCACGTTA CATCATCCGT CAAATGGCGG TTATGGCGGT
 51 TTACGCGCTC CTTGCCTTCC TCGCTTTGTA CAGCTTTTTT GAAATCCTGT
101 ACGAAACCGG CAACCTCGGC AAAGGCAGTT ACGGCATATG GGAAATGCTG
151 GGCTACACCG CCCTCAAAAT GCCCGCCCGC GCCTACGAAC TGATTCCCCT
201 CGCCGTCCTT ATCGGCGGAC TGGTCTCCCT CAGCCAGCTT GCCGCCGGCA
251 GCGAACTGAC CGTCATCAAA GCCAGCGGCA TGAGCACCAA AAAGCTGCTG
301 TTGATTCTGT CGCAGTTCGG TTTTATTTTT GCTATTGCCA CCGTCGCGCT
351 CGGCGAATGG GTTGCGCCCA CACTGAGCCA AAAAGCCGAA AACATCAAAG
401 CCGCCGCCAT CAACGGCAAA ATCAGCACCG GCAATACCGG CCTTTGGCTG
451 AAAGAAAAAA ACAGCGTGAT CAATGTGCGC GAAATGTTGC CCGACCAT..
```

This corresponds to the amino acid sequence (SEQ ID NO: 886; ORF112):

```
  1 MNLISRYIIR QMAVMAVYAL LAFLALYSFF EILYETGNLG KGSYGIWEML
 51 GYTALKMPAR AYELIPLAVL IGGLVSLSQL AAGSELTVIK ASGMSTKKLL
101 LILSQFGFIF AIATVALGEW VAPTLSQKAE NIKAAAINGK ISTGNTGLWL
151 KEKNSVINVR EMLPDH...
```

Further work revealed further partal nucleotide sequence (SEQ ID NO: 887):

```
  1 ATGAACCTGA TTTCACGTTA CATCATCCGT CAAATGGCGG TTATGGCGGT
 51 TTACGCGCTC CTTGCCTTCC TCGCTTTGTA CAGCTTTTTT GAAATCCTGT
101 ACGAAACCGG CAACCTCGGC AAAGGCAGTT ACGGCATATG GGAAATGCTG
151 gGCTACACCG CCCTCAAAAT GCCCGCCCGC GCCTACGAAC TGATTCCCCT
201 CGCCGTCCTT ATCGGCGGAC TGGTCTCCCT CAGCCAGCTT GCCGCCGGCA
251 GCGAACTGAC CGTCATCAAA GCCAGCGGCA TGAGCACCAA AAAGCTGCTG
```

```
                    -continued
301 TTGATTCTGT CGCAGTTCGG TTTTATTTTT GCTATTGCCA CCGTCGCGCT

351 CGGCGAATGG GTTGCGCCCA CACTGAGCCA AAAAGCCGAA AACATCAAAG

401 CCGCCGCCAT CAACGGCAAA ATCAGCACCG GCAATACCGG CCTTTGGCTG

451 AAAGAAAAAA ACAGCrTkAT CAATGTGCGC GAAATGTTGC CCGACCATAC

501 GCTTTTGGGC ATCAAAATTT GGGCGCGCAA CGATAAAAAC GAATTGGCAG

551 AGGCAGTGGA AGCCGATTCC GCCGTTTTGA ACAGCGACGG CAGTTGGCAG

601 TTGAAAAACA TCCGCCGCAG CACGCTTGGC GAAGACAAAG TCGAGGTCTC

651 TATTGCGGCT GAAGAAAACT GGCCGATTTC CGTCAAACGC AACCTGATGG

701 ACGTATTGCT CGTCAAACCC GACCAAATGT CCGTCGGCGA ACTGACCACC

751 TACATCCGCC ACCTCCAAAA CAACAGCCAA AACACCCGAA TCTACGCCAT

801 CGCATGGTGG CGCAAATTGG TTTACCCCGC CGCAGCCTGG GTGATGGCGC

851 TCGTCGCCTT TGCCTTTACC CCGCAAACCA CCCGCCACGG CAATATGGGC

901 TTAAAACTCT TCGGCGGCAT CTGTsTCGGA TTGCTGTTCC ACCTTGCCGG

951 ACGGCTCTTT GGGTTTACCA GCCAACTCGG...
```

This corresponds to the amino acid sequence (SEQ ID NO: 888; ORF112-1):

```
  1 MNLISRYIIR QMAVMAVYAL LAFLALYSFF EILYETGNLG KGSYGIWEML

51 GYTALKMPAR AYELIPLAVL IGGLVSLSQL AAGSELTVIK ASGMSTKKLL

101 LILSQFGFIF AIATVALGEW VAPTLSQKAE NIKAAAINGK ISTGNTGLWL

151 KEKNSXINVR EMLPDHTLLG IKIWARNDKN ELAEAVEADS AVLNSDGSWQ

201 LKNIRRSTLG EDKVEVSIAA EENWPISVKR NLMDVLLVKP DQMSVGELTT

251 YIRHLQNNSQ NTRIYAIAWW RKLVYPAAAW VMALVAFAFT PQTTRHGNMG

301 LKLFGGICXG LLFHLAGRLF GFTSQL...
```

Computer analysis of this amino acid sequence predicts two transmembrane domains and gave the following results: Homology with a Predicted ORF from *N.meningitidis* (Strain A)

ORF112 (SEQ ID NO: 886) shows 96.4% identity over a 166aa overlap with an ORF (ORF112a) (SEQ ID NO: 890) from strain A of *N. meningitidis*:

```
                        10        20        30        40        50        60
orf112.pep   MNLISRYIIRQMAVMAVYALLAFLALYSFFEILYETGNLGKGSYGIWEMLGYTALKMPAR
             ||||||||||||||||||||||||||||||||||||||||||||||||| ||||||| ||
orf112a      MNLISRYlIRQMAVMAVYALLAFLALYSFFEILYETGNLGKGSYGIWEMXGYTALKMXAR
                        10        20        30        40        50        60

70        80        90       100       110       120
orf112.pep   AYELIPLAVLIGGLVSLSQLAAGSELTVIKASGMSTKKLLLILSQFGFIFAIATVALGEW
             ||||:|||||||||||| ||||||||||:|||||||||||||||||||||||||||||||
orf112a      AYELMPLAVLIGGLVSXSQLAAGSELXVIKASGMSTKKLLLILSQFGFIFAIATVALGEW
                        70        80        90       100       110       120

130       140       150       160
orf112.pep   VAPTLSQKAENIKAAAINGKISTGNTGLWLKEKNSVINVREMLPDH
             |||||||||||||||||||||||||||||||||||:||||||||||
orf112a      VAPTLSQKAENIKAAAINGKISTGNTGLWLKEKNSIINVREMLPDHTLLGIKIWARNDKN
                       130       140       150       160       170       180 orf112a      ELAEAVEADSAVLNSDGSWQLKNIRRSTLGEDKVEVSIAAEEXWPISVKRNLMDVLLVKP
                       190       200       210       220       230       240
```

The ORF112a nucleotide sequence (SEQ ID NO: 889) is:

```
   1   ATGAACCTGA TTTCACGTTA CATCATCCGT CAAATGGCGG TTATGGCGGT
  51   TTACGCGCTC CTTGCCTTCC TCGCTTTGTA CAGCTTTTTT GAAATCCTGT
 101   ACGAAACCGG CAACCTCGGC AAAGGCAGTT ACGGCATATG GAAATGNTG
 151   GGNTACACCG CCCTCAAAAT GNCCGCCCGC GCCTACGAAC TGATGCCCCT
 201   CGCCGTCCTT ATCGGCGGAC TGGTCTCTNT CAGCCAGCTT GCCGCCGGCA
 251   GCGAACTGAN CGTCATCAAA GCCAGCGGCA TGAGCACCAA AAAGCTGCTG
 301   TTGATTCTGT CGCAGTTCGG TTTTATTTTT GCTATTGCCA CCGTCGCGCT
 351   CGGCGAATGG GTTGCGCCCA CACTGAGCCA AAAAGCCGAA AACATCAAAG
 401   CCGCGGCCAT CAACGGCAAA ATCAGTACCG GCAATACCGG CCTTTGGCTG
 451   AAAGAAAAAA ACAGCATTAT CAATGTGCGC GAAATGTTGC CCGACCATAC
 501   CCTGCTGGGC ATTAAAATCT GGGCCCGCAA CGATAAAAAC GAACTGGCAG
 551   AGGCAGTGGA AGCCGATTCC GCCGTTTTGA ACAGCGACGG CAGTTGGCAG
 601   TTGAAAAACA TCCGCCGCAG CACGCTTGGC GAAGACAAAG TCGAGGTCTC
 651   TATTGCGGCT GAAGAAAANT GGCCGATTTC CGTCAAACGC AACCTGATGG
 701   ACGTATTGCT CGTCAAACCC GACCAAATGT CCGTCGGCGA ACTGACCACC
 751   TACATCCGCC ACCTCCAAAN NNACAGCCAA AACACCCGAA TCTACGCCAT
 801   CGCATGGTGG CGCAAATTGG TTTACCCCGC CGCAGCCTGG GTGATGGCGC
 851   TCGTCGCCTT TGCCTTTACC CCGCAAACCA CCCGCCACGG CAATATGGGC
 901   TTAAAANTCT TCGGCGGCAT CTGTCTCGGA TTGCTGTTCC ACCTTGCCGG
 951   NCGGCTCTTC NGGTTTACCA GCCAACTCTA CGGCATCCCG CCCTTCCTCG
1001   NCGGCGCACT ACCTACCATA GCCTTCGCCT TGCTCGCCGT TTGGCTGATA
1051   CGCAAACAGG AAAAACGCTA A
```

This encodes a protein having the amino acid sequence (SEQ ID NO: 890):

```
  1   MNLISRYIIR QMAVMAVYAL LAFLALYSFF EILYETGNLG KGSYGIWEMX
 51   GYTALKMXAR AYELMPLAVL IGGLVSXSQL AAGSELXVIK ASGMSTKKLL
101   LILSQFGFIF AIATVALGEW VAPTLSQKAE NIKAAAINGK ISTGNTGLWL
151   KEKNSIINVR EMLPDHTLLG IKIWARNDKN ELAEAVEADS AVLNSDGSWQ
201   LKNIRRSTLG EDKVEVSIAA EEXWPISVKR NLMDVLLVKP DQMSVGELTT
251   YIRHLQXXSQ NTRIYAIAWW RKLVYPAAAW VMALVAFAFT PQTTRHGNMG
301   LKXFGGICLG LLFHLAGRLF XFTSQLYGIP PFLXGALPTI AFALLAVWLI
351   RKQEKR*
```

ORF112a (SEQ ID NO: 890) and ORF112-1 (SEQ ID NO: 888) show 96.3% identity in 326 aa overlap:

```
orf112a.pep  MNLISRYIIRQMAVMAVYALLAFLALYSFFEILYETGNLGKGSYGIWEMXGYTALKMXAR
             ||||||||||||||||||||||||||||||||||||||||||||||||| |||||| ||
orf112-1     MNLISRYIIRQMAVMAVYALLAFLALYSFFEILYETGNLGKGSYGIWEMLGYTALKMPAR orf112a.pep  AYELMPLAVLIGGLVSXSQLAAGSELXVIKASGMSTKKLLLILSQFGFIFAIATVALGEW
             ||||:|||||||||||| ||||||||| ||||||||||||||||||||||||||||||||
orf112-1     AYELIPLAVLIGGLVSLSQLAAGSELTVIKASGMSTKKLLLILSQFGFIFAIATVALGEW
```

```
                   -continued
orf112a.pep  VAPTLSQKAENIKAAAINGKISTGNTGLWLKEKNSIINVREMLPDHTLLGIKIWARNDKN
             ||||||||||||||||||||||||||||||||||| ||||||||||||||||||||||||
orf112-1     VAPTLSQKAENIKAAAINGKISTGNTGLWLKEKNSXINVREMLPDHTLLGIKIWARNDKN orf112a.pep  ELAEAVEADSAVLNSDGSWQLKNIRRSTLGEDKVEVSIAAEEXWPISVKRNLMDVLLVKP
             |||||||||||||||||||||||||||||||||||||||||| |||||||||||||||||
orf112-1     ELAEAVEADSAVLNSDGSWQLKNIRRSTLGEDKVEVSIAAEENWPlSVKRNLMDVLLVKP orf112a.pep  DQMSVGELTTYIRHLQXXSQNTRIYAIAWWRKLVYPAAAWVMALVAFAFTPQTTRHGNMG
             ||||||||||||||  ||||||||||||||||||||||||||||||||||||||||||||
orf112-1     DQMSVGELTTYIRHLQNNSQNTRIYAIAWWRKLVYPAAAWVMALVAFAFTPQTTRHGNMG orf112a.pep  LKXFGGICLGLLFHLAGRLFXFTSQLYGIPPFLXGALPTIAFALLAVWLIRKQEKRX
             || ||||| ||||||||||||| |||||
orf112-1     LKLFGGICXGLLFHLAGRLFGFTSQL
                                                          15
```

Homology with a Predicted ORF from *N.gonorrhoeae*

ORF112 (SEQ ID NO: 886) shows 95.8% identity over 166aa overlap with a Predicted ORF (ORF112ng) (SEQ ID NO: 892) from *N. gonorrhoeae*:

```
orf112.pep   MNLISRYIIRQMAVMAVYALLAFLALYSFFEILYETGNLGKGSYGIWEMLGYTALKMPAR   60
             ||||||||||||||||||||||||||||||||||||||||||||||||||||||||||||
orf112ng     MNLISRYIIRQMAVMAVYALLAFLALYSFFEILYETGNLGKGSYGIWEMLGYTALKMPAR   60 orf112.pep   AYELIPLAVLIGGLVSLSQLAAGSELTVIKASGMSTKKLLLILSQFGFIFAIATVALGEW  120
             ||||:||||||||:|||||||||||:||||||||||||||||||||||||||:||||||
orf112ng     AYELMPLAVLIGGLASLSQLAAGSELAVIKASGMSTKKLLLILSQFGFIFAIAAVALGEW  120 orf112.pep   VAPTLSQKAENIKAAAINGKISTGNTGLWLKEKNSVINVREMLPDH               166
             ||||||||||||||||||||||||||||||||||:|:|||| |||||
orf112ng     VAPTLSQKAENIKAAAINGKISTGNTGLWLKEKTSIINVRGMLPDHTLLGIKIWARNDKN  180
```

The complete length ORF112ng nucleotide sequence (SEQ ID NO: 891) is:

```
  1  ATGAACCTGA TTTCACGTTA CATCATCCGC CAAATGGCGG TTATGGCGGT
 51  TTACGCGCTC CTTGCCTTCC TCGCTTTGTA CAGCTTTTTT GAAATCCTGT
101  ACGAAACCGG CAACCTCGGC AAAGGCAGTT ACGGCATATG GGAAATGCTG
151  GGCTACACCG CCCTCAAAAT GCCCGCCCGC CCTACGAAC  TCATGCCCCT
201  CGCCGTCCTC ATCGGCGGAC TGGCCTCTCT CAGCCAGCTT GCCGCCGGCA
251  GCGAACTGGC CGTCATCAAA GCCAGCGGCA TGAGCACCAA AAAGCTGCTG
301  TTGATTCTGT CTCAGTTCGG TTTTATTTTT GCTATTGCCG CCGTCGCGCT
351  CGGCGAATGG GTTGCGCCCA CGCTGAGCCA AAAAGCCGAA AACATCAAag
401  cCGCCGCCAt taacggCAAA ATCAGCAccg gcAATACCGG CCTTTggcTG
451  AAAGAAAAAa ccAGCATTAT CAATGTGcGC GGAATGTTGC CCGACCATAC
501  GCTTTTGGGC ATCAAAATTT GGGCGCGCAA CGATAAAAAC GAATTGGCAG
551  AGGCAGTGGA AGCCGATTCC GCCGTTTTGA ACAGCGACGG CAGCTGGCAG
601  TTGAAAAACA TCCGCCGCAG CATCATGGGT ACAGACAAAA TCGAAACATC
651  cgCCGCCGCC GAAGAAACTT gGCCGATTGC CGTCAGACGC AACCTGATGG
701  ACGTATTGCT CGTCAAGCCC GACCAAATGT CCGTCGGCGA GCTGACCACC
751  TACATCCGCC ACCTCCAAAA CAACAGCCAA AACACCCAAA TCTACGCCAT
801  CGCATGGTGG CGTAAACTCG TTTACCCCGT CGCCGCATGG GTCATGGCGC
851  TCGTTGCCTT CGCCTTTACG CCGCAAACCA CGCGCCACGG CAATATGGGC
```

```
-continued
 901   TTAAAACTCT TCGGCGGCAT CTGTCTCGGA TTGCTGTTCC ACCTTGCCGG

951   CAGGCTCTTC GGGTTTACCA GCCAACTCTA CGGCACCCCA CCCTTCCTCG

1001   CCGGCGCACT GCCTACCATA GCCTTCGCCT TGCTCGCTGT TTGGCTGATA

1051   CGCAAACAGG AAAAACGTTG A
```

This encodes a protein having amino acid sequence (SEQ ID NO: 892):

```
  1   MNLISRYIIR QMAVMAVYAL LAFLALYSFF EILYETGNLG KGSYGIWEML

51   GYTALKMPAR AYELMPLAVL IGGLASLSQL AAGSELAVIK ASGMSTKKLL

101   LILSQFGFIF AIAAVALGEW VAPTLSQKAE NIKAAAINGK ISTGNTGLWL

151   KEKTSIINVR GMLPDHTLLG IKIWARNDKN ELAEAVEADS AVLNSDGSWQ

201   LKNIRRSIMG TDKIETSAAA EETWPIAVRR NLMDVLLVKP DQMSVGELTT

251   YIRHLQNNSQ NTQIYAIAWW RKLVYPVAAW VMALVAFAFT PQTTRHGNMG

301   LKLFGGICLG LLFHLAGRLF GFTSQLYGTP PFLAGALPTI AFALLAVWLI

351   RKQEKR*
```

ORF112ng (SEQ ID NO: 892) and ORF112-1 (SEQ ID NO: 888) show 94.2% identity in 326 aa overlap:

```
                 10         20         30         40         50         60
orf112ng   MNLISRYIIRQMAVMAVYALLAFLALYSFFEILYETGNLGKGSYGIWEMLGYTALKMPAR
           ||||||||||||||||||||||||||||||||||||||||||||||||||||||||||||
orf112-1   MNLISRYIIRQMAVMAVYALLAFLALYSFFEILYETGNLGKGSYGIWEMLGYTALKMPAR
                 10         20         30         40         50         60

70         80         90        100        110        120
orf112ng   AYELMPLAVLIGGLASLSQLAAGSELAVIKASGMSTKKLLLILSQFGFIFAIAAVALGEW
           ||||:|||||||||:|||||||||||||:|||||||||||||||||||||||:|||||
orf112-1   AYELIPLAVLIGGLVSLSQLAAGSELTVIKASGMSTKKLLLILSQFGFIFAIATVALGEW
                 70         80         90        100        110        120

130        140        150        160        170        180
orf112ng   VAPTLSQKAENIKAAAINGKISTGNTGLWLKEKTSIINVRGMLPDHTLLGIKIWARNDKN
           |||||||||||||||||||||||||||||||||:| |||| |||||||||||||||||
orf112-1   VAPTLSQKAENIKAAAINGKISTGNTGLWLKEKNSXINVREMLPDHTLLGIKIWARNDKN
                130        140        150        160        170        180

190        200        210        220        230        240
orf112ng   ELAEAVEADSAVLNSDGSWQLKNIRRSIMGTDKIETSAAAEETWPIAVRRNLMDVLLVKP
           |||||||||||||||||||||||||||| :| ||:|:| ||||:|||:|:||||||||
orf112-1   ELAEAVEADSAVLNSDGSWQLKNIRRSTLGEDKVEVSIAAEENWPISVKRNLMDVLLVKP
                190        200        210        220        230        240

250        260        270        280        290        300
orf112ng   DQMSVGELTTYIRHLQNNSQNTQIYAIAWWRKLVYPVAAWVMALVAFAFTPQTTRHGNMG
           ||||||||||||||||||||||:|||||||||||||:|||||||||||||||||||||
orf112-1   DQMSVGELTTYIRHLQNNSQNTRIYAIAWWRKLVYPAAAWVMALVAFAFTPQTTRHGNMG
                250        260        270        280        290        300

310        320        330        340        350
orf112ng   LKLFGGICLGLLFHLAGRLFGFTSQLYGTPPFLAGALPTIAFALLAVWLIRKQEKRX
           |||||||| |||||||||||||||||
orf112-1   LKLFGGICXGLLFHLAGRLFGFTSQL
                310        320
```

This analysis suggests that these proteins from *N.meningitidis* and *N.gonorrhoeae*, and their epitopes, could be useful antigens for vaccines or diagnostics, or for raising antibodies.

Example 105

Table III lists several Neisseria strains which were used to assess the conservation of the sequence of ORF 4 (SEQ ID NO: 216) among -continued >ZV04_4 (SEQ ID NO: 898)
MKTFFKTLSAAALALILAACGGQKDSAPAASASAAADNGAEKKEIVFGTTVGDFGDMVKE
HIQPELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV05_4 (SEQ ID NO: 899)
MKTFFKTLSAAALALILAACGGQKDSAPAASASAAADNGAEKKEIVFGTTVGDFGDMVKE
HIQPELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV06_4 (SEQ ID NO: 900)
MKTFFKTLSAAALALILAACGGQKDSAPAASASAAADNGAEKKEIVFGTTVGDFGDMVKE
QIQAELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTAHKDSQWLKDVTEAYNSDAFKAYAHKRFEGYKSPAAWNEGAAK*

>ZV07_4 (SEQ ID NO: 901)
MKTFFKTLSAAALALILAACGGQKDSAPAASASAAADNGAEKKEIVFGTTVGDFGDMVKE
QIQAELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV08_4 (SEQ ID NO: 1107)
MKTFFKTLSAAALALILAACGGQKDSAPAASASAAADNGAEKKEIVFGTTVGDFGDMVKE
HIQPELEKKGYTVELVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV09_4 (SEQ ID NO: 902)
MKTFFKTLSAAALALILAACGGQKDSAPAASASAAADNGAEKKEIVFGTTVGDFGDMVKE
HIQPELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV10_4 (SEQ ID NO: 903)
MKTFFKTLSAAALALILAACGGQKDSAPAASASAAADNGAAKKEIVFGTTVGDFGDMVKE
HIQPELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV11_4 (SEQ ID NO: 904)
MKTFFKTLSAAALALILAACGGQKDSAPAASASAAADNGAAKKEIVFGTTVGDFGDMVKE
QIQVELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV12_4ASS (SEQ ID NO: 905)
MKTFFKTLSAAALALILAACGGQKDRAPAASASAASENGAAKKEILFGTTVGDLGDMVKE
QIQAELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV13_4 (SEQ ID NO: 906)
MKTFFKTLSAAALALILAACGGQKDSAPAASASAAADNGAAKKEIVFGTTVGDFGDMVKE
QIQPELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV15_4 (SEQ ID NO: 907)
MKTFFKTLSAAALALILAACGGQKDSAPAASASAAADNGAEKKEIVFGTTVGDFGDMVKE
HIQPELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

-continued

```
>ZV16_4                                                          (SEQ ID NO: 908)
MKTFFKTLSAAALALILAACGGQKDSAPAASASAAADNGAEKKEIVFGTTVGDFGDMVKE
HIQPELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV17_4                                                          (SEQ ID NO: 909)
MKTFFKTLSAAALALILAACGGQKDSAPAASASAAADNGAEKKEIVFGTTVGDFGDMVKE
QIQAELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV18_4                                                          (SEQ ID NO: 910)
MKTFFKTLSAAALALILAACGGQKDSAPAASASAAADNGAEKKEIVFGTTVGDFGDMVKE
HIQPELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV19_4                                                          (SEQ ID NO: 911)
MKTFFKTLSAAALALILAACGGQKDSAPAASASAAADNGAAKKEIVFGTTVGDFGDMVKE
QIQAELEKKGYTVELVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV20_4                                                          (SEQ ID NO: 912)
MKTFFKTLSAAALALILAACGGQKDSAPAASASAAADNGAAKKEIVFGTTVGDFGDMVKE
QIQAELEKKGYTVELVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV21_4                                                          (SEQ ID NO: 913)
MKTFFKTLSAAALALILAACGGQKDSAPAASASAAADNGAAKKEIVFGTTVGDFGDMVKE
QIQAELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV22_4                                                          (SEQ ID NO: 914)
MKTFFKTLSAAALALILAACGGQKDSAPAASASAAADNGAAKKEIVFGTTVGDFGDLVKE
QIQPELEKKGYTVELVEFTDDVRPNLALGEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV24_4ASS                                                       (SEQ ID NO: 915)
MKTFFKTLSAAALALILAACGGQKDSAPAASASAAADNGAEKKEIVFGTTVGDFGDMVKE
HIQPELEKKGYTVELVEFTDDVRPNLALGEGELDIIVFQHKPYLDDFKKEQNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV25_4                                                          (SEQ ID NO: 916)
MKTFFKTLSAAALALILAACGGQKDSAPAASASAAADNGAEKKEIVFGTTVGDFGDMVKE
QIQPELEKKGYTVKLVEFTDYVRPNLALAEGELDINVFQHKPYLDDFKKEHNLDITEVFQ
VPTAPLGLYPGKLKSLEEVKDGSTVSAPNDPSNFARALVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

>ZV26_4                                                          (SEQ ID NO: 917)
MKTFFKTLSAAALALILAACGGQKDSAPAASASAAADNGAEKKEIVFGTTVGDFGDMVKE
HIQPELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*
```

-continued

\>ZV27_4 (SEQ ID NO: 918)
MKTFFKTLSAAALALILAACGGQKDSAPAASASAAADNGAAKKEIVFGTTVGDFGDMVKE
QIQPELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

\>ZV28_4 (SEQ ID NO: 919)
MKTFFKTLSAAALALILAACGGQKDSAPAASASAAADNGAEKKEIVFGTTVGDFGDMVKE
HIQPELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

\>ZV29_4 (SEQ ID NO: 920)
MKTFFKTLSAAALALILAACGGQKDSAPAASASAAADNGAAKKEIVFGTTVGDFGDMVKE
QIQVELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

\>ZV32_4 (SEQ ID NO: 921)
MKTFFKTLSAAALALILAACGGQKDSAPAASAAAPSADNGAAKKEIVPGTTVGDFGDMVK
EQIQAELEKKGYTVKLVEFTDYVRPNLALAEGELDINVFQHKPYLDDFKKEHNLDITEAF
QVPTAPLGLYPGKLKSLEEVKDGSTVSAPNDPSNFARALVMLNELGWIKLKDGINPLTAS
KADIAENLKNIKIVELEAAQLPRSRADVDFAVVNGNYAISSGMKLTEALFQEPSFAYVNW
SAVKTADKDSQWLKDVTEAYNSDAFKAYAHKRFEGYKSPAAWNEGAAK*

\>ZV33_4 (SEQ ID NO: 922)
MKTFFKTLSAAALALILAACGGQKDSAPAASAAAPSADNGAAKKEIVFGTTVGDFGDMVK
EQIQAELEKKGYTVKLVEFTDYVRPNLALAEGELDINVFQHKPYLDDFKKEHNLDITEAF
QVPTAPLGLYPGKLKSLEEVKDGSTVSAPNDPSNFARALVMLNELGWIKLKDGINPLTAS
KADIAENLKNIKIVELEAAQLPRSRADVDFAVVNGNYAISSGMKLTEALFQEPSFAYVNW
SAVKTADKDSQWLKDVTEAYNSDAFKAYAHKRFEGYKYPAAWNEGAAK*

\>ZV96_4 (SEQ ID NO: 923)
MKTFFKTLSAAALALILAACGGQKDSAPAASASAAADNGAEKKEIVFGTTVGDFGDMVKE
QIQAELEKKGYTVKLVEFTDYVRPNLALAEGELDINVFQHKPYLDDFKKEHNLDITEVFQ
VPTAPLGLYPGKLKSLEEVKDGSTVSAPNDPSNFARVLVMLDELGWIKLKDGINPLTASK
ADIAENLKNIKIVELEAAQLPRSRADVDFAVVNGNYAISSGMKLTEALFQEPSFAYVNWS
AVKTADKDSQWLKDVTEAYNSDAFKAYAHKRFEGYKSPAAWNEGAAK*

FIG. 8 shows the results of aligning the sequences of each of these strains. Dark shading indicates regions of homology, and gray shading indicates the conservation of amino acids with similar characteristics. As is readily discernible, there is significant conservation among the various strains of ORF 4 (SEQ ID NO: 216), further confirming its utility as an antigen for both vaccines and diagnostics.

It will be appreciated that the invention has been described by means of example only, and that modifications may be made whilst remaining within the spirit and scope of the invention.

SEQUENCE LISTING (1098 sequences)

SEQ ID NO: 1 - DNA, 502 bp, Neisseria meningitidis
  misc_feature (66)..(66): N= Unknown
  misc_feature (483)..(483): N= Unknown
atgaaacagacagtcaaatgcttgccgccgccctgattgccttgggcttgaaccgaccggtgtggncggatgacgtatcggattttcgggaaaacttgcagcggcagcacagggaaatgcagcagcccaatacaatttgggcgcaatgtattacaaaggacgcgcgtgcgccgggatgatgctgaagcggtcagatggtatcggcagccggcggaacaggggttagcccaagcccaatacaatttgggctggatgtatgccaacgggcgcgcgtgcgccaagatgataccgaagcggtcagatggtatcggcaggcggcagcgcagggggttgtccaagcccaatacaatttgggcgtgatatatgccgaaggacgtggagtgcgccaagacgatgtcgaagcggtcagatggtttcggcaggcggcagcgcagggggtagcccaagcccaaaacaatttgggcgtgatgtatgccgaaagancgcgcgtgcgccaagaccg

SEQ ID NO: 2 - protein, 168 aa, Neisseria meningitidis
  misc_feature (6)..(6): Xaa= any amino acid
  misc_feature (23)..(24): Xaa= any amino acid
  misc_feature (34)..(34): Xaa= any amino acid
  misc_feature (52)..(52): Xaa= any amino acid
  misc_feature (92)..(92): Xaa= any amino acid
  misc_feature (163)..(163): Xaa= any amino acid
MKQTVXMLAAALIALGLNRPVWXDDVSDFRENLXAAAQGNAAAQYNLGAMYXQRTRVRRDDAEAVRWYRQPAEQGLAQAQYNLGWMYANGRXVRQDDTEAVRWYRQAAAQGVVQAQYNLGVIYAEGRGVRQDDVEAVRWFRQAAAQGVAQAQNNLGVMYAERXRVRQD

SEQ ID NO: 3 - DNA, 597 bp, Neisseria meningitidis
atgaaacagacagtcaaatggcttgccgccgccctgattgccttgggcttgaaccgagcggtgtgggcggatgacgtatcggattttcgggaaaacttgcaggcggcagcacagggaaatgcagcagcccaatacaatttgggcgcaatgtattacaaaggacgcggcgtgcgccgggatgatgctgaagcggtcagatggtatcggcaggcggcggaacaggggttagcccaagcccaatacaatttgggctggatgtatgccaacgggcgcggcgtgcgccaagatgataccgaagcggtcagatggtatcggcaggcggcagcgcagggggttgtccaagcccaatacaatttgggcgtgatatatgccgaaggacgtggagtgcgccaagacgatgtcgaagcggtcagatggtttcggcaggcggcagcgcagggggtagcccaagcccaaaacaatttgggcgtgatgtatgccgaaagacgcggcgtgcgccaagaccgcgcccttgcacaagaatggtttggcaaggcttgtcaaaacggagaccaagacggctgcgacaatgaccaacgcctgaaggcgggttattga

SEQ ID NO: 4 - protein, 198 aa, Neisseria meningitidis
MKQTVKWLAAALIALGLNRAVWADDVSDFRENLQAAAQGNAAAQYNLGAMYYKGRGVRRDDAEAVRWYRQAAEQGLAQAQYNLGWMYANGRGVRQDDTEAVRWYRQAAAQGVVQAQYNLGVIYAEGRGVRQDDVEAVRWFRQAAAQGVAQAQNNLGVMYAERRGVRQDRALAQEWFGKACQNGDQDGCDNDQRLKAGY

SEQ ID NO: 5 - DNA, 273 bp, Neisseria meningitidis
atgaaacagacagtcaaatggcttgccgccgccctgattgccttgggcttgaaccaagcggtgtgggcggatgacgtatcggattttcgggaaaacttgcaggcggcagcacagggaaatgcagcagcccaaaacaatttgggcgtgatgtatgccgaaagacgcggcgtgcgccaagaccgcgcccttgcacaagaatggcttggcaaggcttgtcaaaacggataccaagacagctgcgacaatgaccaacgcctgaaagcgggttattga

SEQ ID NO: 6 - protein, 90 aa, Neisseria meningitidis
MKQTVKWLAAALIALGLNQAVWADDVSDFRENLQAAAQGNAAAQNNLGVMYAERRGVRQDRALAQEWLGKACQNGYQDSCDNDQRLKAGY

SEQ ID NO: 7 - DNA, 381 bp, Neisseria gonorrhoeae
atgaaacagacagtcaaatggcttgccgccgccctgattgccttgggcttgaaccaagcggtgtgggcgggtgacgtatcggattttcgggaaaacttgcaggcggcagaacagggaaatgcagcagcccaattcaatttgggcgtgatgtatgaaaatggacaaggagttcgtcaagattatgtacaggcagtgcagtggtatcgcaaggcttcagaacaaggggatgcccaagcccaatacaatttgggcttgatgtattacgatggacgcggcgtgcgccaagaccttgcgctcgctcaacaatggcttggcaaggcttgtcaaaacggagaccaaaacagctgcgacaatgaccaacgcctgaaggcgggttattaa

SEQ ID NO: 8 - protein, 126 aa, Neisseria meningitidis
MKQTVKWLAAALIALGLNQAVWAGDVSDFRENLQAAEQGNAAAQFNLGVMYENGQGVRQDYVQAVQWYRKASEQGDAQAQYNLGLMYYDGRGVRQDLALAQQWLGKACQNGDQNSCDNDQRLKAGY

SEQ ID NO: 9 - DNA, 357 bp, Neisseria meningitidis
ttcggcgacatcggcggtttgaaggtcaatgcccccgtcaaatccgcaggcgtattggtcgggcgcgtcggcgctatcggacttgacccgaaatcctatcaggcgagggtgcgcctcgatttggacggcaagtatcagttcagcagcgacgtttccgcgcaaatcctgacttcsggacttttgggcgagcagtacatcgggctgcagcagggcggcgacacggaaaaccttgctgccggcgacaccatctccgtaaccagttctgcaatggttctggaaaaccttatcggcaaattcatgacgagttttgccgagaaaaatgccgacggcggcaatgcggaaaaagccgccgaataa

SEQ ID NO: 10 - protein, 118 aa, Neisseria meningitidis
FGDIGGLKVNAPVKSAGVLVGRVGAIGLDPKSYQARVRLDLDGKYQFSSDVSAQILTSGLLGEQYIGLQQGGDTENLAAGDTISVTSSAMVLENLIGKFMTSFAEKNADGGNAEKAAE

SEQ ID NO: 11 - DNA, 858 bp, Neisseria meningitidis
attttgatatacctcatccgcaagaatctaggttcgcccgtcttcttctttcaggaacgccccggaaaggacggaaaaccttttaaaatggtcaaattccgttccatgcgcgacggcttgtattcagacggcattccgctgcccgacggagaacgcctgacaccgttcggcaaaaaactgcgtgccgccagtwtggacgaactgcctgaattatggaatatcttaaaaggcgagatgagcctggtcggcccccgcccgctgctgatgcaatatctgccgctgtacgacaacttccaaaaccgccgccacgaaatgaaacccggcattaccggctgggcgcaggtcaacgggcgcaacgcgctttcgtgggacgaaaaattcgcctgcgatgtttggtatatcgaccacttcagcctgtgcctcgacatcaaaatcctactgctgacggttaaaaaagtattaatcaaggaagggatttccgcacagggcgaacaaccatgccccctttcacaggaaaacgcaaactcgccgtcgtcggtgcgggcggacacggaaaagtcgttgccgaccttgccgccgcactcggccggtacagggaaatcgtttttctggacgaccgcgcacaaggcagcgtcaacggcttttccgtcatcggcacgacgctgctgcttgaaaacagtttatcgcccgaacaatacgacgtcgccgtcgccgtcggcaacaaccgcatccgccgccaaatcgccgaaaaagccgccgcgctcggcttcgccctgcccgtactggttcatccggacgcgaccgtctcgccttctgcaacagtcggacaaggcagcgtcgttatggcgaaagcggtcg

SEQ ID NO: 12 - protein, 286 aa, Neisseria meningitidis
  misc_feature (65)..(65): Xaa= any amino acid
  misc_feature (165)..(165): Xaa= any amino acid
ILIYLIRKNLGSPVFFFQERPGKDGKPFKMVKFRSMRDGLYSDGIPLPDGERLTPFGKKLRAASXDELPELWNILKGEMSLVGPRPLLMQYLPLYDNFQNRRHEMKPGITGWAQVNGRNALSWDEKFACDVWYIDHFSLCLDIKILLLTVKKVLIKEGISAQGEXTMPPFTGKRKLAVVGAGGHGKVVADLAAALGRYREIVFLDDRAQGSVNGFSVIGTTLLLENSLSPEQYDVAVAVGNNRIRRQIAEKAAALGFALPVLVHPDATVSPSATVGQGSVVMAKAV

SEQ ID NO: 13 - DNA, 1242 bp, Neisseria meningitidis
atgagtaaattcttcaaacgcctgtttgacattgttgcctccgcctcgggactgattttcctctcgccagtatttttgattttgatatacctcatccgcaagaatctaggttcgcccgtcttcttctttcaggaacgccccggaaaggacggaaaaccttttaaaatggtcaaattccgttccatgcgcgacgcgcttgattcagacggcattccgctgcccgacggagaacgcctgacaccgttcggcaaaaaactgcgtgccgccagtttggacgaactgcctgaattatggaatatcttaaaaggcgagatgagcctggtcggcccccgcccgctgctgatgcaatatctgccgctgtacgacaacttccaaaaccgccgccacgaaatgaaacccggcattaccggctgggcgcaggtcaacgggcgcaacgcgctttcgtgggacgaaaaattcgcctgcgatgtttggtatatcgaccacttcagcctgtgcctcgacatcaaaatcctactgctgacggttaaaaaagtattaatcaaggaagggatttccgcacagggcgaagccaccatgccccctttcacaggaaaacgcaaactcgccgtcgtcggtgcgggcggacacggaaaagtcgttgccgaccttgccgccgcactcggccggtacagggaaatcgtttttctggacgaccgcgcacaaggcagcgtcaacggcttttccgtcatcggcacgacgctgctgcttgaaaacagtttatcgcccgaacaatacgacgtcgccgtcgccgtcggcaacaaccgcatccgccgccaaatcgccgaaaaagccgccgcgctcggcttcgccctgcccgttctggttcatccggacgcgaccgtctcgccttctgcaacagtcggacaaggcagcgtcgttatggcgaaagccgtcgtacaggcaggcagcgtattgaaagacggcgtgattgtgaacactgccgccaccgtcgatcacgactgcctgcttaacgctttcgtccacatcagcccaggcgcgcacctgtcgggcaacacgcatatcggcgaagaaagctggataggcacgggcgcgtgcagccgccagcagatccgtatcggcagccgcgcaaccattggagcgggcgcagtcgtcgtacgcgacgtttcagacggcatgaccgtcgcgggcaatccggcaaagccgctgccgcgcaaaaaccccgagacctcgacagcataa

SEQ ID NO: 14 - protein, 413 aa, Neisseria meningitidis
MSKFFKRLFDIVASASGLIFLSPVFLILIYLIRKNLGSPVFFFQERPGKDGKPFKMVKFRSMRDALDSDGIPLPDGERLTPFGKKLRAASLDELPELWNILKGEMSLVGPRPLLMQYLPLYDNFQNRRHEMKPGITGWAQVNGRNALSWDEKFACDVWYIDHFSLCLDIKILLLTVKKVLIKEGISAQGEATMPPFTGKRKLAVVGAGGHGKVVADLAAALGRYREIVFLDDRAQGSVNGFSVIGTTLLLENSLSPEQYDVAVAVGNNRIRRQIAEKAAALGFALPVLVHPDATVSPSATVGQGSVVMAKAVVQAGSVLKDGVIVNTAATVDHDCLLNAFVHISPGAHLSGNTHIGEESWIGTGACSRQQIRIGSRATIGAGAVVVRDVSDGMTVAGNPAKPLPRKNPETSTA

SEQ ID NO: 15 - DNA, 1242 bp, Neisseria meningitidis
atgagtaaattcttcaaacgcctgtttgacattgttgcctccgcctcgggactgattttcctctcgccagtatttttgattttgatatacctcatccgcaagaatctgggttcgcccgtcttcttctttcaggaacgccccggaaaggacggaaaaccttttaaaatggtcaaattccgttccatgcacgacgcgcttgattcagacggcattctgctgcccgacggagaacgcctgacaccgttcggcaaaaaactgcgtgccgccagtttggacgaactgcccgaactgtggaacgtcctcaaaggcgacatgagcctggtcggcccccgcccgctgctgatgcaatatctgccgctgtacgacaacttccaaaaccgccgccacgaaatgaaaccgggcattaccggctgggcgcaggtcaacgggcgcaacgcgctttcgtgggacgaacgcttcgcatgcgacatctggtatatcgaccacttcagcctgtgcctcgacatcaaaatcctactgctgacggttaaaaaagtattaatcaaagaagggatttccgcacagggcgaagccaccatgccccctttcacaggaaaacgcaaacttgccgtcgtcggtgcgggcggacacggcaaagtcgttgccgagcttgccgccgcactcggcacatacggcgaaatcgtttttctggacgaccgcgtccaaggcagcgtcaacggcttccccgtcatcggcacgacgctgctgcttgaaaacagtttatcgcccgaacaattcgacatcgccgtcgccgtcggcaacaaccgcatccgccgccaaatcgccgaaaaagccgccgcgctcggcttcgccctgcccgtcctgattcatccggactcgaccgtctcgccttctgcaacagtcggacaaggcggcgtcgttatggcgaaagccgtcgtacaggctgacagcgtattgaaagacggcgtaattgtgaacactgccgccaccgtcgatcacgattgcctgcttgatgctttcgtccacatcagcccgggcgcgcacctgtcgggcaacacgcgtatcggcgaagaaagctggataggcacaggcgcgtgcagccgccagcagatccgtatcggcagccgcgcaaccattggagcgggcgcagtcgtcgtgcgcgacgtttcagacggcatgaccgtcgcgggcaacccggcaaaaccattggcaggcaaaaataccgagaccctgcggtcgtaa

SEQ ID NO: 16 - protein, 413 aa, Neisseria meningitidis
MSKFFKRLFDIVASASGLIFLSPVFLILIYLIRKNLGSPVFFFQERPGKDGKPFKMVKFRSMHDALDSDGILLPDGERLTPFGKKLRAASLDELPELWNVLKGDMSLVGPRPLLMQYLPLYDNFQNRRHEMKPGITGWAQVNGRNALSWDERFACDIWYIDHFSLCLDIKILLLTVKKVLIKEGISAQGEATMPPFTGKRKLAVVGAGGHGKVVAELAAALGTYGEIVFLDDRVQGSVNGFPVIGTTLLLENSLSPEQFDIAVAVGNNRIRRQIAEKAAALGFALPVLIHPDSTVSPSATVGQGGVVMAKAVVQADSVLKDGVIVNTAATVDHDCLLDAFVHISPGAHLSGNTRIGEESWIGTGACSRQQIRIGSRATIGAGAVVVRDVSDGMTVAGNPAKPLAGKNTETLRS

SEQ ID NO: 17 - DNA, 1242 bp, Neisseria gonorrhoeae
atgagtaaagccgtcaaacgcctgttcgacatcatcgcatccgcatcggggctgattgtcctgtcgcccgtgtttttggttttaatatacctcatccgcaaaaacttaggttcgcccgtcttcttcattcgggaacgccccggaaaggacggaaaaccttttaaaatggtcaaattccgttccatgcgcgacgcgcttgattcagacggcattccgctgcccgatagcgaacgcctgaccgatttcggcaaaaaattacgcgccaccagtttggacgaacttcctgaattatggaatgtcctcaaaggcgagatgagcctggtcggcccccgcccgcttttgatgcagtatctgccgctttacaacaaatttcaaaaccgccgccacgaaatgaaaccgggcattaccggctgggcgcaggtcaacgggcgcaacgcgctttcgtgggacgaaaagttctcctgcgatgtttggtacaccgacaatttcagcttttggctggatatgaaaatcctgtttctgacagtcaaaaaagtcttgattaaagaaggcatttcggcgcaaggggaagccaccatgccccctttcgcggggaatcgcaaactcgccgttatcggcgcgggcggacacggcaaagtcgttgccgagcttgccgccgcactcggcacatacggcgaaatcgtttttctggacgaccgcacccaaggcagcgtcaacggcttccccgtcatcggcacgacgctgctgcttgaaaacagtttatcgcccgaacaattcgacatcaccgtcgccgtcggcaacaaccgcatccgccgccaaatcaccgaaaacgccgccgcgctcggcttcaaactgcccgttctgattcatcccgacgcgaccgtctcgccttctgcaataatcggacaaggcagcgtcgtaatggcgaaagccgtcgtacaggccggcagcgtattgaaagacggcgtgattgtgaacactgccgccaccgtcgatcacgactgcctgcttgacgctttcgtccacatcagcccgggcgcgcacctgtcgggcaacacgcgtatcggcgaagaaagccggataggcacgggcgcgtgcagccgccagcagacaaccgtcggcagcggggttaccgccggtgcaggggcggttatcgtatgcgacatcccggacggcatgaccgtcgcgggcaacccggcaaagccccttacgggcaaaaaccccaagaccgggacggcataa

SEQ ID NO: 18 - protein, 413 aa, Neisseria gonorrhoeae
MSKAVKRLFDIIASASGLIVLSPVFLVLIYLIRKNLGSPVFFIRERPGKDGKPFKMVKFRSMRDALDSDGIPLPDSERLTDFGKKLRATSLDELPELWNVLKGEMSLVGPRPLLMQYLPLYNKFQNRRHEMKPGITGWAQVNGRNALSWDEKFSCDVWYTDNFSFWLDMKILFLTVKKVLIKEGISAQGEATMPPFAGNRKLAVIGAGGHGKVVAELAAALGTYGEIVFLDDRTQGSVNGFPVIGTTLLLENSLSPEQFDITVAVGNNRIRRQITENAAALGFKLPVLIHPDATVSPSAIIGQGSVVMAKAVVQAGSVLKDGVIVNTAATVDHDCLLDAFVHISPGAHLSGNTRIGEESRIGTGACSRQQTTVGSGVTAGAGAVIVCDIPDGMTVAGNPAKPLTGKNPKTGTA

SEQ ID NO: 19 - DNA, 394 bp, Neisseria meningitidis
aaccatatggcgattgtcatcgacgaatacggcggcacatccggcttggtcacctttgaagacatcatcgagcaaatcgtcggcgaaatcgaagacgagtttgacgaagacgatagcgccgacaatatccatgccgtttcttcagacacgtggcgcatccatgcagctaccgaaatcgaagacatcaacaccttcttcggcacggaatacagcatcgaagaagccgacaccattggcggcctggtcattcaagagttgggacatctgcccgtgcgcggcgaaaaagtccttatcggcggtttgcagttcaccgtcgcacgcgccgacaaccgccgcctgcatacgctgatggcgacccgcgtgaagtaagcaccgccgtttctgcacagtttag

SEQ ID NO: 20 - protein, 131 aa, Neisseria meningitidis
  misc_feature (79)..(79): Xaa= any amino acid
  misc_feature (125)..(125): Xaa= any amino acid
NHMAIVIDEYGGTSGLVTFEDIIEQIVGEIEDEFDEDDSADNIHAVSSDTWRIHAATEIEDINTFFGTEYSIEEADTIXRPGHSRVGTSARARRKSPYRRFAVHRRTRRQPPPAYADGDPREVSXRRFCTV

SEQ ID NO: 21 - DNA, 900 bp, Neisseria meningitidis
atggacggcgcacaaccgaaaacgaatttttttgaacgcctgattgcccgactcgcccgcgaacccgattccgccgaagacgtattaaacctgcttcggcaggcgcacgagcaggaagtttttgatgcggatacgcttttaagattggaaaaagtcctcgatttttccgatttggaagtgcgcgacgcgatgattacgcgcagccgtatgaacgttttaaaagaaaacgacagcatcgagcgcatcaccgcctacgttatcgataccgcccattcgcgcttccccgtcatcggcgaagacaaagacgaagttttgggcattttgcacgccaaagacctgctcaaatatatgtttaaccccgagcagttccacctcaaatccattctccgccccgccgtcttcgtccccgaaggcaaatcgctgaccgcccttttaaaagagttccgcgaacagcgcaaccatatggcgattgtcatcgacgaatacggcggcacatccggcttggtcacctttgaagacatcatcgagcaaatcgtcggcgaaatcgaagacgagtttgacgaagacgatagcgccgacaatatccatgccgtttcttccgaacgctggcgcatccatgcagctaccgaaatcgaagacatcaacaccttcttcggcacggaatacagcagcgaagaagccgacaccattcggcctggtcattcaagagttgggacatctgcccgtgcgcggcgaaaaagtccttatcggcggtttgcagttcaccgtcgcacgcgccgacaaccgccgcctgcatacgctgatggcgacccgcgtgaagtaagcaccgccgtttctgcacagtttaggatgacggtacgggcgttttctgtttcaatccgccccatccgccaaacataa

SEQ ID NO: 22 - protein, 299 aa, Neisseria meningitidis
MDGAQPKTNFFERLIARLAREPDSAEDVLNLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGEIEDEFDEDDSADNIHAVSSERWRIHAATEIEDINTFFGTEYSSEEADTIRPGHSRVGTSARARRKSPYRRFAVHRRTRRQPPPAYADGDPREVSTAVSAQFRMTVRAFSVSIRPIRQT

SEQ ID NO: 23 - DNA, 903 bp, Neisseria meningitidis
  misc_feature (33)..(34): N= Unknown
  misc_feature (698)..(698): N= Unknown
  misc_feature (717)..(717): N= Unknown
  misc_feature (746)..(746): N= Unknown
  misc_feature (756)..(757): N= Unknown
  misc_feature (763)..(763): N= Unknown
  misc_feature (769)..(769): N= Unknown
  misc_feature (776)..(776): N= Unknown
  misc_feature (781)..(781): N= Unknown
  misc_feature (897)..(897): N= Unknown
atggacggcgcacaaccgaaaacaaattttttnnaacgcctgattgcccgactcgcccgcgaacccgattccgccgaagacgtattgaccctgttgcgccaagcgcacgaacaggaagtatttgatgcggatacgcttttaagattggaaaaagtcctcgatttttctgatttggaagtgcgcgacgcgatgattacgcgcagccgtatgaacgttttaaaagaaaacgacagcatcgaacgcatcaccgcctacgttatcgataccgcccattcgcgcttccccgtcatcggtgaagacaaagacgaagttttgggtattttgcacgccaaagacctgctcaaatatatgttcaaccccgagcagttccacctcaaatcgatattgcgccctgccgtcttcgtccccgaaggcaaatcgctgaccgcccttttaaaagagttccgcgaacagcgcaaccatatggcaatcgtcatcgacgaatacggcggcacgtcgggtttggtaacttttgaagacatcatcgagcaaatcgtcggcgacatcgaagatgagtttgacgaagacgaaagcgcggacaacatccacgccgtttccgccgaacgctggcgcatccacgcggctaccgaaatcgaagacatcaacgcctttttcggcacggaatacagcagcgaagaagccgacaccatcggcggccntggtcattcaggaattggnacacctgcccgtgcgcggcgaaaaagtcnttatcggcgnnttgcanttcacngtcgccngcgcngacaaccgccgcctgcatacgctgatggcgacccgcgtgaagtaagctccgccgtttctgtacagtttaggatgacggtacgggcgttttctgtttcaatccgccccatccgccanacataa

SEQ ID NO: 24 - protein, 300 aa, Neisseria meningitidis
  misc_feature (11)..(12): Xaa= any amino acid
  misc_feature (233)..(233): Xaa= any amino acid
  misc_feature (249)..(249): Xaa= any amino acid
  misc_feature (253)..(253): Xaa= any amino acid
  misc_feature (255)..(255): Xaa= any amino acid
  misc_feature (257)..(257): Xaa= any amino acid
  misc_feature (259)..(259): Xaa= any amino acid
  misc_feature (261)..(261): Xaa= any amino acid
  misc_feature (299)..(299): Xaa= any amino acid
MDGAQPKTNFXXRLIARLAREPDSAEDVLTLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGDIEDEFDEDESADNIHAVSAERWRIHAATEIEDINAFFGTEYSSEEADTIGGXGHSGIGTPARARRKSXYRRXAXHXRXRXQPPPAYADGDPREVSSAVSVQFRMTVRAFSVSIRPIRXT

SEQ ID NO: 25 - DNA, 8 bp, Neisseria gonorrhoeae
  misc_feature (1)..(8): N= Unknown
nnnnnnnn

SEQ ID NO: 26 - protein, 287 aa, Neisseria gonorrhoeae
MDGAQPKTNFFERLIARLAREPDSAEDVLNLLRQAHEQEVFDADTLTRLEKVLDFAELEVRDAMITRSRMNVLKENDSIERITAYVIDTAHSRFPVIGEDKDEVLGILHAKDLLKYMFNPEQFHLKSVLRPAVFVPEGKSLTALLKEFREQRNHMAIVIDEYGGTSGLVTFEDIIEQIVGDIEDEFDEDESADDIHSVSAERWRIHAATEIEDINAFFGTEYGSEEADTIRRLGHSGIGTPARARRKSPYRRFAVHRRPRRQPPPAHADGDPREVSRACPHRRFCTV

SEQ ID NO: 27 - DNA, 915 bp, Neisseria gonorrhoeae
atggacggcgcacaaccgaaaacaaatttttttgaacgcctgattgcccgactcgcccgcgaacccgattccgccgaagacgtattaaacctgcttcggcaggcgcacgaacaggaagtttttgatgccgacacactgacccggctggaaaaagtattggactttgccgagctggaagtgcgcgatgcgatgattacgcgcagccgcatgaacgtattgaaagaaaacgacagcatcgaacgcatcaccgcctacgtcatcgataccgcccattcgcgcttccccgtcatcggcgaagacaaagacgaagttttgggcattttgcacgccaaagacctgctcaaatatatgttcaaccccgagcagttccacctgaaatccgtcttgcgccctgccgttttcgtgcccgaaggcaaatctttgaccgcccttttaaaagagttccgcgaacagcgcaaccatatggcaatcgtcatcgacgaatacggcggcacgtcgggtttggtcacctttgaagacatcatcgagcaaatcgtcggtgacatcgaagacgagtttgacgaagacgaaagcgccgacgacatccactccgtttccgccgaacgctggcgcatccacgcggctaccgaaatcgaagacatcaacgcctttttcggtacggaatacggcagcgaagaagccgacaccatccggcggcttggtcattcaggaattgggacacctgcccgtgcgcggcgaaaaagtccttatcggcggtttgcagttcaccgtcgcccgcgccgacaaccgccgcctgcacacgctgatggcgacccgcgtgaagtaagcagagcctgcccgaccgccgtttctgcacagtttaggatgacggtacggtcgttttctgtttcaatccgccccatccgccaaacataa

SEQ ID NO: 28 - protein, 304 aa, Neisseria gonorrhoeae
MDGAQPKTNFFERLIARLAREPDSAEDVLNLLRQAHEQEVFDADTLTRLEKVLDFAELEVRDAMITRSRMNVLKENDSIERITAYVIDTAHSRFPVIGEDKDEVLGILHAKDLLKYMFNPEQFHLKSVLRPAVFVPEGKSLTALLKEFREQRNHMAIVIDEYGGTSGLVTFEDIIEQIVGDIEDEFDEDESADDIHSVSAERWRIHAATEIEDINAFFGTEYGSEEADTIRRLGHSGIGTPARARRKSPYRRFAVHRRPRRQPPPAHADGDPREVSRACPTAVSAQFRMTVRSFSVSIRPIRQT

SEQ ID NO: 29 - DNA, 563 bp, Neisseria meningitidis
atgcgcggcggcaggccggattccgttaccgtgcagattatcgaaggttcgcgtttttcgcatatgaggaaagtcatcgacgcaacgcccgacatcggacacgacaccaaaggctggagcaatgaaaaactgatggcggaagttgcgcccgatgccttcagcggcaatcctgaagggcagtttttccccgacagctacgaaatcgatgcgggcggcagtgatttgcagatttaccaaaccgcctacaagggcgatgcaacgccgcctgaatgagggcatgggaaagcaggcaggacgggctgccttataaaaacccttatgaaatgctgattatggcgarcctggtcgaaaaggaaacagggcatgaagccgascscgaccatgtcgcttccgtcttcgtcaaccgcctgaaaatcggtatgcgcctgcaaaccgasscgtccgtgatttacggcatgggtgcggcatacaagggcaaaatccgtaaagccgacctgcgccgcgacacgccgtacaacacctacacgcgcggcggtctgccgccaaccccgattgcgctgccc

SEQ ID NO: 30 - protein, 187 aa, Neisseria meningitidis
  misc_feature (113)..(113): Xaa= any amin acid
  misc_feature (124)..(125): Xaa= any amin acid
  misc_feature (145)..(146): Xaa= any amin acid
MRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWESRQDGLPYKNPYEMLIMAXLVEKETGHEAXXDHVASVFVNRLKIGMRLQTXXSVIYGMGAAYKGKIRKADLRRDTPYNTYTRGGLPPTPIALP

SEQ ID NO: 31 - DNA, 996 bp, Neisseria meningitidis
atgttgagaaaattgttgaaatggtctgccgtttttttgaccgtgtcggcagccgttttcgccgcgctgctttttgttcctaaggataacggcagggcataccgaatcaaaattgccaaaaaccagggtatttcgtcggtcggcaggaaacttgccgaagaccgcatcgtgttcagcaggcatgttttgacggcggcggcctacgttttgggtgtgcacaacaggctgcatacggggacgtacagattgccttcggaagtgtctgcttgggatatcttgcagaaaatgcgcggcggcaggccggattccgttaccgtgcagattatcgaaggttcgcgtttttcgcatatgaggaaagtcatcgacgcaacgcccgacatcggacacgacaccaaaggctggagcaatgaaaaactgatggcggaagttgcgcccgatgccttcagcggcaatcctgaagggcagtttttccccgacagctacgaaatcgatgcgggcggcagtgatttgcagatttaccaaaccgcctacaaggcgatgcaacgccgcctgaatgaggcatgggaaagcaggcaggacgggctgccttataaaaacccttatgaaatgctgattatggcgagcctggtcgaaaaggaaacagggcatgaagccgaccgcgaccatgtcgcttccgtcttcgtcaaccgcctgaaaatcggtatgcgcctgcaaaccgacccgtccgtgatttacggcatgggtgcggcatacaagggcaaaatccgtaaagccgacctgcgccgcgacacgccgtacaacacctacacgcgcggcggtctgccgccaaccccgattgcgctgcccggcaaggcggcactcgatgccgccgcccatccgtccggcgaaaaatacctgtatttcgtgtccaaaatggacggcacgggcttgagccagttcagccatgatttgaccgaacacaatgccgccgtccgcaaatatattttgaaaaaataa

SEQ ID NO: 32 - protein, 331 aa, Neisseria meningitidis
MLRKLLKWSAVFLTVSAAVFAALLFVPKDNGRAYRIKIAKNQGISSVGRKLAEDRIVFSRHVLTAAAYVLGVHNRLHTGTYRLPSEVSAWDILQKMRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWESRQDGLPYKNPYEMLIMASLVEKETGHEADRDHVASVFVNRLKIGMRLQTDPSVIYGMGAAYKGKIRKADLRRDTPYNTYTRGGLPPTPIALPGKAALDAAAHPSGEKYLYFVSKMDGTGLSQFSHDLTEHNAAVRKYILKK

SEQ ID NO: 33 - DNA, 996 bp, Neisseria meningitidis
atgttgagaaaattgttgaaatggtctgccgtttttttgaccgtatcggcagccgttttcgccgcgctgcttttcgtccctaaagacaacggcagggcatacaggattaaaattgccaaaaaccagggtatttcgtcggtcggcaggaaacttgccgaagaccgcatcgtgttcagcaggcatgttttgacggcggcggcctacgttttgggtgtgcacaacaggctgcatacggggacgtacagactgccttcggaagtgtctgcttgggatatcttgcagaaaatgcgcggcggcaggccggattccgttaccgtgcagattatcgaaggttcgcgtttttcgcatatgaggaaagtcatcgacgcaacgcccgacatcgaacacgacaccaaaggctggagcaatgaaaaactgatggcggaagttgcccctgatgccttcagcggcaatcctgaagggcagtttttccccgacagctacgaaatcgatgcgggcggcagcgatttacggatttaccaaatcgcctacaaggcgatgcaacgccgactgaatgaggcatgggaaagcaggcaggacgggctgccttataaaaacccttatgaaatgctgattatggcgagcctgatcgaaaaggaaacagggcatgaagccgaccgcgaccatgtcgcttccgtcttcgtcaaccgcctgaaaatcggtatgcgcctgcaaaccgacccgtccgtgatttacggcatgggtgcggcatacaagggcaaaatccgtaaagccgacctgcgccgcgacacgccgtacaacacctacacgcgcggcggtctgccgccaaccccgatcgcgctgcccggcaaggcggcactcgatgccgccgcccatccgtccggtgaaaaatacctgtatttcgtgtccaaaatggacggtacgggcttgagccagttcagccatgatttgaccgaacacaacgccgccgttcgcaaatatattttgaaaaaataa

SEQ ID NO: 34 - protein, 331 aa, Neisseria meningitidis
MLRKLLKWSAVFLTVSAAVFAALLFVPKDNGRAYRIKIAKNQGISSVGRKLAEDRIVFSRHVLTAAAYVLGVHNRLHTGTYRLPSEVSAWDILQKMRGGRPDSVTVQIIEGSRFSHMRKVIDATPDIEHDTKGWSNEKLMAEVAPDAFSGNPEGQFFPDSYEIDAGGSDLRIYQIAYKAMQRRLNEAWESRQDGLPYKNPYEMLIMASLIEKETGHEADRDHVASVFVNRLKIGMRLQTDPSVIYGMGAAYKGKIRKADLRRDTPYNTYTRGGLPPTPIALPGKAALDAAAHPSGEKYLYFVSKMDGTGLSQFSHDLTEHNAAVRKYILKK

SEQ ID NO: 35 - DNA, 8 bp, Neisseria gonorrhoeae
  misc_feature (1)..(8): N= Unknown
nnnnnnnn

SEQ ID NO: 36 - protein, 236 aa, Neisseria gonorrhoeae
MRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWAGRQDGLPYKNPYEMLIMASLIEKETGHEADRDHVASVFVNRLKIGMRLQTDPSVIYGMGAAYKGKIRKADLRRDTPYNTYTGGGLPPTRIALPGKAAMDAAAHPSGEKYLYFVSKMDGTGLSQFSHDLTEHNAAVRKYILKK

SEQ ID NO: 37 - DNA, 897 bp, Neisseria gonorrhoeae
taccgaatcaagattgccaaaaatcagggtatttcgtcggtcggcaggaaacttgccgaagaccgcatcgtgttcagcaggcatgttttgacagcggcggcctacgttttgggtgtgcacaacaggctgcatacggggacgtacagattgccttcggaagtgtctgcttgggatatcttgcagaaaatgcgcggcggcaggccggattccgttaccgtgcagattatcgaaggttcgcgtttttcgcatatgaggaaagtcatcgacgcaacgcccgacatcggacacgacaccaaaggctggagcaatgaaaaactgatggcggaagttgcgcccgatgccttcagcggcaatcctgaagggcagttttttcccgacagctacgaaatcgatgcgggcggcagcgatttgcagatttaccaaaccgcctacaaggcgatgcaacgccgcctgaacgaggcatgggcaggcaggcaggacgggctgccttataaaaacccttatgaaatgctgattatggcgagcctgatcgaaaaggaaacggggcatgaggccgaccgcgaccatgtcgcttccgtcttcgtcaaccgcctgaaaatcggtatgcgcctgcaaaccgacccgtccgtgatttacggcatgggtgcggcatacaagggcaaaatccgtaaagccgacctgcgccgcgacacgccgtacaacacctatacgggcgggggcttgccgccaacccggattgcgctgcccggcaaggcggcaatggatgccgccgcccacccgtccggcgaaaaatacctgtatttcgtgtccaaaatggacggcacgggcttgagccagttcagccatgatttgaccgaacacaacgccgccgtccgcaaatatattttgaaaaaataa

SEQ ID NO: 38 - protein, 298 aa, Neisseria gonorrhoeae
YRIKIAKNQGISSVGRKLAEDRIVFSRHVLTAAAYVLGVHNRLHTGTYRLPSEVSAWDILQKMRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWAGRQDGLPYKNPYEMLIMASLIEKETGHEADRDHVASVFVNRLKIGMRLQTDPSVIYGMGAAYKGKIRKADLRRDTPYNTYTGGGLPPTRIALPGKAAMDAAAHPSGEKYLYFVSKMDGTGLSQFSHDLTEHNAAVRKYILKK

SEQ ID NO: 39 - DNA, 498 bp, Neisseria meningitidis
cgtttcaaaatgttaactgtgttgacggcaaccttgattgccggacaggtatctgccgccggaggcggtgcgggggatatgaaacagccgaaggaagtcggaaaggttttcagaaagcagcagcgttacagcgaggaagaaatcaaaaacgaacgcgcacggcttgcggcagtgggcgagcgggttaatcagatatttacgttgctgggaggggaaaccgccttgcaaaaggggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagattgagcctataccgggtaaggcgcaaaaacgggcggggtggctgcggaacgtgctgagggaaagaggaaatcagcatctggacggacgggaagaagtgctggctcaggcggacgaaggacag

SEQ ID NO: 40 - protein, 166 aa, Neisseria meningitidis
RFKMLTVLTATLIAGQVSAAGGGAGDMKQPKEVGKVFRKQQRYSEEEIKNERARLAAVGERVNQIFTLLGGETALQKGQAGTALATYMLMLERTKSPEVAERALEMAVSLNAFEQAEMIYQKWRQIEPIPGKAQKRAGWLRNVLRERGNQHLDGREEVLAQADEGQ

SEQ ID NO: 41 - DNA, 1845 bp, Neisseria meningitidis
atgttacctaaccgtttcaaaatgttaactgtgttgacggcaaccttgattgccggacaggtatctgccgccggaggcggtgcgggggatatgaaacagccgaaggaagtcggaaaggttttcagaaagcagcagcgttacagcgaggaagaaatcaaaaacgaacgcgcacggcttgcggcagtgggcgagcgggttaatcagatatttacgttgctgggaggggaaaccgccttgcaaaaggggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagattgagcctataccgggtaaggcgcaaaaacgggcggggtggctgcggaacgtgctgagggaaagaggaaatcagcatctggacggactggaagaagtgctggctcaggcggacgaaggacagaaccgcagggtgtttttattgttggcacaagccgccgtgcaacaggacgggttggcgcaaaaagcatcgaaagcggttcgccgcgcggcgttgaaatatgaacatctgcccgaagcggcggttgccgatgtggtgttcagcgtacagggacgcgaaaaggaaaaggcaatcggagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcacaggctggatgatgcctatgcgcgtttgaacgtgctgttggaacgcaatccgaatgcagacctgtatattcaggcagcgatattggcggcaaaccgaaaagaaggtgcttccgttatcgacggctacgccgaaaaggcatacggcagggggacggaggaacagcggagcagggcggcgctaacggcggcgatgatgtatgccgaccgcagggattacgccaaagtcaggcagtggctgaaaaaagtatccgcgccggaatacctgttcgacaaaggtgtgctggcggctgcggcggctgtcgagttggacggcggcagggcggctttgcggcagatcggcagggtgcggaaacttcccgaacagcaggggcggtattttacggcagacaatttgtccaaaatacagatgctcgccctgtcgaagctgcccgataaacgggaggctttgagggggttggacaagattatcgaaaaaccgcctgccggcagtaatacagagttacaggcagaggcattggtacagcggtcagttgtttacgatcggcttggcaagcggaaaaaaatgatttcagatcttgaaagggcgttcaggcttgcacccgataacgctcagattatgaataatctgggctacagcctgctgaccgattccaaacgtttggacgaaggtttcgccctgcttcagacggcataccaaatcaacccggacgataccgctgtcaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttacgggagacaagaaaatatggcgggaaacgctcaaacgtcacggcatcgcattgccccaaccttcccgaaaacctcggaaataa

SEQ ID NO: 42 - protein, 614 aa, Neisseria meningitidis
MLPNRFKMLTVLTATLIAGQVSAAGGGAGDMKQPKEVGKVFRKQQRYSEEEIKNERARLAAVGERVNQIFTLLGGETALQKGQAGTALATYMLMLERTKSPEVAERALEMAVSLNAFEQAEMIYQKWRQIEPIPGKAQKRAGWLRNVLRERGNQHLDGLEEVLAQADEGQNRRVFLLLAQAAVQQDGLAQKASKAVRRAALKYEHLPEAAVADVVFSVQGREKEKAIGALQRLAKLDTEILPPTLMTLRLTARKYPEILDGFFEQTDTQNLSAVWQEMEIMNLVSLHRLDDAYARLNVLLERNPNADLYIQAAILAANRKEGASVIDGYAEKAYGRGTEEQRSRAALTAAMMYADRRDYAKVRQWLKKVSAPEYLFDKGVLAAAAAVELDGGRAALRQIGRVRKLPEQQGRYFTADNLSKIQMLALSKLPDKREALRGLDKIIEKPPAGSNTELQAEALVQRSVVYDRLGKRKKMISDLERAFRLAPDNAQIMNNLGYSLLTDSKRLDEGFALLQTAYQINPDDTAVNDSIGWAYYLKGDAESALPYLRYSFENDPEPEVAAHLGEVLWALGERDQAVDVWTQAAHLTGDKKIWRETLKRHGIALPQPSRKPRK

SEQ ID NO: 43 - DNA, 1839 bp, Neisseria meningitidis
  misc_feature (217)..(217): N= Unknown
  misc_feature (333)..(333): N= Unknown
  misc_feature (478)..(478): N= Unknown
  misc_feature (499)..(499): N= Unknown
  misc_feature (653)..(653): N= Unknown
  misc_feature (958)..(958): N= Unknown
  misc_feature (1165)..(1165): N= Unknown
  misc_feature (1609)..(1609): N= Unknown
atgttacccgcccgtttcaccattttatctgtgctcgcggcagccctgcttgccgggcaggcgtatgccgccggcgcggcggatgcgaagccgccgaaggaagtcggaaaggttttcagaaagcagcagcgttacagcgaggaagaaatcaaaaacgaacgcgcacggcttgcggcagtgggcgagcgggttaatcagatatttacgttgctgggangggaaaccgccttgcaaaaggggcaggcgggaacggctctggcaacctatatgctgatgttggaacgcacaaaatcccccgaagtcgccgaacgcgccttggaaatggccgtgtcnctgaacgcgtttgaacaggcggaaatgatttatcagaaatggcggcagattgagcctataccgggtaaggcgcaaaaacgggcggggtggctgcggaacgtgctgagggaaagaggaaatcagcatctagacggactggaagaantgctggctcaggcggacgaangacagaaccgcagggtgtttttattgttggcacaagccgccgtgcaacaggacgggttggcgcaaaaagcatcgaaagcggttcgccgcgcggcgttgagatatgaacatctgcccgaagcggcggttgccgatgtggtgttcagcgtacaggnacgcgaaaaggaaaaggcaatcggagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcacaggctggatgatgcctatgcgcgtttgaacgtgctgttggaacgcaatccgaatgcagacctgtatattcaggcagcgatattggcggcaaaccgaaaagaangtgcttccgttatcgacggctacgccgaaaaggcatacggcagggggacgggggaacagcggggcagggcggcaatgacggcggcgatgatatatgccgaccgaagggattacaccaaagtcaggcagtggttgaaaaaagtgtccgcgccggaatacctgttcgacaaaggtgtgctggcggctgcggcggctgtcgagttggacngcggcagggcggctttgcggcagatcggcagggtgcggaaacttcccgaacagcaggggcggtattttacggcagacaatttgtccaaaatacagatgttcgccctgtcgaagctgcccgacaaacgggaggctttgagggggttggacaagattatcgaaaaaccgcctgccggcagtaatacagagttacaggcagaggcattggtacagcggtcagttgtttacgatcggcttggcaagcggaaaaaaatgatttcagatcttgaaagggcgttcaggcttgcacccgataacgctcagattatgaataatctgggctacagcctgctttccgattccaaacgtttggacgaaggcttcgccctgcttcagacggcataccaaatcaacccggacgataccgctgtcaacgacagcataggctgggcgtattacctgaaangcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttacgggagacaagaaaatatggcgggaaacgctcaaacgtcacggcatcgcattgccccaaccttcccgaaaacctcggaaataa

SEQ ID NO: 44 - protein, 612 aa, Neisseria meningitidis
  misc_feature (73)..(73): Xaa= any amino acid
  misc_feature (160)..(160): Xaa= any amino acid
  misc_feature (167)..(167): Xaa= any amino acid
  misc_feature (218)..(218): Xaa= any amino acid
  misc_feature (320)..(320): Xaa= any amino acid
  misc_feature (389)..(389): Xaa= any amino acid
  misc_feature (537)..(537): Xaa= any amino acid
MLPARFTILSVLAAALLAGQAYAAGAADAKPPKEVGKVFRKQQRYSEEEIKNERARLAAVGERVNQIFTLLGXETALQKGQAGTALATYMLMLERTKSPEVAERALEMAVSLNAFEQAEMIYQKWRQIEPIPGKAQKRAGWLRNVLRERGNQHLDGLEEXLAQADEXQNRRVFLLLAQAAVQQDGLAQKASKAVRRAALRYEHLPEAAVADVVFSVQXREKEKAIGALQRLAKLDTEILPPTLMTLRLTARKYPEILDGFFEQTDTQNLSAVWQEMEIMNLVSLHRLDDAYARLNVLLERNPNADLYIQAAILAANRKEXASVIDGYAEKAYGRGTGEQRGRAAMTAAMIYADRRDYTKVRQWLKKVSAPEYLFDKGVLAAAAAVELDXGRAALRQIGRVRKLPEQQGRYFTADNLSKIQMFALSKLPDKREALRGLDKIIEKPPAGSNTELQAEALVQRSVVYDRLGKRKKMISDLERAFRLAPDNAQIMNNLGYSLLSDSKRLDEGFALLQTAYQINPDDTAVNDSIGWAYYLKXDAESALPYLRYSFENDPEPEVAAHLGEVLWALGERDQAVDVWTQAAHLTGDKKIWRETLKRHGIALPQPSRKPRK

SEQ ID NO: 45 - DNA, 8 bp, Neisseria gonorrhoeae
  misc_feature (1)..(8): N= Unknown
nnnnnnnn

SEQ ID NO: 46 - protein, 300 aa, Neisseria gonorrhoeae
MIMLPARFTILSVLAAALLAGQAYAAGAADVELPKEVGKVLRKHRRYSEEEIKNERARLAAVGERVNRVFTLLGGETALQKGQAGTALATYMLMLERTKSPEVAERALEMAVSLNAFEQAEMIYQKWRQIEPIPGEAQKPAGWLRNVLKEGGNPHLDRLEEVPAQSDYVHQPMIFLLLVQAAVQHGGVAQKPSKAVRPAAYNYEVLPETAGADAVFCVQGPQYEKAIQSFPPCGRNPQTENIAPPFNELFRPTARPISPKLLQRFFRTEPNLAKPFRPPGPEMETYQTGFPRPLTRNNPT

SEQ ID NO: 47 - DNA, 1839 bp, Neisseria gonorrhoeae
atgttacccgcccgtttcactattttatctgtcctcgcagcagccctgcttgccggacaggcgtatgctgccggcgcggcggatgtggagctgccgaaggaagtcggaaaggttttaaggaaacatcggcgttacagcgaggaagaaatcaaaaacgaacgcgcacggcttgcggcagtgggcgaacgggtcaacagggtgtttacgctgttgggcggtgaaacggctttgcagaaagggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagatcgagcctataccgggtgaggcgcaaaaaccggcggggtggctgcggaacgtattgaaggaagggggaaatcagcatctggacgggttgaaagaggtgctggcgcaatcggacgatgtgcaaaaacgcaggatatttttgctgctggtgcaagccgccgtgcagcagggtggggtggctcaaaaagcatcgaaagcggttcgccgtgcggcgttgaagtatgaacatctgcccgaagcggcggttgccgatgcggtgttcggcgtacagggacgcgaaaaggaaaaggcaatcgaagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcgtaagccggatgatgcctatgcgcgtttgaacgtgctgttggaacacaacccgaatgcaaacctgtatattcaggcggcgatattggcggcaaaccgaaaagaaggtgcgtccgttatcgacggctacgccgaaaaggcatacggcagggggacgggggaacagcggggcagggcggcaatgacggcggcgatgatatatgccgaccgcagggattacgccaaagtcaggcagtggttgaaaaaagtgtccgcgccggaatacctgttcgacaaaggcgtgctggcggctgcggcggctgccgaattggacggaggccgggcggctttgcggcagatcggcagggtgcggaaacttcccgaacagcaggggcggtattttacggcagacaatttgtccaaaatacagatgctcgccctgtcgaagctgcccgacaaacgggaagccctgatcgggctgaacaacatcatcgccaaactttcggcggcgggaagcacggaacctttggcggaagcattggcacagcgttccattatttacgaacagttcggcaaacggggaaaaatgattgccgaccttgaaaccgcgctcaaacttacgcccgataatgcacaaattatgaataatctgggctacagcctgctttccgattccaaacgtttggacgagggtttcgccctgcttcagacggcataccaaatcaacccggacgataccgccgttaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttaggggagacaagaaaatatggcgggagacgctcaaacgctacggaatcgccttgcccgagccttcccgaaaaccccggaaataa

SEQ ID NO: 48 - protein, 612 aa, Neisseria gonorrhoeae
MLPARFTILSVLAAALLAGQAYAAGAADVELPKEVGKVLRKHRRYSEEEIKNERARLAAVGERVNRVFTLLGGETALQKGQAGTALATYMLMLERTKSPEVAERALEMAVSLNAFEQAEMIYQKWRQIEPIPGEAQKPAGWLRNVLKEGGNQHLDGLKEVLAQSDDVQKRRIFLLLVQAAVQQGGVAQKASKAVRRAALKYEHLPEAAVADAVFGVQGREKEKAIEALQRLAKLDTEILPPTLMTLRLTARKYPEILDGFFEQTDTQNLSAVWQEMEIMNLVSLRKPDDAYARLNVLLEHNPNANLYIQAAILAANRKEGASVIDGYAEKAYGRGTGEQRGRAAMTAAMIYADRRDYAKVRQWLKKVSAPEYLFDKGVLAAAAAAELDGGRAALRQIGRVRKLPEQQGRYFTADNLSKIQMLALSKLPDKREALIGLNNIIAKLSAAGSTEPLAEALAQRSIIYEQFGKRGKMIADLETALKLTPDNAQIMNNLGYSLLSDSKRLDEGFALLQTAYQINPDDTAVNDSIGWAYYLKGDAESALPYLRYSFENDPEPEVAAHLGEVLWALGERDQAVDVWTQAAHLRGDKKIWRETLKRYGIALPEPSRKPRK

SEQ ID NO: 49 - DNA, 724 bp, Neisseria meningitidis
aacctctacgccggcccgcagaccacatccgtcatcgcaaacatcgccgacaacctgcaactggccaaagactacggcaaagtacactggttcgcctccccgctcttctggctcctgaaccaactgcacaacatcatcggcaactggggctgggcgattatcgttttaaccatcatcgtcaaagccgtactgtatccattgaccaacgcctcttaccgctctatggcgaaaatgcgtgccgccgcacccaaactgcaagccatcaaagagaaatacggcgacgaccgtatggcgcaacaacaggcgatgatgcagctttacacagacgagaaaatcaacccgactgggcggctgcctgcctatgctgttgcaaatccccgtcttcatcggattgtattgggcattgttcgcctccgtagaattgcgccaggcaccttggctgggttggattaccgacctcagccgcgccgacccctactacatcctgcccatcattatggcggcaacgatgttcgcccaaacttatctgaacccgccgccgaccgacccgatgcaggcgaaaatgatgaaaatcatgccgttggttttctcsgwcrtgttcttcttcttccctgccggkstggtattgtactgggtagtcaacaacctcctgaccatcgcccagcaatggcacatcaaccgcagcatcgaaaaacaacgcgcccaaggcgaagtcgtttcctaa

SEQ ID NO: 50 - protein, 240 aa, Neisseria meningitidis
  misc_feature (198)..(199): Xaa= any amino acid
  misc_feature (207)..(207): Xaa= any amino acid
NLYAGPQTTSVIANIADNLQLAKDYGKVHWFASPLFWLLNQLHNIIGNWGWAIIVLTIIVKAVLYPLTNASYRSMAKMRAAAPKLQAIKEKYGDDRMAQQQAMMQLYTDEKINPLGGCLPMLLQIPVFIGLYWALFASVELRQAPWLGWITDLSRADPYYILPIIMAATMFAQTYLNPPPTDPMQAKMMKIMPLVFSXXFFFFPAGXVLYWVVNNLLTIAQQWHINRSIEKQRAQGEVVS

SEQ ID NO: 51 - DNA, 1638 bp, Neisseria meningitidis
atggattttaaaagactcacggcgtttttcgccatcgcgctggtgattatgatcggctgggaaaagatgttccccactccgaagccagtccccgcgccccaacaggcagcacaacaacaggccgtaaccgcttccgccgaagccgcgctcgcgcccgcaacgccgattaccgtaacgaccgacacggttcaagccgtcattgatgaaaaaagcggcgacctgcgccggctgaccctgctcaaatacaaagcaaccggcgacgaaaataaaccgttcatcctgtttggcgacggcaaagaatacacctacgtcgcccaatccgaacttttggacgcgcagggcaacaacattctaaaaggcatcggctttagcgcaccgaaaaaacagtacagcttggaaggcgacaaagttgaagtccgcctgagcgcgcctgaaacacgcggtctgaaaatcgacaaagtttatactttcaccaaaggcagctatctggtcaacgtccgcttcgacatcgccaacggcagcggtcaaaccgccaacctgagcgcggactaccgcatcgtccgcgaccacagcgaacccgagggtcaaggttactttacccactcttacgtcggccctgttgtttatacccctgaaggcaacttccaaaaagtcagcttttccgacttggacgacgatgccaaatccggcaaatccgaggccgaatacatccgcaaaaccccgaccggctggctcggcatgattgaacaccacttcatgtccacctggattctccaacctaaaggcagacaaagcgtttgcgccgcaggcgagtgcaacatcgacatcaaacgccgcaacgacaagctgtacagcaccagcgtcagcgtgcctttagccgccatccaaaacggcgcgaaagccgaagcctccatcaacctctacgccggcccgcagaccacatccgtcatcgcaaacatcgccgacaacctgcaactggccaaagactacggcaaagtacactggttcgcctccccgctcttctggctcctgaaccaactgcacaacatcatcggcaactggggctgggcgattatcgttttaaccatcatcgtcaaagccgtactgtatccattgaccaacgcctcttaccgctctatggcgaaaatgcgtgccgccgcacccaaactgcaagccatcaaagagaaatacggcgacgaccgtatggcgcaacaacaggcgatgatgcagctttacacagacgagaaaatcaacccgctgggcggctgcctgcctatgctgttgcaaatccccgtcttcatcggattgtattgggcattgttcgcctccgtagaattgcgccaggcaccttggctgggttggattaccgacctcagccgcgccgacccctactacatcctgcccatcattatggcggcaacgatgttcgcccaaacttatctgaacccgccgccgaccgacccgatgcaggcgaaaatgatgaaaatcatgccgttggttttctccgtcatgttcttcttcttccctgccggtctggtattgtactgggtagtcaacaacctcctgaccatcgcccagcaatggcacatcaaccgcagcatcgaaaaacaacgcgcccaaggcgaagtcgtttcctaa

SEQ ID NO: 52 - protein, 545 aa, Neisseria meningitidis
MDFKRLTAFFAIALVIMIGWEKMFPTPKPVPAPQQAAQQQAVTASAEAALAPATPITVTTDTVQAVIDEKSGDLRRLTLLKYKATGDENKPFILFGDGKEYTYVAQSELLDAQGNNILKGIGFSAPKKQYSLEGDKVEVRLSAPETRGLKIDKVYTFTKGSYLVNVRFDIANGSGQTANLSADYRIVRDHSEPEGQGYFTHSYVGPVVYTPEGNFQKVSFSDLDDDAKSGKSEAEYIRKTPTGWLGMIEHHFMSTWILQPKGRQSVCAAGECNIDIKRRNDKLYSTSVSVPLAAIQNGAKAEASINLYAGPQTTSVIANIADNLQLAKDYGKVHWFASPLFWLLNQLHNIIGNWGWAIIVLTIIVKAVLYPLTNASYRSMAKMRAAAPKLQAIKEKYGDDRMAQQQAMMQLYTDEKINPLGGCLPMLLQIPVFIGLYWALFASVELRQAPWLGWITDLSRADPYYILPIIMAATMFAQTYLNPPPTDPMQAKMMKIMPLVFSVMFFFFPAGLVLYWVVNNLLTIAQQWHINRSIEKQRAQGEVVS

SEQ ID NO: 53 - DNA, 1638 bp, Neisseria meningitidis
  misc_feature (2)..(2): N= Unknown
  misc_feature (21)..(21): N= Unknown
  misc_feature (23)..(23): N= Unknown
  misc_feature (59)..(59): N= Unknown
  misc_feature (61)..(61): N= Unknown
  misc_feature (65)..(65): N= Unknown
  misc_feature (128)..(128): N= Unknown
  misc_feature (158)..(158): N= Unknown
  misc_feature (160)..(160): N= Unknown
  misc_feature (262)..(262): N= Unknown
  misc_feature (298)..(298): N= Unknown
  misc_feature (310)..(310): N= Unknown
  misc_feature (318)..(318): N= Unknown
  misc_feature (684)..(684): N= Unknown
  misc_feature (690)..(690): N= Unknown
  misc_feature (722)..(722): N= Unknown
  misc_feature (817)..(817): N= Unknown
  misc_feature (822)..(822): N= Unknown
  misc_feature (904)..(904): N= Unknown
  misc_feature (945)..(945): N= Unknown
  misc_feature (980)..(980): N= Unknown
  misc_feature (1389)..(1389): N= Unknown
  misc_feature (1501)..(1501): N= Unknown
  misc_feature (1503)..(1503): N= Unknown
  misc_feature (1506)..(1511): N= Unknown
  misc_feature (1519)..(1520): N= Unknown
anggattttaaaagactcacngngtttttcgccatcgcactggtgattatgatcggatngnaaangatgttccccactccgaagcccgtccccgcgccccaacagacggcacaacaacaggccgtaancgcttccgccgaagccgcgctcgcgcccgnancgccgattaccgtaacgaccgacacggttcaagccgtcattgatgaaaaaagcggcgacctgcgccggctgaccctgctcaaatacaaagcaaccggcgacnaaaataaaccgttcatcctgtttggcgacggcaaanaatacacctacntcgcccantccgaacttttggacgcgcagggcaacaacattctaaaaggcatcggctttagcgcaccgaaaaaacagtacagcttggaaggcgacaaagttgaagtccgcctgagcgcacctgaaacacgcggtctgaaaatcgacaaagtttatactttcaccaaaggcagctatctggtcaacgtccgcttcgacatcgccaacggcagcggtcaaaccgccaacctgagcgcggactaccgcatcgtccgcgaccacagcgaacccgagggtcaaggctactttacccactcttacgtcggccctgttgtttatacccctgaaggcaacttccaaaaagtcagcttctccgacttggacgacgatgccaantccggnaaatccgaggccgaatacatccgcaaaacccngaccggctggctcggcatgattgaacaccacttcatgtccacctggatcctccaacccaaaggcggacaaagcgtttgcgccgctggcgactgcngtatngacatcaaacgccgcaacgacaagctgtacagcaccagcgtcagcgtgcctttagccgctatccaaaacggtgcgaaatccnaagcctccatcaacctctacgccggcccacagaccacatcngttatcgcaaacatcgccgacaacctgcaactggncaaagactacggcaaagtacactggttcgcctcccccctcttttggcttttgaaccaactgcacaacatcatcggcaactggggctgggcgattatcgttttaaccatcatcgtcaaagccgtactgtatccattgaccaacgcctcttaccgttcgatggcgaaaatgcgtgccgccgcgcccaaactgcaagccatcaaagagaaatacggcgacgaccgtatggcgcagcaacaagccatgatgcagctttacacagacgagaaaatcaacccgctgggcggctgcctgcctatgctgttgcaaatccccgtcttcatcggattgtattgggcattgttcgcctccgtagaattgcgccaggcaccttggctgggttggattaccgacctcagccgcgccgacccntactacatcctgcccatcattatggcggcaacgatgttcgcccaaacctatctgaacccgccgccgaccgacccgatgcaggcgaaaatgatgaaaatcatgcctttggttntntcnnnnangttcttcnncttccctgccggtctggtattgtactgggtgatcaacaacctcctgaccatcgcccagcaatggcacatcaaccgcagcatcgaaaaacaacgcgcccaaggcgaagtcgtttcctaa

SEQ ID NO: 54 - protein, 545 aa, Neisseria meningitidis
  misc_feature (1)..(1): Xaa= any amino acid
  misc_feature (8)..(8): Xaa= any amino acid
  misc_feature (20)..(22): Xaa= any amino acid
  misc_feature (43)..(43): Xaa= any amino acid
  misc_feature (53)..(54): Xaa= any amino acid
  misc_feature (88)..(88): Xaa= any amino acid
  misc_feature (100)..(100): Xaa= any amino acid
  misc_feature (104)..(104): Xaa= any amino acid
  misc_feature (106)..(106): Xaa= any amino acid
  misc_feature (228)..(228): Xaa= any amino acid
  misc_feature (241)..(241): Xaa= any amino acid
  misc_feature (273)..(274): Xaa= any amino acid
  misc_feature (302)..(302): Xaa= any amino acid
  misc_feature (327)..(327): Xaa= any amino acid
  misc_feature (501)..(501): Xaa= any amino acid
  misc_feature (503)..(504): Xaa= any amino acid
  misc_feature (507)..(507): Xaa= any amino acid
XDFKRLTXFFAIALVIMIGXXXMFPTPKPVPAPQQTAQQQAVXASAEAALAPXXPITVTTDTVQAVIDEKSGDLRRLTLLKYKATGDXNKPFILFGDGKXYTYXAXSELLDAQGNNILKGIGFSAPKKQYSLEGDKVEVRLSAPETRGLKIDKVYTFTKGSYLVNVRFDIANGSGQTANLSADYRIVRDHSEPEGQGYFTHSYVGPVVYTPEGNFQKVSFSDLDDDAXSGKSEAEYIRKTXTGWLGMIEHHFMSTWILQPKGGQSVCAAGDCXXDIKRRNDKLYSTSVSVPLAAIQNGAKSXASINLYAGPQTTSVIANIADNLQLXKDYGKVHWFASPLFWLLNQLHNIIGNWGWAIIVLTIIVKAVLYPLTNASYRSMAKMRAAAPKLQAIKEKYGDDRMAQQQAMMQLYTDEKINPLGGCLPMLLQIPVFIGLYWALFASVELRQAPWLGWITDLSRADPYYILPIIMAATMFAQTYLNPPPTDPMQAKMMKIMPLVXSXXFFXFPAGLVLYWVINNLLTIAQQWHINRSIEKQRAQGEVVS

SEQ ID NO: 55 - DNA, 8 bp, Neisseria gonorrhoeae
  misc_feature (1)..(8): N= Unknown
nnnnnnnn

SEQ ID NO: 56 - protein, 243 aa, Neisseria gonorrhoeae
MAVNLYAGPQTTSVIANIADNLQLAKDYGKVHWFASPLFWLLNQLHNIIGNWGWAIVVLTIIVKAVLYPLTNASYRSMAKMRAAAPELQTIKEKYGDDRMAQQQAMMQLFEDEEINPLGGCLPMLLQIPVFIGLYWALFASVELRQAPWLGWITDLSRADPYYILPIIMAATMFAQTYLNPPPTDPMQAKMMKIMPLVFSVMFFFFPAGLVLYWVVNNLLTIAQQWHINRSIEKQRAQGEVVS

SEQ ID NO: 57 - DNA, 1641 bp, Neisseria gonorrhoeae
atggattttaaaagactcacggcgtttttcgccatcgcgctggtgattatgatcggctgggaaaaaatgttccccaccccgaaacccgtccccgcgccccaacaggcggcacaaaaacaggcagcaaccgcttccgccgaagccgcgctcgcgcccgcaacgccgattaccgtaacgaccgacacggttcaagccgttattgatgaaaaaagtggcgacctgcgccggctgaccctgctcaaatacaaagcaaccggcgacgaaaacaaaccgttcgtcctgtttggcgacggcaaagaatacacctacgtcgcccaatccgaacttttggacgcgcagggcaacaacattctgaaaggcatcggctttagcgcaccgaaaaaacagtacaccctcaacggcgacacagtcgaagtccgcctgagcgcgcccgaaaccaacggactgaaaatcgacaaagtctatacctttaccaaagacagctatctggtcaacgtccgcttcgacatcgccaacggcagcggtcaaaccgccaacctgagcgcggactaccgcatcgtccgcgaccacagcgaacccgagggtcaaggctactttacccactcttacgtcggccctgttgtttatacccctgaaggcaacttccaaaaagtcagcttctccgacttggacgacgatgcgaaatccggcaaatccgaggccgaatacatccgcaaaaccccgaccggttggctcggcatgattgaacaccacttcatgtccacctggatcctccaacctaaaggcggccaaaacgtttgcgcccagggagactgccgtatcgacattaaacgccgcaacgacaagctgtacagcgcaagcgtcagcgtgcctttaaccgctatcccaacccgggggccaaaaccgaaaatggcggtcaacctgtatgccggtccgcaaaccacatccgttatcgcaaacatcgccgacaacctgcaactggcaaaagactacggtaaagtacactggttcgcatcgccgctcttctggctcctgaaccaactgcacaacattatcggcaactggggctgggcaatcgtcgttttgaccatcatcgtcaaagccgtactgtatccattgaccaacgcctcctaccgttcgatggcgaaaatgcgtgccgccgcacccaaactgcagaccatcaaagaaaaatacggcgacgaccgtatggcgcaacagcaagcgatgatgcagctttacaaagacgagaaaatcaacccgctgggcggctgtctgcctatgctgttgcaaatccccgtcttcatcggcttgtactgggcattgttcgcctccgtagaattgcgccaggcaccttggctgggctggattaccgacctcagccgcgccgacccctactacatcctgcccatcattatggcggcaacgatgttcgcccaaacctatctgaacccgccgccgaccgacccgatgcaggcgaaaatgatgaaaatcatgccgttggttttctccgtcatgttcttcttcttccctgccggtttggttctctactgggtggtcaacaacctcctgaccatcgcccagcagtggcacatcaaccgcagcatcgaaaaacaacgcgcccaaggcgaagtcgtttcctaa

SEQ ID NO: 58 - protein, 546 aa, Neisseria gonorrhoeae
MDFKRLTAFFAIALVIMIGWEKMFPTPKPVPAPQQAAQKQAATASAEAALAPATPITVTTDTVQAVIDEKSGDLRRLTLLKYKATGDENKPFVLFGDGKEYTYVAQSELLDAQGNNILKGIGFSAPKKQYTLNGDTVEVRLSAPETNGLKIDKVYTFTKDSYLVNVRFDIANGSGQTANLSADYRIVRDHSEPEGQGYFTHSYVGPVVYTPEGNFQKVSFSDLDDDAKSGKSEAEYIRKTPTGWLGMIEHHFMSTWILQPKGGQNVCAQGDCRIDIKRRNDKLYSASVSVPLTAIPTRGPKPKMAVNLYAGPQTTSVIANIADNLQLAKDYGKVHWFASPLFWLLNQLHNIIGNWGWAIVVLTIIVKAVLYPLTNASYRSMAKMRAAAPKLQTIKEKYGDDRMAQQQAMMQLYKDEKINPLGGCLPMLLQIPVFIGLYWALFASVELRQAPWLGWITDLSRADPYYILPIIMAATMFAQTYLNPPPTDPMQAKMMKIMPLVFSVMFFFFPAGLVLYWVVNNLLTIAQQWHINRSIEKQRAQGEVVS

SEQ ID NO: 59 - DNA, 379 bp, Neisseria meningitidis
  misc_feature (51)..(51): N= Unknown
  misc_feature (122)..(122): N= Unknown
  misc_feature (149)..(149): N= Unknown
  misc_feature (237)..(237): N= Unknown
gccgtcttaatcatcgaattattgacgggaacggtttatcttttggttgtnagcgcggctttggcgggttcgggcattgcttacgggctgaccggcagtacgcctgccgccgtcttgaccgncgctctgctttccgcgctgggtatttngttcgtacacgccaaaaccgccgttagaaaagttgaaacggattcatatcaggatttggatgccggacaatatgtcgaaatcctccgncacacaggcggcaaccgttacgaagtttttatcgcggtacgactggcaggctcaaaatacggggcaagaagagcttgaaccaggaactcgcgccctcattgtccgcaaggaaggcaaccttcttattatcacacacccttaa

SEQ ID NO: 60 - protein, 126 aa, Neisseria meningitidis
  misc_feature (41)..(41): Xaa= any amino acid
  misc_feature (50)..(50): Xaa= any amino acid
  misc_feature (89)..(89): Xaa= any amino acid
  misc_feature (94)..(94): Xaa= any amino acid
AVLIIELLTGTVYLLVVSAALAGSGIAYGLTGSTPAAVLTXALLSALGIXFVHAKTAVRKVETDSYQDLDAGQYVEILRHTGGNRYEVXYRGTXWQAQNTGQEELEPGTRALIVRKEGNLLIITHP

SEQ ID NO: 61 - DNA, 381 bp, Neisseria meningitidis
  misc_feature (51)..(51): N= Unknown
  misc_feature (122)..(122): N= Unknown
  misc_feature (149)..(149): N= Unknown
gccgtcttaatcatcgaattattgacgggaacggtttatcttttggttgtnagcgcggctttggcgggttcgggcattgcttacgggctgaccggcagtacgcctgccgccgtcttgaccgncgctctgctttccgcgctgggtatttngttcgtacacgccaaaaccgccgttagaaaagttgaaacggattcatatcaggatttggatgccggacaatatgtcgaaatcctccgacacacaggcggcaaccgttacgaagttttttatcgcggtacgcactggcaggctcaaaatacggggcaagaagagcttgaaccaggaactcgcgccctcattgtccgcaaggaaggcaaccttcttattatcacacacccttaa

SEQ ID NO: 62 - protein, 126 aa, Neisseria meningitidis
  misc_feature (41)..(41): Xaa= any amino acid
  misc_feature (50)..(50): Xaa= any amino acid
AVLIIELLTGTVYLLVVSAALAGSGIAYGLTGSTPAAVLTXALLSALGIXFVHAKTAVRKVETDSYQDLDAGQYVEILRHTGGNRYEVFYRGTHWQAQNTGQEELEPGTRALIVRKEGNLLIITHP

SEQ ID NO: 63 - DNA, 408 bp, Neisseria meningitidis
atgactgtatggtttgttgccgctgttgccgtcttaatcatcgaattattgacgggaacggtttatcttttggttgtcagcgcggctttggcgggttcgggcattgcttacgggctgaccggcagcacgcctgccgccgtcttgaccgccgctctgctttccgcgctgggtatttggttcgtacacgccaaaaccgccgtgggaaaagttgaaacggattcatatcaggatttggatgccgggcaatatgccgaaatcctccggcacgcaggcggcaaccgttacgaagttttttatcgcggtacgcactggcaggctcaaaatacggggcaagaagagcttgaaccaggaacgcgcgccctaatcgtccgcaaggaaggcaaccttcttatcatcgcaaaaccttaa

SEQ ID NO: 64 - protein, 135 aa, Neisseria meningitidis
MTVWFVAAVAVLIIELLTGTVYLLVVSAALAGSGIAYGLTGSTPAAVLTAALLSALGIWFVHAKTAVGKVETDSYQDLDAGQYAEILRHAGGNRYEVFYRGTHWQAQNTGQEELEPGTRALIVRKEGNLLIIAKP

SEQ ID NO: 65 - DNA, 408 bp, Neisseria gonorrhoeae
atgactgtatggtttgttgccgctgttgccgtcttaatcatcgaattattgacgggaacggtttatcttttggttgtcagcgcggctttggcgggttcgggcattgcctacgggctgactggcagcacgcctgccgccgtcttgaccgccgcactgctttccgcgctgggcatttggttcgtacatgccaaaaccgccgtgggaaaagttgaaacggattcatatcaggatttggataccggaaaatatgccgaaatcctccgatacacaggcggcaaccgttacgaagttttttatcgcggtacgcactggcaggcgcaaaatacggggcaggaagtgtttgaaccgggaacgcgcgccctcatcgtccgcaaagaaggtaaccttcttatcatcgcaaacccttaa

SEQ ID NO: 66 - protein, 135 aa, Neisseria gonorrhoeae
MTVWFVAAVAVLIIELLTGTVYLLVVSAALAGSGIAYGLTGSTPAAVLTAALLSALGIWFVHAKTAVGKVETDSYQDLDTGKYAEILRYTGGNRYEVFYRGTHWQAQNTGQEVFEPGTRALIVRKEGNLLIIANP

SEQ ID NO: 67 - DNA, 407 bp, Neisseria meningitidis
atgtwtgatttcggtttrggcgarctggtttttgtcggcattatcgccctgatwgtcctcggccccgaacgcstgcccgaggccgcccgcaycgccggacggctcatcggcaggctgcaacgctttgtcggcagcgtcaaacaggaatttgacactcaaatcgaactggaagaactgaggaaggcaaagcaggaatttgaagctgccgccgctcaggttcgagacagcctcaaagaaaccggtacggatatggaaggcaatctgcacgacatttccgacggtctgaagccttgggaaaaactgcccgaacagcggacacctgccgatttcggtgtcgatgaaaacggcaatccgcttcccgatgcggcaaacaccctatcagacggcatttccgacgttatgccgtc

SEQ ID NO: 68 - protein, 136 aa, Neisseria meningitidis
  misc_feature (2)..(2): Xaa= any amino acid
  misc_feature (25)..(25): Xaa= any amino acid
  misc_feature (31)..(31): Xaa= any amino acid
  misc_feature (119)..(119): Xaa= any amino acid
MXDFGLGELVFVGIIALIVLGPERXPEAARXAGRLIGRLQRFVGSVKQEFDTQIELEELRKAKQEFEAAAAQVRDSLKETGTDMEGNLHDISDGLKPWEKLPEQRTPADFGVDENGNPXSRCGKHPIRRHFRRYAV

SEQ ID NO: 69 - DNA, 687 bp, Neisseria meningitidis
atgtttgatttcggtttgggcgagctggtttttgtcggcattatcgccctgattgtcctcggccccgaacgcctgcccgaggccgcccgcaccgccggacggctcatcggcaggctgcaacgctttgtcggcagcgtcaaacaggaatttgacactcaaatcgaactggaagaactgaggaaggcaaagcaggaatttgaagctgccgccgctcaggttcgagacagcctcaaagaaaccggtacggatatggaaggcaatctgcacgacatttccgacggtctgaagccttgggaaaaactgcccgaacagcggacacctgccgatttcggtgtcgatgaaaacggcaatccgcttcccgatgcggcaaacaccctatcagacggcatttccgacgttatgccgtccgaacgttcctacgcttccgccgaaacccttggggacagcgggcaaaccggcagtacagccgaacccgcggaaaccgaccaagaccgcgcatggcgggaatacctgactgcttctgccgccgcacccgtcgtacagaccgtcgaagtcagctatatcgatactgctgttgaaacgcctgttccgcacaccacttccctgcgcaaacaggcaataagccgcaaacgcgattttcgtccgaaacaccgcgccaaacctaaattgcgcgtccgtaaatcataa

SEQ ID NO: 70 - protein, 228 aa, Neisseria meningitidis
MFDFGLGELVFVGIIALIVLGPERLPEAARTAGRLIGRLQRFVGSVKQEFDTQIELEELRKAKQEFEAAAAQVRDSLKETGTDMEGNLHDISDGLKPWEKLPEQRTPADFGVDENGNPLPDAANTLSDGISDVMPSERSYASAETLGDSGQTGSTAEPAETDQDRAWREYLTASAAAPVVQTVEVSYIDTAVETPVPHTTSLRKQAISRKRDFRPKHRAKPKLRVRKS

SEQ ID NO: 71 - DNA, 687 bp, Neisseria meningitidis
atgtttgatttcggtttgggcgagctggtttttgtcggcattatcgccctgattgtcctcggccccgaacgcctgcccgaggccgcccgcaccgccggacggctcatcggcaggctgcaacgctttgtcggcagcgtcaaacaggaatttgacacgcaaatcgaactggaagaactaaggaaggcaaagcaggaatttgaagctgccgctgctcaggttcgagacagcctcaaagaaaccggtacggatatggagggtaatctgcacgacatttccgacggtctgaagccttgggaaaaactgcccgaacagcgcacgcctgctgatttcggtgtcgatgaaaacggcaatccctttcccgatgcggcaaacaccctattagacggcatttccgacgttatgccgtccgaacgttcctacgcttccgccgaaacccttggggacagcgggcaaaccggcagtacagccgaacccgcggaaaccgaccaagaccgtgcatggcgggaatacctgactgcttctgccgccgcacccgtcgtacagaccgtcgaagtcagctatatcgataccgctgttgaaacccctgttccgcataccacttcgctgcgtaaacaggcaataagccgcaaacgcgatttgcgtcctaaatcccgcgccaaacctaaattgcgcgtccgtaaatcataa

SEQ ID NO: 72 - protein, 228 aa, Neisseria meningitidis
MFDFGLGELVFVGIIALIVLGPERLPEAARTAGRLIGRLQRFVGSVKQEFDTQIELEELRKAKQEFEAAAAQVRDSLKETGTDMEGNLHDISDGLKPWEKLPEQRTPADFGVDENGNPFPDAANTLLDGISDVMPSERSYASAETLGDSGQTGSTAEPAETDQDRAWREYLTASAAAPVVQTVEVSYIDTAVETPVPHTTSLRKQAISRKRDLRPKSRAKPKLRVRKS

SEQ ID NO: 73 - DNA, 8 bp, Neisseria gonorrhoeae
  misc_feature (1)..(8): N= Unknown
nnnnnnnn

SEQ ID NO: 74 - protein, 136 aa, Neisseria gonorrhoeae
MFDFGLGELIFVGIIALIVLGPERLPEAARTAGRLIGRLQRFVGSVKQELDTQIELEELRKVKQAFEAAAAQVRDSLKETDTDMQNSLHDISDGLKPWEKLPEQRTPADFGVDEKGNSLSRYGKHRIRRHFRRYAV

SEQ ID NO: 75 - DNA, 690 bp, Neisseria gonorrhoeae
atgtttgatttcggtttgggcgagctgatttttgtcggcattatcgccctgattgtccttggtccagaacgcctgcccgaagccgcccgcactgccggacggcttatcggcaggctgcaacgctttgtaggaagcgtcaaacaagaacttgacactcaaatcgaactggaagagctgaggaaggtcaagcaggcattcgaagctgccgccgctcaggttcgagacagcctcaaagaaaccgatacggatatgcagaacagtctgcacgacatttccgacggtctgaagccttgggaaaaactgcccgaacagcgcacgcctgccgatttcggtgtcgatgaaaacggcaatccccttcccgatacggcaaacaccgtatcagacggcatttccgacgttatgccgtctgaacgttccgatacttccgccgaaacccttggggacgacaggcaaaccggcagtacagccgaacctgcggaaaccgacaaagaccgcgcatggcgggaatacctgactgcttctgccgccgcacctgtcgtacagagggccgtcgaagtcagctatatcgatactgctgttgaaacgcctgttccgcacaccacttccctgcgcaaacaggcaataaaccgcaaacgcgatttttgtccgaaacaccgcgccaaaccgaaattgcgcgtccgtaaatcataa

SEQ ID NO: 76 - protein, 229 aa, Neisseria gonorrhoeae
MFDFGLGELIFVGIIALIVLGPERLPEAARTAGRLIGRLQRFVGSVKQELDTQIELEELRKVKQAFEAAAAQVRDSLKETDTDMQNSLHDISDGLKPWEKLPEQRTPADFGVDENGNPLPDTANTVSDGISDVMPSERSDTSAETLGDDRQTGSTAEPAETDKDRAWREYLTASAAAPVVQRAVEVSYIDTAVETPVPHTTSLRKQAINRKRDFCPKHRAKPKLRVRKS

SEQ ID NO: 77 - DNA, 639 bp, Neisseria meningitidis
atgcaagcacggctgctgatacctattcttttttcagtttttattttatccgctgcgggacactgacaggtattccatcgcatggcggagktaaacgctttgcggtcgaacaagaacttgtggccgcttctgccagagctgccgttaaagacatggatttacaggcattacacggacgaaaagttgcattgtacattgccactatgggcgaccaaggttcaggcagtttgacaggggggtcgctactccattgatgcackgrtwcstggcgaatacataaacagccctgccgtccgtaccgattacacctatccacgttacgaaaccaccgctgaaacaacatcaggcggtttgacaggtttaaccacttctttatctacacttaatgcccctgcactctctcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacagatgtgtttattaacatcgacgtattcggaacgatacgcaacagaaccgaaatg

SEQ ID NO: 78 - protein, 213 aa, Neisseria meningitidis
  misc_feature (31)..(31): Xaa= any amino acid
  misc_feature (87)..(89): Xaa= any amino acid
MQARLLIPILFSVFILSACGTLTGIPSHGGXKRFAVEQELVAASARAAVKDMDLQALHGRKVALYIATMGDQGSGSLTGGRYSIDAXXXGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEM

SEQ ID NO: 79 - DNA, 963 bp, Neisseria meningitidis
atgcaagcacggctgctgatacctattcttttttcagtttttattttatccgcctgcgggacactgacaggtattccatcgcatggcggaggtaaacgctttgcggtcgaacaagaacttgtggccgcttctgccagagctgccgttaaagacatggatttacaggcattacacggacgaaaagttgcattgtacattgccactatgggcgaccaaggttcaggcagtttgacagggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctctcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatggggccgtataaagtaagcaaaggaattaaaccgacggaaggattaatggtcgatttctccgatatccgaccatacggcaatcatacgggtaactccgccccatccgtagaggctgataacagtcatgaggggtatggatacagcgatgaagtagtgcgacaacatagacaaggacaaccttga

SEQ ID NO: 80 - protein, 320 aa, Neisseria meningitidis
MQARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIRPYGNHTGNSAPSVEADNSHEGYGYSDEVVRQHRQGQP

SEQ ID NO: 81 - DNA, 963 bp, Neisseria meningitidis
atgcaagcacggctgctgatacctattcttttttcagtttttattttatccgcctgcgggacactgacaggtattccatcgcatggcggaggtaaacgctttgcggtcgaacaagaacttgtggccgcttctgccagagctgccgttaaagacatggatttacaggcattacacggacgaaaagttgcattgtacattgcaactatgggcgaccaaggttcaggcagtttgacagggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctcgcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacggatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatgggaccgtataaagtaagcaaaggaattaaaccgacagaaggattaatggtcgatttctccgatatccaaccatacggcaatcatatgggtaactctgccccatccgtagaggctgataacagtcatgaggggtatggatacagcgatgaagcagtgcgacgacatagacaagggcaaccttga

SEQ ID NO: 82 - protein, 320 aa, Neisseria meningitidis
MQARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIQPYGNHMGNSAPSVEADNSHEGYGYSDEAVRRHRQGQP

SEQ ID NO: 83 - DNA, 963 bp, Neisseria gonorrhoeae
atgcgggcacggctgctgatacctattcttttttcagtttttattttatccgcctgcgggacactgacaggtattccatcgcatggcggaggcaaacgcttcgcggtcgaacaagaacttgtggccgcttctgccagagctgccgttaaagacatggatttacaggcattacacggacgaaaagttgcattgtacattgcaactatgggcgaccaaggttcaggcagtttgacagggggtcgctactccattgatgcactgattcgcggcgaatacataaacagccctgccgtccgcaccgattacacctatccgcgttacgaaaccaccgctgaaacaacatcaggcggtttgacgggtttaaccacttctttatctacacttaatgcccctgcactctcgcgcacccaatcagacggtagcggaagtaggagcagtctgggcttaaatattggcgggatgggggattatcgaaatgaaaccttgacgaccaacccgcgcgacactgcctttctttcccacttggtgcagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaacccaaaaccaatgcgtttgaagctgcctataaagaaaattacgcattgtggatggggccgtataaagtaagcaaaggaatcaaaccgacggaaggattgatggtcgatttctccgatatccaaccatacggcaatcatacgggtaactccgccccatccgtagaggctgataacagtcatgaggggtatggatacagcgatgaagcagtgcgacaacatagacaagggcaaccttga

SEQ ID NO: 84 - protein, 320 aa, Neisseria gonorrhoeae
MRARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSRSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIQPYGNHTGNSAPSVEADNSHEGYGYSDEAVRQHRQGQP

SEQ ID NO: 85 - DNA, 590 bp, Neisseria meningitidis
ggcagcacaaaaaacaggcggttgaacggaaaaaccgtatttacgatgatgccgggtatgatattcggcgtattcacgggcgcattctccgcaaaatatatccccgcgttcgggcttcaaattttcttcatcctgtttttaaccgccgtcgcattcaaaacactgcataccgaccctcagacggcatcccgcccgctgcccggactgcccrgactgactgcggtttccacactgttcggcacaatgtcgagctgggtcggcataggcggcggttcactttccgtccccttcttaatccactgcggcttccccgcccataaagccatcggcacatcatccggccttgcctggccgattgcactctccggcgcaatatcgtatctgctcaacggcctgaatattgcaggattgcccgaagggtcactgggcttcctttacctgcccgccgtcgccgtcctcagcgcggcaaccattgcctttgccccgctcggtgtcaaaaccgcccacaaactttcttctgccaaactcaaaaaatcttcggcattatgttgcttttgattgccggaaaaatgctgtacaacctgctttaa

SEQ ID NO: 86 - protein, 196 aa, Neisseria meningitidis
  misc_feature (71)..(71): Xaa= any amino acid
GQHKKQAVNGKTVFTMMPGMIFGVFTGAFSAKYIPAFGLQIFFILFLTAVAFKTLHTDPQTASRPLPGLPXLTAVSTLFGTMSSWVGIGGGSLSVPFLIHCGFPAHKAIGTSSGLAWPIALSGAISYLLNGLNIAGLPEGSLGFLYLPAVAVLSAATIAFAPLGVKTAHKLSSAKLKKSFGIMLLLIAGKMLYNLL

SEQ ID NO: 87 - DNA, 806 bp, Neisseria meningitidis
atgtggcattgggacattatcttaatcctgcttgccgtaggcagtgcggcaggttttattgccggcctgttcggcgtaggcggcggcacgctgattgtccctgtcgttttatgggtgcttgatttgcagggtttggcacaacatccttacgcgcaacacctcgccgtcggcacatccttcgccgtcatggtcttcaccgccttttccagtatgctggggcagcacaaaaaacaggcggtcgactggaaaaccgtatttacgatgatgccgggtatgatattcggcgtattcacgggcgcactctccgcaaaatatatccccgcgttcgggcttcaaattttcttcatcctgtttttaaccgccgtcgcattcaaaacactgcataccgaccctcagacggcatcccgcccgctgcccggactgcccggactgactgcggtttccacactgttcggcacaatgtcgagctgggtcggcataggcggcggttcactttccgtccccttcttaatccactgcggcttccccgcccataaagccatcggcacatcatccggccttgcctggccgattgcactctccggcgcaatatcgtatctgctcaacggcctgaatattgcaggattgcccgaagggtcactgggcttcctttacctgcccgccgtcgccgtcctcagcgcggcaaccattgcctttgccccgctcggtgtcaaaaccgcccacaaactttcttctgccaaactcaaaaaatcttcggcattatgttgcttttgattgccggaaaaatgctgtacaacctgctttaa

SEQ ID NO: 88 - protein, 268 aa, Neisseria meningitidis
  misc_feature (251)..(251): Xaa= any amino acid
MWHWDIILILLAVGSAAGFIAGLFGVGGGTLIVPVVLWVLDLQGLAQHPYAQHLAVGTSFAVMVFTAFSSMLGQHKKQAVDWKTVFTMMPGMIFGVFTGALSAKYIPAFGLQIFFILFLTAVAFKTLHTDPQTASRPLPGLPGLTAVSTLFGTMSSWVGIGGGSLSVPFLIHCGFPAHKAIGTSSGLAWPIALSGAISYLLNGLNIAGLPEGSLGFLYLPAVAVLSAATIAFAPLGVKTAHKLSSAKLKKXFGIMLLLIAGKMLYNLL

SEQ ID NO: 89 - DNA, 807 bp, Neisseria meningitidis
atgtggcattgggacattatcttaatcctgcttgccgtaggcagtgcggcaggttttattgccggcctgttcggcgtaggcggcggcacgctgattgtccctgtcgttttatgggtgcttgatttgcagggtttggcacaacatccttacgcgcaacacctcgccgtcggcacatccttcgccgtcatggtcttcaccgccttttccagtatgctggggcagcacaaaaaacaggcggtcgactggaaaaccgtatttacgatgatgccgggtatggtattcggcgtattcgctggcgcactctccgcaaaatatatcccagcgttcgggcttcaaattttcttcatcctgtttttaaccgccgtcgcattcaaaacactgcataccgaccctcagacggcatcccgcccgctgcccggactgcccggactgactgcggtttccacactgttcggcacaatgtcgagctgggtcggcataggcggcggttcactttccgtccccttcttaatccactgcggcttccccgcccataaagccatcggcacatcatccggccttgcctggccgattgcactctccggcgcaatatcgtatctgctcaacggcctgaatattgcaggattgcccgaagggtcactgggcttcctttacctgcccgccgtcgccgtcctcagcgcggcaaccattgcctttgccccgctcggtgtcaaaaccgcccacaaactttcttctgccaaactcaaaaaatccttcggcattatgttgcttttgattgccggaaaaatgctgtacaacctgctttaa

SEQ ID NO: 90 - protein, 268 aa, Neisseria meningitidis
MWHWDIILILLAVGSAAGFIAGLFGVGGGTLIVPVVLWVLDLQGLAQHPYAQHLAVGTSFAVMVFTAFSSMLGQHKKQAVDWKTVFTMMPGMVFGVFAGALSAKYIPAFGLQIFFILFLTAVAFKTLHTDPQTASRPLPGLPGLTAVSTLFGTMSSWVGIGGGSLSVPFLIHCGFPAHKAIGTSSGLAWPIALSGAISYLLNGLNIAGLPEGSLGFLYLPAVAVLSAATIAFAPLGVKTAHKLSSAKLKKSFGIMLLLIAGKMLYNLL

SEQ ID NO: 91 - DNA, 8 bp, Neisseria gonorrhoeae
  misc_feature (1)..(8): N= Unknown
nnnnnnnn

SEQ ID NO: 92 - protein, 268 aa, Neisseria gonorrhoeae
MWHWDIILILLAVGSAAGFIAGLFGVGGGTLIVPVVLWVLDLQGLAQHPYAQHLAVGTSFAVMVFTAFSSMLGQHKKQAVDWKTIFAMMPGMIFGVFAGALSAKYIPAFGLQIFFILFLTAVAFKTLHTGRQTASRPLPGLPGLTAVSTLFGAMSSWVGIGGGSLSVPFLIHCGFPAHKAIGTSSGLAWPIALSGAISYLVNGLNIAGLPEGSLGFLYLPAVAVLSAATIAFAPLGVKTAHKLSSAKLKESFGIMLLLIAGKMLYNLL

SEQ ID NO: 93 - DNA, 807 bp, Neisseria gonorrhoeae
atgtggcattgggacattatcttaatcctgcttgccgtaggcagtgcggcaggttttattgccggcctgttcggtgtaggcggcggtacgctgattgtccctgtcgttttatgggtgcttgatttgcagggtttggcacaacatccttacgcgcaacacctcgccgtcggcacatccttcgccgtcatggtcttcaccgccttttccagtatgttggggcagcacaaaaaacaggcggtcgactggaaaaccatatttgcgatgatgccgggtatgatattcggcgtattcgctggcgcactctccgcaaaatatatccccgcgttcgggcttcaaattttcttcatcctgtttttaaccgccgtcgcattcaaaacactgcataccggtcgtcagacggcatcccgcccgctgcccgggctgcccggactgactgcggtttccacactgttcggcgcaatgtcgagctgggtcggcataggcggcggttcactttccgtccccttcttaatccactgcggcttccccgcccataaagccatcggcacatcatccggccttgcctggccgattgcactctccggcgcaatatcgtatctggtcaacggtctgaatattgcaggattgcccgaagggtcgctgggcttcctttacctgcccgccgtcgccgtcctcagcgcggcaaccattgcctttgccccgctcggtgtcaaaaccgcccacaaactttcttctgccaaactcaaagaatccttcggcattatgttgcttttgattgccggaaaaatgctgtacaacctgctttaa

SEQ ID NO: 94 - protein, 268 aa, Neisseria gonorrhoeae; identical to SEQ ID NO: 92

SEQ ID NO: 95 - DNA, 351 bp, Neisseria meningitidis
ggaaacggatggcaggcagaccccgaacatccgctgctcgggctttttgccgtcagtaatgtatcgatgacgcttgcttttgtcggaatatgtgcgttggtgcattattgcttttcgggaacggttcaagtgtttgtgtttgcggcactgctcaaactttatgcgctgaagccggtttattggttcgtgttgcagtttgtgctgatggcggttgcctatgtccaccgctgcggtatagaccggcagccgccgtcaacgttcggcggctcgcagctgcgactcggcgggttgacggcagcgttgatgcaggtctcggtactggtgctgctgctttcagaaattggaagataa

SEQ ID NO: 96 - protein, 116 aa, Neisseria meningitidis
GNGWQADPEHPLLGLFAVSNVSMTLAFVGICALVHYCFSGTVQVFVFAALLKLYALKPVYWFVLQFVLMAVAYVHRCGIDRQPPSTFGGSQLRLGGLTAALMQVSVLVLLLSEIGR

SEQ ID NO: 97 - DNA, 606 bp, Neisseria meningitidis
atgattttgctgcatttggattttttgtctgccttactgtatgcggcggtttttctgtttctgatattccgcgcaggaatgttgcaatggttttgggcgagtattatgctgtggctgggcatatcggttttgggggcaaagctgatgcccggcatatggggaatgacccgcgccgcgcccttgttcatcccccatttttacctgactttgggcagcatattttttttcatcgggcattggaaccggaaaacagatggaaacggatggcaggcagaccccgaacatccgctgctcgggctttttgccgtcagtaatgtatcgatgacgcttgcttttgtcggaatatgtgcgttggtgcattattgcttttcgggaacggttcaagtgtttgtgtttgcggcactgctcaaactttatgcgctgaagccggtttattggttcgtgttgcagtttgtgctgatggcggttgcctatgtccaccgctgcggtatagaccggcagccgccgtcaacgttcggcggctcgcagctgcgactcggcgggttgacggcagcgttgatgcaggtctcggtactggtgctgctgctttcagaaattggaagataa

SEQ ID NO: 98 - protein, 201 aa, Neisseria meningitidis
MILLHLDFLSALLYAAVFLFLIFRAGMLQWFWASIMLWLGISVLGAKLMPGIWGMTRAAPLFIPHFYLTLGSIFFFIGHWNRKTDGNGWQADPEHPLLGLFAVSNVSMTLAFVGICALVHYCFSGTVQVFVFAALLKLYALKPVYWFVLQFVLMAVAYVHRCGIDRQPPSTFGGSQLRLGGLTAALMQVSVLVLLLSEIGR

SEQ ID NO: 99 - DNA, 606 bp, Neisseria meningitidis
  misc_feature (373)..(373): N= Unknown
  misc_feature (522)..(522): N= Unknown
  misc_feature (565)..(565): N= Unknown
atgattttgctgcatttggattttttgtctgccttactgtatgcggcggtttttctgtttctgatattccgcgcaggaatgttgcaatggttttgggcgagtattatgctgtggctgggcatatcggttttgggggcaaagctgatgcccggcatatggggaatgacccgcgccgcgcccttgttcatcccccatttttacctgactttgggcagcatattttttttcatcgggcattggaaccggaaaacggatggaaacggatggcaggcagaccccgaacatcctctgctcgggctgtttgccgtcagtaatgtatcgatgacgcttgcttttgtcggaatatgtgcgttggtgcattattgcttttcgngaacggttcaagtgtttgtgtttgcggcactgctcaaactttatgcgctgaagccggtttattggttcgtgttgcagtttgtgctgatggcggttgcctatgtccaccgctgcggtatagaccggcagccgccgtcaacgttcggcggntcgcagctgcgactcggcgggttgacggcagcgttgatgcagntctcggtactggtgctgctgctttcagaaattggaagataa

SEQ ID NO: 100 - protein, 201 aa, Neisseria meningitidis
  misc_feature (125)..(125): N= Unknown
  misc_feature (189)..(189): N= Unknown
MILLHLDFLSALLYAAVFLFLIFRAGMLQWFWASIMLWLGISVLGAKLMPGIWGMTRAAPLFIPHFYLTLGSIFFFIGHWNRKTDGNGWQADPEHPLLGLFAVSNVSMTLAFVGICALVHYCFSXTVQVFVFAALLKLYALKPVYWFVLQFVLMAVAYVHRCGIDRQPPSTFGGSQLRLGGLTAALMQXSVLVLLLSEIGR

SEQ ID NO: 101 - DNA, 606 bp, Neisseria gonorrhoeae
  misc_feature (125)..(125): N= Unknown
  misc_feature (189)..(189): N= Unknown
atgattttgctgcatttggattttttgtctgccttactgtatgcggcggtttttctgtttctgatattccgcgcaggaatgttgcaatggttttgggcgagtattgcgttgtggctcggcatctcggttttaggggtaaagctgatgccggggatgtggggaatgacccgcgccgcgcctttgttcatcccccatttttacctgactttgggcagcatattttttttcatcgggtattggaaccggaaaacagatggaaacggatggcaggcagaccccgaacatccgctgctcgggctttttgccgtcagtaatgtatcgatgacgcttgcttttgtcggaatatgtgcgttggtgcattattgcttttcgggaacggttcaagtgtttgtgtttgcggcattgctcaaactttatgcgctgaagccggtttattggttcgtgttgcagtttgtattgatggcggttgcctatgtccaccgctgcggtatagaccggcagccgccgtcaacgttcggcggttcgcagctgcgactcggcgtgttggcggcgatgttgatgcaggttgcggtaacggcgatgctgcttgccgaaatcggcagatga

SEQ ID NO: 102 - protein, 201 aa, Neisseria meningitidis
MILLHLDFLSALLYAAVFLFLIFRAGMLQWFWASIALWLGISVLGVKLMPGMWGMTRAAPLFIPHFYLTLGSIFFFIGYWNRKTDGNGWQADPEHPLLGLFAVSNVSMTLAFVGICALVHYCFSGTVQVFVFAALLKLYALKPVYWFVLQFVLMAVAYVHRCGIDRQPPSTFGGSQLRLGVLAAMLMQVAVTAMLLAEIGR

SEQ ID NO: 103 - DNA, 308 bp, Neisseria gonorrhoeae
  misc_feature (30)..(30): N= Unknown
  misc_feature (161)..(161): N= Unknown
  misc_feature (163)..(163): N= Unknown
  misc_feature (177)..(177): N= Unknown
  misc_feature (306)..(306): N= Unknown
atgaaaaccccactcctcaagcctctgctnattacctcgcttcccgttttcgccagtgtttttaccgccgcctccatcgtctggcagctaggcgaacccaagctcgccatgcccttcgtactcggcatcatcgccggcggccttgtcgatttggacaaccncntgaccggacggctnaaaaacatcatcaccaccgtcgccctgttcaccctctcctcgctcacggcacaaagcaccctcggcacagggctgcccttcatcctcgccatgaccctgatgacttcgcttcaccattttaggcgcggncg

SEQ ID NO: 104 - protein, 103 aa, Neisseria meningitidis
  misc_feature (54)..(55): Xaa= any amino acid
  misc_feature (95)..(96): Xaa= any amino acid
  misc_feature (103)..(103): Xaa= any amino acid
MKTPLLKPLLITSLPVFASVFTAASIVWQLGEPKLAMPFVLGIIAGGLVDLDNXXTGRLKNIITTVALFTLSSLTAQSTLGTGLPFILAMTLMTXXFTILGAX

SEQ ID NO: 105 - DNA, 2151 bp, Neisseria meningitidis
atgaaaaccccactcctcaagcctctgctcattacctcgcttcccgttttcgccagtgtttttaccgccgcctccatcgtctggcagctaggcgaacccaagctcgccatgcccttcgtactcggcatcatcgccggcggccttgtcgatttggacaaccgcctgaccggacggctgaaaaacatcatcaccaccgtcgccctgttcaccctctcctcgctcacggcacaaagcaccctcggcacagggctgcccttcatcctcgccatgaccctgatgaccttcggcttcaccattttaggcgcggtcgggctcaaataccgcaccttcgccttcggtgcactcgccgtcgccacctacaccacacttacctacacccccgaaacctactggctgaccaaccccttcatgattttatgcggcaccgtactgtacagcaccgccatcctcctgttccaaatcgtcctgccccaccgccccgtccaagaaagcgtcgccaacgcctacgacgcactcggcggctacctcgaagccaaagccgacttcttcgaccccgatgaggcagcctggataggcaaccgccacatcgacctcgccatgagcaacaccggcgtcatcaccgccttcaaccaatgccgttccgccctgttttaccgccttcgcggcaaacaccgccacccgcgcaccgccaaaatgctgcgttactactttgccgcccaagacatacacgaacgcatcagctccgcccacgtcgattatcaggaaatgtccgaaaaattcaaaaacaccgacatcatcttccgcatccaccgcctgctcgaaatgcagggacaagcctgccgcaacaccgcccaagccctgcgcgcaagcaaagactacgtttacagcaaacgcctcggccgcgccatcgaaggctgccgccaatcgctgcgcctcctttcagacagcaacgacagtcccgacatccgccacctgcgccgccttctcgacaacctcggcagcgtcgaccagcagttccgccaactccagcacaacggcctgcaggcagaaaacgaccgcatgggcgacacccgcatcgccgccctcgaaaccagcagcctcaaaaacacctggcaggcaatccgtccgcagctaaacctcgaatcaggcgtattccgccatgccgtccgcctgtccctcgtcgttgccgccgcctgcaccatcgtcgaagccctcaacctcaacctcggctactggatactactgaccgcccttttcgtctgccaacccaactacaccgccaccaaaagccgcgtccgccagcgcatcgccggcaccgtactcggcgtaatcgtcggctcgctcgtcccctacttcaccccgtctgtcgaaaccaaactctggattgtcatcgccagtaccaccctctttttcatgacccgcacctacaaatacagtttctccaccttcttcattaccattcaagccctgaccagcctctccctcgcaggtttggacgtatacgccgccatgcccgtacgcatcatcgacaccattatcggcgcatcccttgcctgggcggcagtcagctacctgtggccagactggaaatacctcacgctcgaacgcaccgccgcccttgccgtatgcagcaacggtgcctatctcgaaaaaatcaccgaacgcctcaaaagcggcgaaaccggcgacgacgtcgaataccgcgccacccgccgccgcgcccacgaacacaccgccgccctcagcagcaccctttccgacatgagcagcgaacccgcaaaattcgccgacagcctgcaacccggctttaccctgctcaaaaccggctacgccctgaccggctacatctccgccctcggcgcataccgcagcgaaatgcacgaagaatgcagccccgactttaccgcacagttccacctcgccgccgaacacaccgcccacatcttccaacacctgcccgaaaccgaacccgacgactttcagacagcactggatacactgcgcggcgaactcgacaccctccgcacccacagcagcggaacacaaagccacatcctcctccaacagctccaactcatcgcccgacagctcgaaccctactaccgcgcctaccgccaaattccgcacaggcagccccaaaatgcagcctga

SEQ ID NO: 106 - protein, 716 aa, Neisseria meningitidis
MKTPLLKPLLITSLPVFASVFTAASIVWQLGEPKLAMPFVLGIIAGGLVDLDNRLTGRLKNIITTVALFTLSSLTAQSTLGTGLPFILAMTLMTFGFTILGAVGLKYRTFAFGALAVATYTTLTYTPETYWLTNPFMILCGTVLYSTAILLFQIVLPHRPVQESVANAYDALGGYLEAKADFFDPDEAAWIGNRHIDLAMSNTGVITAFNQCRSALFYRLRGKHRHPRTAKMLRYYFAAQDIHERISSAHVDYQEMSEKFKNTDIIFRIHRLLEMQGQACRNTAQALRASKDYVYSKRLGRAIEGCRQSLRLLSDSNDSPDIRHLRRLLDNLGSVDQQFRQLQHNGLQAENDRMGDTRIAALETSSLKNTWQAIRPQLNLESGVFRHAVRLSLVVAAACTIVEALNLNLGYWILLTALFVCQPNYTATKSRVRQRIAGTVLGVIVGSLVPYFTPSVETKLWIVIASTTLFFMTRTYKYSFSTFFITIQALTSLSLAGLDVYAAMPVRIIDTIIGASLAWAAVSYLWPDWKYLTLERTAALAVCSNGAYLEKITERLKSGETGDDVEYRATRRRAHEHTAALSSTLSDMSSEPAKFADSLQPGFTLLKTGYALTGYISALGAYRSEMHEECSPDFTAQFHLAAEHTAHIFQHLPETEPDDFQTALDTLRGELDTLRTHSSGTQSHILLQQLQLIARQLEPYYRAYRQIPHRQPQNAA

SEQ ID NO: 107 - DNA, 2151 bp, Neisseria meningitidis
atgaaaaccccacccctcaagcctctgctcattacctcgcttcccgttttcgccagtgtctttaccgccgcctccatcgtctggcagctgggcgaacccaagctcgccatgcccttcgtactcggcatcatcgctggcggcctggtcgatttggacaaccgcctgaccggacggctgaaaaacatcatcgccaccgtcgccctgttcaccctctcctcacttgtcgcgcaaagcaccctcggcacaggtttgccattcatcctcgccatgaccctgatgactttcggctttaccatcatgggcgcggtcgggctgaaataccgcaccttcgccttcggcgcactcgccgtcgccacctacaccacacttacctacacccccgaaacctactggctgaccaacccctttatgattctgtgcggaaccgtactgtacagcaccgccatcatcctgttccaaatcatcctgccccaccgccccgttcaagaaaacgtcgccaacgcctacgaagcactcggcagctacctcgaagccaaagccgactttttcgatcccgacgaagccgaatggataggcaaccgccacatcgacctcgccatgagcaacaccggcgtcatcaccgccttcaaccaatgccgttccgccctgttttaccgccttcgcggcaaacaccgccacccgcgcaccgccaaaatgctgcgctactacttcgccgcccaagacatacacgaacgcatcagctccgcccacgtcgactaccaagagatgtccgaaaaattcaaaaacaccgacatcatcttccgcatccaccgcctgctcgaaatgcagggacaagcctgccgcaacaccgcccaagccctgcgcgcaagcaaagactacgtttacagcaaacgcctcggccgcgccatcgaaggctgccgccaatcgctgcgcctcctttcagacagcaacgacaatcccgacatccgccacctgcgccgccttctcgacaacctcggcagcgtcgaccagcagttccgccaactccagcacaacggcctgcaggcagaaaacgaccgcatgggcgacacccgcatcgccgccctcgaaaccggcagcctcaaaaacacctggcaggcaatccgtccgcagctaaacctcgaatcaggcgtattccgccatgccgtccgcctgtcccttgtcgttgccgccgcctgcaccatcgtcgaagccctcaacctcaacctcggctactggatactactgaccgcccttttcgtctgccaacccaactacaccgccaccaaaagccgcgtccgccagcgcatcgccggcaccgtactcggcgtaatcgtcggctcgctcgtcccctactttaccccctccgtcgaaaccaaactctggatcgtcatcgccagtaccaccctctttttcatgacccgcacctacaaatacagcttctcgacatttttcatcaccattcaagccctgaccagcctctccctcgcagggttggacgtatacgccgccatgcccgtacgcatcatcgacaccattatcggcgcatcccttgcctgggcggcagtcagctacctgtggccagactggaaatacctcacgctcgaacgcaccgccgcccttgccgtatgcagcaacggcgcctatctcgaaaaaatcaccgaacgcctcaaaagcggcgaaaccggcgacgacgtcgaataccgcgccacccgccgccgcgcccacgaacacaccgccgccctcagcagcaccctttccgacatgagcagcgaacccgcaaaattcgccgacagcctgcaacccggctttaccctgctcaaaaccggctacgccctgaccggctacatctccgccctcggcgcataccgcagcgaaatgcacgaagaatgcagccccgactttaccgcacagttccacctcgccgccgaacacaccgcccacatcttccaacacctgcccgaaaccgaacccgacgactttcagacagcactggatacactgcgcggcgaactcgacaccctccgcacccacagcagcggaacacaaagccacatcctcctccaacagctccaactcatcgcccggcagctcgaaccctactaccgcgcctaccgacaaattccgcacaggcagccccaaaacgcagcctga

SEQ ID NO: 108 - protein, 716 aa, Neisseria meningitidis
MKTPPLKPLLITSLPVFASVFTAASIVWQLGEPKLAMPFVLGIIAGGLVDLDNRLTGRLKNIIATVALFTLSSLVAQSTLGTGLPFILAMTLMTFGFTIMGAVGLKYRTFAFGALAVATYTTLTYTPETYWLTNPFMILCGTVLYSTAIILFQIILPHRPVQENVANAYEALGSYLEAKADFFDPDEAEWIGNRHIDLAMSNTGVITAFNQCRSALFYRLRGKHRHPRTAKMLRYYFAAQDIHERISSAHVDYQEMSEKFKNTDIIFRIHRLLEMQGQACRNTAQALRASKDYVYSKRLGRAIEGCRQSLRLLSDSNDNPDIRHLRRLLDNLGSVDQQFRQLQHNGLQAENDRMGDTRIAALETGSLKNTWQAIRPQLNLESGVFRHAVRLSLVVAAACTIVEALNLNLGYWILLTALFVCQPNYTATKSRVRQRIAGTVLGVIVGSLVPYFTPSVETKLWIVIASTTLFFMTRTYKYSFSTFFITIQALTSLSLAGLDVYAAMPVRIIDTIIGASLAWAAVSYLWPDWKYLTLERTAALAVCSNGAYLEKITERLKSGETGDDVEYRATRRRAHEHTAALSSTLSDMSSEPAKFADSLQPGFTLLKTGYALTGYISALGAYRSEMHEECSPDFTAQFHLAAEHTAHIFQHLPETEPDDFQTALDTLRGELDTLRTHSSGTQSHILLQQLQLIARQLEPYYRAYRQIPHRQPQNAA

SEQ ID NO: 109 - DNA, 8 bp, Neisseria gonorrhoeae
  misc_feature (1)..(8): N= Unknown
nnnnnnnn

SEQ ID NO: 110 - protein, 370 aa, Neisseria meningitidis
MKTPLLKPLLITSLPVFASVFTAASIVWQLGEPKLAMPFVLGIIAGGLVDLDNRLTGRLKNIIATVALFTLSSLTAQSTLGTGLPFILAMTLMTFGFTILGAVGLKYRTFAFGALAVATYTTLTYTPETYWLTNPFMILCGTVLYSTAIILFQIILPHRPVQESVANAYEALGGYLEAKADFFDPDEAAWIGNRHIDLAMSNTGVITAFNQCRSALFYRLRGKHRHPRTAKMLRYYFAAQDIHERISSAHVDYQEMSEKFKNTDIIFRIRRLLEMQGQACRNTAQAIRSGKDYVYSKRLGRAIEGCRQSLRLLSDGNDSPDIRHLSRLLDNLGSVDQQFRQLRHSDSPAENDRMGDTRIAALETGSFKNT

SEQ ID NO: 111 - DNA, 2151 bp, Neisseria gonorrhoeae
atgaaaaccccactcctcaagcctctgctcattacctcgcttcccgttttcgccagtgtctttaccgccgcctccatcgtctggcagctaggcgaacccaagctcgccatgcccttcgtactcggcatcatcgccggcggcctggtcgatttggacaaccgcctgaccggacggctgaaaaacatcatcgccaccgtcgccctgtttaccctctcctcgctcacggcgcaaagcaccctcggcacagggctgcccttcatcctcgccatgaccctgatgaccttcggctttaccattttaggcgcggtcgggctgaaataccgcaccttcgccttcggcgcactcgccgtcgccacctacaccacgcttacctacacccccgaaacctactggctgaccaaccccttcatgattttatgcggcaccgtactgtacagcaccgccatcatcctgttccaaatcatcctgccccaccgccccgtccaagaaagcgtcgccaatgcctacgaagcactcggcggctacctcgaagccaaagccgacttcttcgaccccgatgaggcagcctggataggcaaccgccacatcgacctcgccatgagcaacaccggcgtcatcaccgccttcaaccaatgccgttccgccctgttttaccgtttgcgcggcaaacaccgccacccgcgcaccgccaaaatgctgcgctactacttcgccgcccaagacatccacgaacgcatcagctccgcccacgtcgactaccaagagatgtccgaaaaattcaaaaacaccgacatcatcttccgcatccgccgcctgctcgaaatgcaggggcaggcgtgccgcaacaccgcccaagccatccggtcgggcaaagactacgtttacagcaaacgcctcggacgcgccatcgaaggctgccgccagtcgctgcgcctcctttcagacggcaacgacagtcccgacatccgccacctgagccgccttctcgacaacctcggcagcgtcgaccagcagttccgccaactccgacacagcgactcccccgccgaaaacgaccgcatgggcgacacccgcatcgccgccctcgaaaccggcagcttcaaaaacacctggcaggcaatccgtccgcagctgaacctcgaatcatgcgtattccgccatgccgtccgcctgtccctcgtcgttgccgccgcctgcaccatcgtcgaagccctcaacctcaacctcggctactggatactgctgaccgcccttttcgtctgccaacccaactacaccgccaccaaaagccgcgtgtaccaacgcatcgccggcaccgtactcggcgtaatcgtcggctcgctcgtcccctacttcaccccctccgtcgaaaccaaactctggattgtcatcgccggtaccaccctgttcttcatgacccgcacctacaaatacagtttctccaccttcttcatcaccattcaggcactgaccagcctctccctcgcaggtttggacgtatacgccgccatgcccgtgcgcatcatcgacaccattatcggcgcatcccttgcctgggcggcggtcagctacctgtggccagactggaaatacctcacgctcgaacgcaccgccgcccttgccgtatgcagcagcggcacatacctccaaaaaattgccgaacgcctcaaaaccggcgaaaccggcgacgacatagaataccgcatcacccgccgccgcgcccacgaacacaccgccgccctcagcagcaccctttccgacatgagcagcgaacccgcaaaattcgccgacagcctgcaacccggctttaccctgctcaaaaccggctacgccctgaccggctacatctccgccctcggcgcataccgcagcgaaatgcacgaagaatgcagccccgactttaccgcacagttccaccttgccgccgaacacaccgcccacatcttccaacacctgcccgacatgggacccgacgactttcagacggcattggatacactgcgcggcgaactcggcaccctccgcacccgcagcagcggaacacaaagccacatcctcctccaacagctccaactcatcgcccggcaactcgaaccctactaccgcgcctaccgacaaattccgcacaggcagccccaaaacgcagcctga

SEQ ID NO: 112 - protein, 716 aa, Neisseria gonorrhoeae
MKTPLLKPLLITSLPVFASVFTAASIVWQLGEPKLAMPFVLGIIAGGLVDLDNRLTGRLKNIIATVALFTLSSLTAQSTLGTGLPFILAMTLMTFGFTILGAVGLKYRTFAFGALAVATYTTLTYTPETYWLTNPFMILCGTVLYSTAIILFQIILPHRPVQESVANAYEALGGYLEAKADFFDPDEAAWIGNRHIDLAMSNTGVITAFNQCRSALFYRLRGKHRHPRTAKMLRYYFAAQDIHERISSAHVDYQEMSEKFKNTDIIFRIRRLLEMQGQACRNTAQAIRSGKDYVYSKRLGRAIEGCRQSLRLLSDGNDSPDIRHLSRLLDNLGSVDQQFRQLRHSDSPAENDRMGDTRIAALETGSFKNTWQAIRPQLNLESCVFRHAVRLSLVVAAACTIVEALNLNLGYWILLTALFVCQPNYTATKSRVYQRIAGTVLGVIVGSLVPYFTPSVETKLWIVIAGTTLFFMTRTYKYSFSTFFITIQALTSLSLAGLDVYAAMPVRIIDTIIGASLAWAAVSYLWPDWKYLTLERTAALAVCSSGTYLQKIAERLKTGETGDDIEYRITRRRAHEHTAALSSTLSDMSSEPAKFADSLQPGFTLLKTGYALTGYISALGAYRSEMHEECSPDFTAQFHLAAEHTAHIFQHLPDMGPDDFQTALDTLRGELGTLRTRSSGTQSHILLQQLQLIARQLEPYYRAYRQIPHRQPQNAA

SEQ ID NO: 113 - DNA, 1363 bp, Neisseria meningitidis
atgaatatgctgggagctttggcaaaagtcggcagcctgacgatggtgtcgcgcgttttgggatttgtgcgcgatacggtcattgcgcgggcattcggcgcgggtatggcgacggatgcgttttttgtcgcgttcaaactgcccaacctgcttcgccgcgtgtttgcggagggggcgtttgcccaagcgtttgtgccgattttggcggaatacaaggaaacgcgttcaaaagaggcggcgaagcctttatccgccatgtggcggggatgctgtcgtttgtactggttatcgttaccgcgctgggcatacttgccgcgccttgggtgatttatgtttccgcacccgagttttgcccaagatgccgacaaatttcagctctccatcgatttgctgcggattacgtttccttatatattattgatttccctgtcttcatttgtcggctcggtactcaattcttatcataagttcggcattccggcgtttacgccacgtttctgaacgtgtcgtttatcgtattcgcgctgtttttcgtgccgtatttcgatccgcccgttaccgcgcyggcgtgggcggtctttgtcggcggcattttgcaactcgrmttccaactgccctggctggcgaaactgggctttttgaaactgcccaaactgagtttcaaagatgcggcggtcaaccgcgtgatgaaacagatggcgcctgcgattttgggcgtgagcgtggcgcaggtttctttggtgatcaacacgattttcgcgtcttatctgcaatcgggcagcgtttcatggatgtattacgccgaccgcatgatggagctgcccagcggcgtgctgggggcggcactcggtacgattttgctgccgactttgtccaaacactcggcaaaccaagatacggaacagttttccgccctgctcgactggggtttgcgcctgtgcatgctgctgacgctgccggcggcggtcggactggcggtgttgtcgttcccgctggtggcgacgctgtttatgtaccgcgwatttacgctgtttgacgcgcagatgacgcaacacgcgctgattgcctattctttcggtttaatcggcttaatcatgattaaagtgttggcacccggcttctatgcgcggcaaaacatcaawamgcccgtcaaaatcgccatcttcacgctcatctgcmcgcagttgatgaaccttgsctttaycggcccactrraacrcastcggactttcgcttgccatcggtctgggcgcgtgtatcaatgccggattgttgttttacctgttgcgcagacacggtatttaccaacctggcaagggttgggcagcgttcttagcaaaaatgctgctctcgctcgccgtga

SEQ ID NO: 114 - protein, 454 aa, Neisseria meningitidis
  misc_feature (80)..(80): Xaa= any amino acid
  misc_feature (165)..(165): Xaa= any amino acid
  misc_feature (189)..(189): Xaa= any amino acid
  misc_feature (202)..(202): Xaa= any amino acid
  misc_feature (341)..(341): Xaa= any amino acid
  misc_feature (381)..(382): Xaa= any amino acid
  misc_feature (394)..(394): Xaa= any amino acid
  misc_feature (400)..(400): Xaa= any amino acid
  misc_feature (402)..(402): Xaa= any amino acid
  misc_feature (406)..(407): Xaa= any amino acid
  misc_feature (438)..(438): Xaa= any amino acid
  misc_feature (446)..(446): Xaa= any amino acid
MNMLGALAKVGSLTMVSRVLGFVRDTVIARAFGAGMATDAFFVAFKLPNLLRRVFAEGAFAQAFVPILAEYKETRSKEAXEAFIRHVAGMLSFVLVIVTALGILAAPWVIYVSAPSFAQDADKFQLSIDLLRITFPYILLISLSSFVGSVLNSYHKFGIPAFTPXFLNVSFIVFALFFVPYFDPPVTAXAWAVFVGGILQLXFQLPWLAKLGFLKLPKLSFKDAAVNRVMKQMAPAILGVSVAQVSLVINTIFASYLQSGSVSWMYYADRMMELPSGVLGAALGTILLPTLSKHSANQDTEQFSALLDWGLRLCMLLTLPAAVGLAVLSFPLVATLFMYRXFTLFDAQMTQHALIAYSFGLIGLIMIKVLAPGFYARQNIXXPVKIAIFTLICXQLMNLXFXGPLXXIGLSLAIGLGACINAGLLFYLLRRHGIYQPXQGLGSVLXQKCCSRSP

SEQ ID NO: 115 - DNA, 1539 bp, Neisseria meningitidis
atgaatatgctgggagctttggcaaaagtcggcagcctgacgatggtgtcgcgcgttttgggatttgtgcgcgatacggtcattgcgcgggcattcggcgcgggtatggcgacggatgcgttttttgtcgcgttcaaactgcccaacctgcttcgccgcgtgtttgcggagggggcgtttgcccaagcgtttgtgccgattttggcggaatacaaggaaacgcgttcaaaagaggcggcggaggcttttatccgccatgtggcggggatgctgtcgtttgtactggttatcgttaccgcgctgggcatacttgccgcgccttgggtgatttatgtttccgcacccggttttgcccaagatgccgacaaatttcagctctccatcgatttgctgcggattacgtttccttatatattattgatttccctgtcttcatttgtcggctcggtactcaattcttatcataagttcggcattccggcgtttacgcccacgtttctgaacgtgtcgtttatcgtattcgcgctgtttttcgtgccgtatttcgatccgcccgttaccgcgctggcgtgggcggtctttgtcggcggcattttgcaactcggcttccaactgccctggctggcgaaactgggctttttgaaactgcccaaactgagtttcaaagatgcggcggtcaaccgcgtgatgaaacagatggcgcctgcgattttgggcgtgagcgtggcgcaggtttctttggtgatcaacacgattttcgcgtcttatctgcaatcgggcagcgtttcatggatgtattacgccgaccgcatgatggagctgcccagcggcgtgctgggggcggcactcggtacgattttgctgccgactttgtccaaacactcggcaaaccaagatacggaacagttttccgccctgctcgactggggtttgcgcctgtgcatgctgctgacgctgccggcggcggtcggactggcggtgttgtcgttcccgctggtggcgacgctgtttatgtaccgcgaatttacgctgtttgacgcgcagatgacgcaacacgcgctgattgcctattctttcggtttaatcggcttaatcatgattaaagtgttggcacccggcttctatgcgcggcaaaacatcaaaacgcccgtcaaaatcgccatcttcacgctcatctgcacgcagttgatgaaccttgcctttatcggcccactgaaacacgtcggactttcgcttgccatcggtctgggcgcgtgtatcaatgccggattgttgttttacctgttgcgcagacacggtatttaccaacctggcaagggttgggcagcgttcttagcaaaaatgctgctctcgctcgccgtgatgtgcggcggactgtgggcagcgcaggcttacctgccgtttgaatgggcgcacgccggcggaatgcggaaagcggggcagctctgcatcctgattgccgtcggcggcggactgtatttcgcatcactggcggctttgggcttccgtccgcgccatttcaaacgcgtggaaaactga

SEQ ID NO: 116 - protein, 512 aa, Neisseria meningitidis
MNMLGALAKVGSLTMVSRVLGFVRDTVIARAFGAGMATDAFFVAFKLPNLLRRVFAEGAFAQAFVPILAEYKETRSKEAAEAFIRHVAGMLSFVLVIVTALGILAAPWVIYVSAPGFAQDADKFQLSIDLLRITFPYILLISLSSFVGSVLNSYHKFGIPAFTPTFLNVSFIVFALFFVPYFDPPVTALAWAVFVGGILQLGFQLPWLAKLGFLKLPKLSFKDAAVNRVMKQMAPAILGVSVAQVSLVINTIFASYLQSGSVSWMYYADRMMELPSGVLGAALGTILLPTLSKHSANQDTEQFSALLDWGLRLCMLLTLPAAVGLAVLSFPLVATLFMYREFTLFDAQMTQHALIAYSFGLIGLIMIKVLAPGFYARQNIKTPVKIAIFTLICTQLMNLAFIGPLKHVGLSLAIGLGACINAGLLFYLLRRHGIYQPGKGWAAFLAKMLLSLAVMCGGLWAAQAYLPFEWAHAGGMRKAGQLCILIAVGGGLYFASLAALGFRPRHFKRVEN

SEQ ID NO: 117 - DNA, 1539 bp, Neisseria meningitidis
  misc_feature (937)..(937): N= Unknown
atgaatatgctgggagctttggtaaaagtcggcagcctgacgatggtgtcgcgcgttttgggatttgtgcgcgatacggtcattgcgcgcgcattcggcgcaggcatggcgacggatgcgttctttgtcgcgttcaaactgcccaacctgcttcgccgcgtgtttgcggagggggcgtttgcccaagcgtttgtgccgattttggcggaatataaggaaacgcgttctaaagaggcgacggaggcttttatccgccatgtggcggggatgctgtcgtttgtactggtcatcgttaccgcgctgggcatacttgccgcgccttgggtgatttatgtttccgcacccggttttgccaaagatgccgacaaatttcagctctctatcgatttgctgcggattacgtttccttatatcttattgatttcactttcctcttttgtcggctcggtactcaattcctatcataaattcagcattcctgcgtttacgcccacgttcctgaacgtgtcgtttatcgtattcgcgctgtttttcgtgccgtatttcgatcctcccgttaccgcgctggcttgggcggtttttgtcggcggcattttgcaactcggcttccaactgccctggctggcgaaactgggttttttgaaactgcccaaactgagtttcaaagatgcggcggtcaaccgcgtgatgaaacagatggcgcctgcgattttgggcgtgagcgtggcgcagatttctttggtgatcaacacgattttcgcgtcttatctgcaatcgggcagcgtttcatggatgtattacgccgaccgcatgatggaactgcccggcggcgtgctgggggcggcactcggtacgattttgctgccgactttgtccaaacactcggcaaaccaagatacggaacagttttccgccctgctcgactggggtttgcgcntgtgcatgctgctgacgctgccggcggcggtcggaatggcggtgttgtcgttcccgctggtggcaaccttgtttatgtaccgagaattcacgctgtttgacgcgcagatgacgcaacacgcgctgattgcctattctttcggtttaatcggtttaatcatgattaaagtgttggcgcccggcttttatgcgcggcaaaacatcaaaacgcccgtcaaaatcgccatcttcacgctcatttgcacgcagttgatgaaccttgcctttatcggcccactgaaacacgtcggactttcgcttgccatcggtctgggcgcgtgtatcaatgccggattgttgttttacctgttgcgcagacacggtatttaccaacctggcaagggttgggcagcgttcttggcaaaaatgctgctctcgctcgccgtgatgggaggcggcctgtatgccgcccaaatctggctgccgttcgactgggcacacgccggcggaatgcaaaaggccgcccggctcttcatcctgattgccgtcggcggcggactgtatttcgcatcactggcggctttgggcttccgtccgcgccatttcaaacgcgtggaaagctga

SEQ ID NO: 118 - protein, 512 aa, Neisseria meningitidis
  misc_feature (313)..(313): Xaa= any amino acid
MNMLGALVKVGSLTMVSRVLGFVRDTVIARAFGAGMATDAFFVAFKLPNLLRRVFAEGAFAQAFVPILAEYKETRSKEATEAFIRHVAGMLSFVLVIVTALGILAAPWVIYVSAPGFAKDADKFQLSIDLLRITFPYILLISLSSFVGSVLNSYHKFSIPAFTPTFLNVSFIVFALFFVPYFDPPVTALAWAVFVGGILQLGFQLPWLAKLGFLKLPKLSFKDAAVNRVMKQMAPAILGVSVAQISLVINTIFASYLQSGSVSWMYYADRMMELPGGVLGAALGTILLPTLSKHSANQDTEQFSALLDWGLRXCMLLTLPAAVGMAVLSFPLVATLFMYREFTLFDAQMTQHALIAYSFGLIGLIMIKVLAPGFYARQNIKTPVKIAIFTLICTQLMNLAFIGPLKHVGLSLAIGLGACINAGLLFYLLRRHGIYQPGKGWAAFLAKMLLSLAVMGGGLYAAQIWLPFDWAHAGGMQKAARLFILIAVGGGLYFASLAALGFRPRHFKRVES

SEQ ID NO: 119 - DNA, 8 bp, Neisseria gonorrhoeae
  misc_feature (1)..(8): N= Unknown
nnnnnnnn

SEQ ID NO: 120 - protein, 454 aa, Neisseria gonorrhoeae
MNMLGALAKVGSLTMVSRVLGFVRDTVIARAFGAGMATDAFFVAFKLPNLLRRVFAEGAFAQAFVPILAEYKETRSKEATEAFIRHVAGMLSFVLIVVTALGILAAPWVIYVSAPGFTKDADKFQLSISLLRITFPYILLISLSSFVGSILNSYHKFGIPAFTPTFLNISFIVFALFFVPYFDPPVTALAWAVFVGGILQLGFQLPWLAKLGFLKLPKLNFKDAAVNRVMKQMAPAILGVSVAQISLVINTIFASYLQSGSVSWMYYADRMMELPGGVLGAALGTILLPTLSKHSANQDTEQFSALLDWGLRLCMLLTLPAAAGLAVLSFPLVATLFMYREFTLFDAQMTQHALIAYSFGLIGLIMIKVLASGFYARQNIKTPVKIAIFTLICTQLMNLAFIGPLKHAGLSLAIGLGACINAGLLFFLFRKHGIYRPGQGLGQPSWRKCCSRSP

SEQ ID NO: 121 - DNA, 1539 bp, Neisseria gonorrhoeae
atgaatatgcttggagctttggcaaaagtcggcagcctgacgatggtgtcgcgcgttttgggatttgtgcgcgatacggtcattgcgcgggcattcggcgcgggtatggcgacggatgcgttttttgtcgcgttcaaactgcccaacctgcttcgccgcgtgtttgcggagggggcgtttgcccaagcgtttgtgccgattttggcggaatataaggaaacgcgttctaaagaggcgacggaggcttttatccgccacgttgcgggaatgctgtcgtttgtgctgatcgtcgttaccgcgctgggcatacttgccgcgccttgggtgatttatgtttccgcgcccggctttaccaaagacgcggacaagttccaactttccatcagcctgctgcggattacgtttccttatatattattgatttctttgtcttcttttgtcggctcgatactcaattcctaccataagttcggcattcccgcgtttacgcccacgtttttaaacatctcttttatcgtattcgcactgtttttcgtgccgtatttcgatccgcccgttaccgcgctggcgtgggcggtttttgtcggcggtattttgcagctcggtttccaactgccgtggctggcgaaactgggctttttgaaactgcccaaactgaatttcaaagatgcggcggtcaaccgcgtcatgaaacagatggcgcctgcgattttgggcgtgagcgtggcgcaaatttctttggttatcaacacgattttcgcgtcttatctgcaatcgggcagcgtttcatggatgtattacgccgaccgcatgatggagctgcgccggggcgtgctgggggctgcactcggtacaattttgctgccgactttgtccaaacactcggcaaaccaagatacggaacagttttccgccctgctcgactggggtttgcgcctgtgcatgctgctgacgctgccggcggcggccggactggcggtattgtcgttcccgctggtggcgacgctgtttatgtaccgagaattcacgctgtttgacgcacaaatgacgcaacacgcgctgattgcctattctttcggtttaatcggtttaattatgattaaagtgttggcatccggcttttatgcgcggcaaaacatcaaaacgcccgtcaaaatcgccatcttcacgctcatctgcacgcagttgatgaacctcgcctttatcggtccgttgaaacacgccgggctttcgctcgccatcggcctgggcgcgtgcatcaacgccggattgttgttcttcctgttgcgcaaacacggtatttaccggcccggcaggggttgggcggcgttcttggcgaaaatgctgctcgcgctcgccgtgatgtgcggcggactgtgggcggcgcaggcttgcctgccgttcgaatgggcgcacgccggcggaatgcggaaagcggggcagctctgcatcctgattgccgtcggcggcggactgtatttcgcatctctggcggctttgggcttccgtccgcgccatttcaaacgcgtggaaagctga

SEQ ID NO: 122 - protein, 512 aa, Neisseria gonorrhoeae
MNMLGALAKVGSLTMVSRVLGFVRDTVIARAFGAGMATDAFFVAFKLPNLLRRVFAEGAFAQAFVPILAEYKETRSKEATEAFIRHVAGMLSFVLIVVTALGILAAPWVIYVSAPGFTKDADKFQLSISLLRITFPYILLISLSSFVGSILNSYHKFGIPAFTPTFLNISFIVFALFFVPYFDPPVTALAWAVFVGGILQLGFQLPWLAKLGFLKLPKLNFKDAAVNRVMKQMAPAILGVSVAQISLVINTIFASYLQSGSVSWMYYADRMMELRRGVLGAALGTILLPTLSKHSANQDTEQFSALLDWGLRLCMLLTLPAAAGLAVLSFPLVATLFMYREFTLFDAQMTQHALIAYSFGLIGLIMIKVLASGFYARQNIKTPVKIAIFTLICTQLMNLAFIGPLKHAGLSLAIGLGACINAGLLFFLLRKHGIYRPGRGWAAFLAKMLLALAVMCGGLWAAQACLPFEWAHAGGMRKAGQLCILIAVGGGLYFASLAALGFRPRHFKRVES

SEQ ID NO: 123 - DNA, 474 bp, Neisseria meningitidis
atgattaaaatcaaaaaaggtctaaacctgcccatcgcgggcagaccggagcaagccgtttacgacggcccggccattaccgaagtcgcgttgcttggcgaagaatatgccggtatgcgcccctcgatgaaagtcaaggaaggcgatgccgtcaaaaaaggccaagtgctgtttgaagacaaaaagaatccgggcgtggtgtttactgcgccggcttcaggcaaaatcgccgcgattcaccgtggcgaaaagcgcgtacttcagtcagtcgtgattgccgttgaargcaacgacgaaatcgagtttgaacgctacgcacctgaagcgctggcaaacttaagcggcgaagaagtgcgccgcaacctgatccaatccggtttgtggactgcgctgcgcacccgtccgttcagcaaaattcctgccgtcgatgccgagccgttcgccatcttcgtcaatgcgatggacaccaatccg

SEQ ID NO: 124 - protein, 158 aa, Neisseria meningitidis
  misc_feature (96)..(96): Xaa= any amino acid
MIKIKKGLNLPIAGRPEQAVYDGPAITEVALLGEEYAGMRPSMKVKEGDAVKKGQVLFEDKKNPGVVFTAPASGKIAAIHRGEKRVLQSVVIAVEXNDEIEFERYAPEALANLSGEEVRRNLIQSGLWTALRTRPFSKIPAVDAEPFAIFVNAMDTNP

SEQ ID NO: 125 - DNA, 1344 bp, Neisseria meningitidis
atgattaaaatcaaaaaaggtctaaacctgcccatcgcgggcagaccggagcaagccgtttacgacggcccggccattaccgaagtcgcgttgcttggcgaagaatatgccggtatgcgcccctcgatgaaagtcaaggaaggcgatgccgtcaaaaaaggccaagtgctgtttgaagacaaaaagaatccgggcgtggtgtttactgcgccggcttcaggcaaaatcgccgcgattcaccgtggcgaaaagcgcgtacttcagtcagtcgtgattgccgttgaaggcaacgacgaaatcgagtttgaacgctacgcacctgaagcgctggcaaacttaagcggcgaagaagtgcgccgcaacctgatccaatccggtttgtggactgcgctgcgcacccgtccgttcagcaaaattcctgccgtcgatgccgagccgttcgccatcttcgtcaatgcgatggacaccaatccgctggctgccgaccctacggtcattatcaaagaagccgccgaggatttcaaacgcggcctgttggtattgagccgtttgaccgaacgcaaaatccatgtttgtaaggcagctggcgcagacgtgccgtctgaaaatgctgccaacatcgaaacacatgaattcggcggcccgcatcctgccggtttgagtggcacgcacattcatttcatcgagccggtcggcgcgaataaaaccgtgtggaccatcaattatcaagatgtaattaccattggccgtttgtttgcaacaggccgtctgaacaccgagcgcgtgattgccctaggtggttctcaagtcaacaaaccgcgcctcttgcgtaccgttttgggtgcgaaagtatcgcaaattactgcgggcgaattggttgacacagacaaccgcgtgatttccggttcggtattgaacggcgcgattacacaaggcgcgcacgattatttgggacgctaccacaatcagatttccgttatcgaagaaggccgcagcaaagagctgttcggctgggttgcgccgcagccggacaaatactccatcacgcgtacaaccctcggccatttcctgaaaaacaaactcttcaagttcaacacagccgtcaacggcggcgaccgcgccatggtgccgattggtacttacgagcgcgtgatgcccttggatatcctgcccaccctgcttttgcgcgatttaatcgtcggcgataccgacagcgcgcaggcattgggttgcttggaattggacgaagaagacctcgctttgtgcagcttcgtctgcccgggcaaatacgaatacggcccgctgttgcgcaaagtgctggaaaccattgagaaggaaggctga

SEQ ID NO: 126 - protein, 447 aa, Neisseria meningitidis
MIKIKKGLNLPIAGRPEQAVYDGPAITEVALLGEEYAGMRPSMKVKEGDAVKKGQVLFEDKKNPGVVFTAPASGKIAAIHRGEKRVLQSVVIAVEGNDEIEFERYAPEALANLSGEEVRRNLIQSGLWTALRTRPFSKIPAVDAEPFAIFVNAMDTNPLAADPTVIIKEAAEDFKRGLLVLSRLTERKIHVCKAAGADVPSENAANIETHEFGGPHPAGLSGTHIHFIEPVGANKTVWTINYQDVITIGRLFATGRLNTERVIALGGSQVNKPRLLRTVLGAKVSQITAGELVDTDNRVISGSVLNGAITQGAHDYLGRYHNQISVIEEGRSKELFGWVAPQPDKYSITRTTLGHFLKNKLFKFNTAVNGGDRAMVPIGTYERVMPLDILPTLLLRDLIVGDTDSAQALGCLELDEEDLALCSFVCPGKYEYGPLLRKVLETIEKEG

SEQ ID NO: 127 - DNA, 1344 bp, Neisseria meningitidis
  misc_feature (125)..(125): N= Unknown
  misc_feature (187)..(187): N= Unknown
  misc_feature (213)..(213): N= Unknown
  misc_feature (348)..(348): N= Unknown
  misc_feature (352)..(352): N= Unknown
  misc_feature (354)..(355): N= Unknown
  misc_feature (357)..(358): N= Unknown
  misc_feature (398)..(398): N= Unknown
  misc_feature (477)..(477): N= Unknown
  misc_feature (512)..(512): N= Unknown
  misc_feature (516)..(516): N= Unknown
  misc_feature (529)..(529): N= Unknown
  misc_feature (532)..(532): N= Unknown
  misc_feature (1296)..(1296): N= Unknown
  misc_feature (1327)..(1327): N= Unknown
atgattaaaatcaaaaaaggtctaaacctgcccatcgcgggcagaccggagcaagtcatttatgacgggcccgtcattaccgaagtcgcgttgcttggcgaagaatatgccggtatgcgcccctngatgaaagtcaaggaaggcgatgccgtcaaaaaaggccaagtgctgtttgaagacaaaaagnatccgggcgtggtgtttaccgcgccngtttcaggcaaaatcgccgccatccatcgcggcgaaaagcgcgtacttcagtcggtcgtgattgccgttgaaggcaacgacgaaatcgagttcgaacgctacgcgcccgaagcgttggcaaacttaagcggcgangaantnngnngcaatctgatccaatccggtttgtggactgcgctgcgtanccgtccgttcagcaaaatccctgccgtcgatgccgagccgttcgccatcttcgtcaatgcgatggacaccaatccgctngcggcagaccctgtggttgtgatcaaagaagccgncgangatttcagacgangtntgctggtattgagccgtttgaccgagcgtaaaatccatgtgtgtaaggcagctggcgcagacgtgccgtctgaaaatgctgccaacatcgaaacacatgaattcggcggcccgcatccggccggtttgagtggcacgcacattcatttcattgagccggtcggtgcaaacaaaaccgtttggaccatcaattatcaagatgtaattgccatcggacgtttgtttgcaacaggccgtctgaacaccgagcgcgtgattgctttgggtggttctcaagtcaacaaaccacgcctcttgcgtaccgttttgggtgcgaaagtatcgcaaattactgcgggcgaattggttgacgcagacaaccgcgtgatttccggttcggtattgaacggcgcgattacacaaggcgcgcacgattatttgggacgctaccacaatcagatttccgttatcgaagaaggccgcagcaaagagctgttcggctgggttgcgccgcagccggacaaatactccatcacgcgtacgaccctcggccatttcctgaaaaacaaactcttcaagttcacgacagccgtcaacggtggcgaccgcgccatggtgccgattggtacttacgagcgcgtaatgccgctagacatcctgcctaccctgcttttgcgcgatttaatcgtcggcgataccgacagcgcgcaagcattgggttgcttggaattggacgaagaagacctcgctttgtgcagcttcgtctgcccgggcaaatacgaatanggcccgctgttgcgtaaggtgctggaaaccnttgagaaggaaggctga

SEQ ID NO: 128 - protein, 447 aa, Neisseria meningitidis
  misc_feature (42)..(42): Xaa= any amino acid
  misc_feature (63)..(63): Xaa= any amino acid
  misc_feature (116)..(116): Xaa= any amino acid
  misc_feature (118)..(120): Xaa= any amino acid
  misc_feature (133)..(133): Xaa= any amino acid
  misc_feature (171)..(172): Xaa= any amino acid
  misc_feature (177)..(178): Xaa= any amino acid
  misc_feature (432)..(432): Xaa= any amino acid
  misc_feature (443)..(443): Xaa= any amino acid
MIKIKKGLNLPIAGRPEQVIYDGPVITEVALLGEEYAGMRPXMKVKEGDAVKKGQVLFEDKKXPGVVFTAPVSGKIAAIHRGEKRVLQSVVIAVEGNDEIEFERYAPEALANLSGXEXXXNLIQSGLWTALRXRPFSKIPAVDAEPFAIFVNAMDTNPLAADPVVVIKEAXXDFRRXXLVLSRLTERKIHVCKAAGADVPSENAANIETHEFGGPHPAGLSGTHIHFIEPVGANKTVWTINYQDVIAIGRLFATGRLNTERVIALGGSQVNKPRLLRTVLGAKVSQITAGELVDADNRVISGSVLNGAITQGAHDYLGRYHNQISVIEEGRSKELFGWVAPQPDKYSITRTTLGHFLKNKLFKFTTAVNGGDRAMVPIGTYERVMPLDILPTLLLRDLIVGDTDSAQALGCLELDEEDLALCSFVCPGKYEXGPLLRKVLETXEKEG

SEQ ID NO: 129 - DNA, 8 bp, Neisseria gonorrhoeae
  misc_feature (1)..(8): N= Unknown
nnnnnnnn

SEQ ID NO: 130 - protein, 322 aa, Neisseria gonorrhoeae
MIKIKKGLNLPIAGRPEQVIYDGPAITEVALLGEEYVGMRPSMKIKEGEAVKKGQVLFEDKKNPGVVFTAPASGKIAAIHRGEKRVLQSVVIAVEGNDEIEFERYVPEALAKLSSEKVRRNLIQSGLWTALRTRPFSKIPAVDAEPFAIFVNAMDTNPLAADPTVIIKEAAEDFKRGLLVLSRLTERKIHVCKAAGADVPSENAANIETHEFGGPHPAGLSGTHIHFIEPVGANKTVWTINYQDVIAIGRLFVTGRLNTERVVALGGLQVNKPRLLRTVLGAKVSQLTAGELVDADNRVISGSVLNGAIAQGAHDYLGRYHN

SEQ ID NO: 131 - DNA, 1344 bp, Neisseria gonorrhoeae
atgattaaaatcaaaaaaggtctaaatctgcccatcgcgggcagaccggagcaagtcatttatgacggcccggccattaccgaagtcgcgttgcttggcgaagaatatgtcggcatgcgcccctcgatgaaaatcaaggaaggtgaagccgtcaaaaaaggccaagtgctgtttgaagacaaaaagaatccgggcgtagtatttactgcgccggcttcaggcaaaatcgccgctattcaccgtggcgaaaagcgcgtacttcagtcagtcgtgattgccgttgaaggcaacgacgaaatcgagttcgaacgctacgtacctgaagcgctggcaaaattgagcagcgaaaaagtgcgccgcaacctgattcaatcaggcttatggactgcgcttcgcacccgtccgttcagcaaaatccctgccgtagatgccgagccgttcgccatcttcgtcaatgcgatggacaccaatccgctggctgccgaccctacggtcatcatcaaagaagccgccgaagacttcaaacgcggcctgttggtattgagccgcctgaccgaacgtaaaatccatgtgtgtaaagcagcaggcgcagacgtgccgtctgaaaatgctgccaatatcgaaacacatgaatttggcggcccgcatcctgccggcttgagtggcacgcacattcatttcatcgagccagtcggcgcgaataaaaccgtgtggaccatcaattatcaagacgtgattgctatcggacgtttgttcgtaacaggccgtctgaataccgagcgcgtggttgccttgggcggcctgcaagtcaacaaaccgcgcctcttgcgtaccgttttgggtgcgaaggtgtctcaacttaccgccggcgaattggttgacgcggacaaccgcgtgatttccggttcggtattgaacggtgcgattgcacaaggcgcgcatgattatttgggacgctaccacaatcagatttccgttatcgaagaaggccgcagcaaagagctgttcggctgggttgcgccgcagccggacaaatactccatcacgcgcaccactctcggccatttcctaaaaaacaaactcttcaagttcacgacagccgtcaacggcggcgaccgcgccatggtaccgatcggcacttatgagcgcgtaatgccgttggacatcctgcctaccttgcttttgcgcgatttaatcgtcggcgataccgacagcgcgcaggctttgggttgcttggaattggacgaagaagacctcgctttgtgcagcttcgtctgcccgggcaaatacgaatacggcccgctgttgcgcaaagtgctggaaaccattgagaaggaaggctga

SEQ ID NO: 132 - protein, 447 aa, Neisseria gonorrhoeae
MIKIKKGLNLPIAGRPEQVIYDGPAITEVALLGEEYVGMRPSMKIKEGEAVKKGQVLFEDKKNPGVVFTAPASGKIAAIHRGEKRVLQSVVIAVEGNDEIEFERYVPEALAKLSSEKVRRNLIQSGLWTALRTRPFSKIPAVDAEPFAIFVNAMDTNPLAADPTVIIKEAAEDFKRGLLVLSRLTERKIHVCKAAGADVPSENAANIETHEFGGPHPAGLSGTHIHFIEPVGANKTVWTINYQDVIAIGRLFVTGRLNTERVVALGGLQVNKPRLLRTVLGAKVSQLTAGELVDADNRVISGSVLNGAIAQGAHDYLGRYHNQISVIEEGRSKELFGWVAPQPDKYSITRTTLGHFLKNKLFKFTTAVNGGDRAMVPIGTYERVMPLDILPTLLLRDLIVGDTDSAQALGCLELDEEDLALCSFVCPGKYEYGPLLRKVLETIEKEG

SEQ ID NO: 133 - DNA, 961 bp, Neisseria meningitidis
  misc_feature (4)..(4): N= Unknown
  misc_feature (7)..(7): N= Unknown
  misc_feature (23)..(23): N= Unknown
gcgncgnaaatcatccatccccnacgtcgtaggccctgaagccaactggttttttatggtagccagtacgtttgtgattgctttgattggttattttgttactgaaaaaatcgtcgaaccgcaattgggcccttatcaatcagatttgtcacaagaagaaaaagacattcggcattccaatgaaatcacgcctttggaatataaaggattaatttgggctggcgtggtgtttgttgccttatccgccctattggcttggagcatcgtccctgccgacggtattttgcgtcatcctgaaacaggattggtttccggttcgccgtttttaaaatcgattgttgtttttattttcttgttgtttgcactgccgggcattgtttatggccgggtaacccgaagtttgcgcggcgaacaggaagtcgttaatgcgmyggccgaatcgatgagtactctggsgctttmtttgswcakcatcttttttgccgcacagtttgtcgcattttttaattggacgaatattgggcaatatattgccgttaaaggggcgacgttcttaaaagaagtcggcttgggcggcagcgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtgrkcmmmtacaaaaaagatgcgggcgtgggtacgctgattwctatgatgttgccgtattccgctttcttcttgattgcgtggattgccttattctgcatttgggtatttgttttgggcctgcccgtcggtcccggcgcgcccacattctatcccgcaccttaa

SEQ ID NO: 134 - protein, 320 aa, Neisseria meningitidis
  misc_feature (2)..(3): Xaa=  any amino acid
  misc_feature (8)..(9): Xaa=  any amino acid
  misc_feature (145)..(145): Xaa=  any amino acid
  misc_feature (153)..(153): Xaa=  any amino acid
  misc_feature (155)..(155): Xaa=  any amino acid
  misc_feature (157)..(158): Xaa=  any amino acid
  misc_feature (268)..(269): Xaa=  any amino acid
  misc_feature (281)..(281): Xaa=  any amino acid
AXXIIHPXXVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALPGIVYGRVTRSLRGEQEVVNAXAESMSTLXLXLXXIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVXXYKKDAGVGTLIXMMLPYSAFFLIAWIALFCIWVFVLGLPVGPGAPTFYPAP

SEQ ID NO: 135 - DNA, 1569 bp, Neisseria meningitidis
atgagtcaaaccgatacgcaacgggacggacgatttttacgcacagtcgaatggctgggcaatatgttgccgcatccggttacgctttttattattttcattgtgttattgctgattgcctctgccgtcggtgcgtatttcggactatccgtccccgatccgcgccctgttggtgcgaaaggacgtgccgatgacggtttgatttacattgtcagcctgctcaatgccgacggttttatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatcgccacgcaaactcactacttttatggttgtttttacagggattttatctaataccgcttctgaattgggctatgtcgtcctaatccctttgtccgccatcatctttcattccctcggccgccatccgcttgccggtctggctgcggctttcgccggcgtttcgggcggttattcggccaatctgttcttaggcacaatcgatccgctcttggcaggcatcacccaacaggcggcgcaaatcatccatcccgactacgtcgtaggccctgaagccaactggttttttatggtagccagtacgtttgtgattgctttgattggttattttgttactgaaaaaatcgtcgaaccgcaattgggcccttatcaatcagatttgtcacaagaagaaaaagacattcggcattccaatgaaatcacgcctttggaatataaaggattaatttgggctggcgtggtgtttgttgccttatccgccctattggcttggagcatcgtccctgccgacggtattttgcgtcatcctgaaacaggattggtttccggttcgccgtttttaaaatcgattgttgtttttattttcttgttgtttgcactgccgggcattgtttatggccgggtaacccgaagtttgcgcggcgaacaggaagtcgttaatgcgatggccgaatcgatgagtactctggggctttatttggtcatcatcttttttgccgcacagtttgtcgcattttttaattggacgaatattgggcaatatattgccgttaaaggggcgacgttcttaaaagaagtcggcttgggcggcagcgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtgatcaaatacaaaaaagatgcgggcgtgggtacgctgatttctatgatgttgccgtattccgctttcttcttgattgcgtggattgccttattctgcatttgggtatttgttttgggcctgcccgtcggtcccggcgcgcccacattctatcccgcaccttaa

SEQ ID NO: 136 - protein, 522 aa, Neisseria meningitidis
MSQTDTQRDGRFLRTVEWLGNMLPHPVTLFIIFIVLLLIASAVGAYFGLSVPDPRPVGAKGRADDGLIYIVSLLNADGFIKILTHTVKNFTGFAPLGTVLVSLLGVGIAEKSGLISALMRLLLTKSPRKLTTFMVVFTGILSNTASELGYVVLIPLSAIIFHSLGRHPLAGLAAAFAGVSGGYSANLFLGTIDPLLAGITQQAAQIIHPDYVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALPGIVYGRVTRSLRGEQEVVNAMAESMSTLGLYLVIIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVIKYKKDAGVGTLISMMLPYSAFFLIAWIALFCIWVFVLGLPVGPGAPTFYPAP

SEQ ID NO: 137 - DNA, 1569 bp, Neisseria meningitidis
atgagtcaaaccgatacgcaacgggacggacgatttttacgcacagtcgaatggctgggcaatatgttgccgcacccggttacgctttttattattttcattgtgttattgctgattgcctctgccgccggtgcgtatttcggactatccgtccccgatccgcgccctgttggtgcgaaaggacgtgccgatgacggtttgattcacgttgtcagcctgctcgatgctgacggtttgatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatctccacgcaaactcactacttttatggttgtttttacagggattttatctaataccgcttctgaattgggctatgtcgtcctaatccctttgtccgccatcatctttcattccctcggccgccatccgcttgccggtctggctgcggctttcgccggcgtttcgggcggttattcggccaatctgttcttaggcacaatcgatccgctcttggcaggcatcacccaacaggcggcgcaaatcatccatcccgactacgtcgtaggccctgaagccaactggttttttatggtagccagtacgtttgtgattgctttgattggttattttgttactgaaaaaatcgtcgaaccgcaattgggcccttatcaatcagatttgtcacaagaagaaaaagacattcgacattccaatgaaatcacgcctttggaatataaaggattaatttgggctggcgtggtgtttgttgccttatccgccctattggcttggagcatcgtccctgccgacggtattttgcgtcatcctgaaacaggattggtttccggttcgccgtttttaaaatcaattgttgtttttattttcttgttgtttgcactgccgggcattgtttatggccgggtaacccgaagtttgcgcggcgaacaggaagtcgttaatgcgatggccgaatcgatgagtactctggggctttatttggtcatcatcttttttgccgcacagtttgtcgcattttttaattggacgaatattgggcaatatattgccgttaaaggggcgacgttcttaaaagaagtcggcttgggcggcagcgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtgatcaaatacaaaaaagatgcgggcgtgggtacgctgatttctatgatgttgccgtattccgctttcttcttgattgcgtggattgccttattctgcatttgggtatttgttttgggcctgcccgtcggtcccggcgcgcccacattctatcccgcaccttaa

SEQ ID NO: 138 - protein, 522 aa, Neisseria meningitidis
MSQTDTQRDGRFLRTVEWLGNMLPHPVTLFIIFIVLLLIASAAGAYFGLSVPDPRPVGAKGRADDGLIHVVSLLDADGLIKILTHTVKNFTGFAPLGTVLVSLLGVGIAEKSGLISALMRLLLTKSPRKLTTFMVVFTGILSNTASELGYVVLIPLSAIIFHSLGRHPLAGLAAAFAGVSGGYSANLFLGTIDPLLAGITQQAAQIIHPDYVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALPGIVYGRVTRSLRGEQEVVNAMAESMSTLGLYLVIIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVIKYKKDAGVGTLISMMLPYSAFFLIAWIALFCIWVFVLGLPVGPGAPTFYPAP

SEQ ID NO: 139 - DNA, 1569 bp, Neisseria gonorrhoeae
atgagtcaaaccgacgcgcgtcgtagcggacgatttttacgcacagtcgaatggctgggcaatatgttgccgcacccggttacgctttttattattttcattgtgttattgctgattgcctctgccgtcggtgcgtatttcggactatccgtccccgatccgcgtcctgttggggcgaaaggacgtgccgatgacggtttgattcacgttgtcagcctgctcgatgccgacggtttgatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatccccacgcaaactcactacttttatggttgtttttacagggattttatccaatacggcttctgaattgggctatgtcgtcctaatccctttgtccgccgtcatctttcattcgctcggccgccatccgcttgccggtttggctgcggctttcgccggcgtttcgggcggttattcggccaatctgttcttaggcacaatcgatccgctcttggcaggcatcacccaacaggcggcgcaaatcatccatcccgactacgtcgtaggccctgaagccaactggttttttatggcagccagtacgtttgtgattgctttgattggttattttgttactgaaaaaatcgtcgaaccgcaattgggcccttatcaatcagatttgtcacaagaagaaaaagacattcggcattccaatgaaatcacgcctttggaatataaaggattaatttgggcaggcgtggtgtttgttgccttatccgccctattggcttggagcatcgtccctgccgacggtattttgcgtcatcctgaaacaggattggttgccggttcgccgtttttaaaatcgattgttgtttttattttcttgttgtttgcgctgccgggcattgtttatggccggataacccgaagtttgcgcggcgaacgggaagtcgttaatgcgatggccgaatcgatgagtactttgggactttatttggtcatcatcttttttgccgcacagtttgtcgcattttttaattggacgaatattgggcaatatattgccgttaaaggggcggtgttcttaaaagaagtcggcttgggcggcagtgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtaatcaaatacaaaaaagatgcgggcgtaggcacgctgatttctatgatgttgccgtattccgctttcttcttaattgcatggatcgccttattctgcatttgggtatttgttttgggtctgcccgtcggtcccggcacacccacattctatccggtgccttaa

SEQ ID NO: 140 - protein, 522 aa, Neisseria gonorrhoeae
MSQTDARRSGRFLRTVEWLGNMLPHPVTLFIIFIVLLLIASAVGAYFGLSVPDPRPVGAKGRADDGLIHVVSLLDADGLIKILTHTVKNFTGFAPLGTVLVSLLGVGIAEKSGLISALMRLLLTKSPRKLTTFMVVFTGILSNTASELGYVVLIPLSAVIFHSLGRHPLAGLAAAFAGVSGGYSANLFLGTIDPLLAGITQQAAQIIHPDYVVGPEANWFFMAASTFVIALIGYFVTEKIVEPQLGPYQSDLSQEEKDIRHSNEITPLEYKGLIWAGVVFVALSALLAWSIVPADGILRHPETGLVAGSPFLKSIVVFIFLLFALPGIVYGRITRSLRGEREVVNAMAESMSTLGLYLVIIFFAAQFVAFFNWTNIGQYIAVKGAVFLKKFRLGGSVLFIGFILICAFINLMIGSASAQWAVTAPIFVPMLMLAGNAPQVIQAAYRIGDSVTNIITPMMSYFGLIMATVIKYKKDAGVGTLISMMLPYSAFFLIAWIALFCIWVFVLGLPVGPGTPTFYPVP

SEQ ID NO: 141 - DNA, 503 bp, Neisseria meningitidis
  misc_feature (20)..(20): N= Unknown
  misc_feature (22)..(22): N= Unknown
  misc_feature (459)..(459): N= Unknown
acagccggcgcagcaggttncncggtcttcgttttcgtaacggacagtcaggtggaggtgttcgggaacatccagaccgcagtggaaacaggtttttttcatggcatttcggtttcgtctgtgtttggtgcggcggcacaagactcggcaatggcttcgcgcagtgcgtctataccggtattttcagcaacggaaatgcggacggcggcaatttttcccgcagcgtcgcgccatatgcccgtgttttgttcttcagacggcagcaggtcggttttgttgtacaccttgatgcacggaatatcgccggcatggatttcttgcagtacgttttccacgtcttcaatctgctgtccgctgttcggagcggcggcatcgacgacgtgcagcagcacatcggcttgcgcggtttcttccagcgtggcggaaaaggcggaaatcagtttgtgcggcagatygctnacgaatccgacggtatcggtcaggataatgctgcattcgggact

SEQ ID NO: 142 - protein, 167 aa, Neisseria meningitidis
  misc_feature (7)..(8): Xaa= any amino acid
  misc_feature (152)..(152): Xaa= any amino acid
TAGAAGXXVFVFVTDSQVEVFGNIQTAVETGFFHGISVSSVFGAAAQDSAMASRSASIPVFSATEMRTAAIFPAASRHMPVFCSSDGSRSVLLYTLMHGISPAWISCSTFSTSSICCPLFGAAASTTCSSTSACAVSSSVAEKAEISLCGRXLTNPTVSVRIMLHSG

SEQ ID NO: 143 - DNA, 1149 bp, Neisseria meningitidis
atggaggatttgcaggaaatcgggttcgatgtcgccgccgtaaaggtaggtcggcagcgcgaacatcatcgtctgcatcatccccagcccggcaacggcgaggcggacgatgtattgtttgcgttctttttggttggcggcttcgattttttgcgcgtcatagggtgcggcggtgtagcctatctgcctgattttcaacagaatgtcggaaaggcggattttgccgtcgtcccagacgacgcggcagcggtgcgtgctgtaattgaggtcgatgcggacgatgccgtctgtacgcaaaagctgctgttcgatcagccagacgcaggcggcgcaggtgatgccgccgagcattaaaaccgcctcgcgcgtgccgccgtgggtttccacaaagtcggactggacttcgggcaggtcgtacaggcggatttggtcgaggatttcttggggcggcagctcggttttttgcgcgtcggcggtgcgttgtttgtaataactgcccaagcccgcgtcaataatgctttgtgcgactgcctgacaaccggcgcagcaggtttcgcggtcttcgttttcgtaacggacggtcagatgcaggttttcgggaacgtccagcccgcagtggaaacaggtttttttcatggcatttcggtttcgtctgtgtttggtgcggcggcacaatactcggcaatggcttcgcgcagtgcgtctataccggtattttcagcaacggaaatgcggacggcggcaatttttcccgcagcgtcgcgccatatgcccgtgttttgttcttcagacggcagcaggtcggttttgttgtacaccttgatgcacggaatatcgccggcatggatttcttgcagtacgttttccacgtcttcaatctgctgtccgctgttcggagcggcggcatcgacgacgtgcagcagcacatcggcttgcgcggtttcttccagcgtggcggaaaaggcggaaatcagtttgtgcggcagatcgctgacgaatccgacggtatcggtcaggataatgctgcattcgggactgatgtacagccgccgcgccgtcgtgtcgagtgtggcgaaaagctggtctttcgcatatatgcccgacttggtcagccggttgaacagactggatttgccgacattggtatag

SEQ ID NO: 144 - protein, 381 aa, Neisseria meningitidis
MEDLQEIGFDVAAVKVGRQREHHRLHHPQPGNGEADDVLFAFFLVGGFDFLRVIGCGGVAYLPDFQQNVGKADFAVVPDDAAAVRAVIEVDADDAVCTQKLLFDQPDAGGAGDAAEHNRLARAAVGFHKVGLDFGQVVQADLVEDFLGRQLGFLRVGGALFVITAQARVNNALCDCLTTGAAGFAVFVFVTDGQMQVFGNVQPAVETGFFHGISVSSVFGAAAQYSAMASRSASIPVFSATEMRTAAIFPAASRHMPVFCSSDGSRSVLLYTLMHGISPAWISCSTFSTSSICCPLFGAAASTTCSSTSACAVSSSVAEKAEISLCGRSLTNPTVSVRIMLHSGLMYSRRAVVSSVAKSWSFAYMPDLVSRLNRLDLPTLV

SEQ ID NO: 145 - DNA, 8 bp, Neisseria gonorrhoeae
  misc_feature (1)..(8): N= Unknown
nnnnnnnn

SEQ ID NO: 146 - protein, 382 aa, Neisseria gonorrhoeae
MEDLQEIGFDVAAVKVGRQREHHRLHHTQSGNGKADDVLFAFFLVGGFDFLRVIGCGGVACLPDFQQNVGEADFAVVPDDAAAVRAVIEVDADDAVCAQKLLFDQPDAGGAGNAAEHQHCFVRAIMGFHKVGLDFGQVVQADLVEDFLGRQFGFFRVGGASFVITAQAGIDDALCDCLTADAAGFAVFAFVADGQMQVFGNVQPAVETGFFHGISVSSVFGAAAQYSAMASRSASIPVFSATEMRTAAIFPAASRHMPVFCSSDGSRSVLLYTLMHGISWAWISCSTFSTSSICCPLFRAAASTTCSSTSACTVSSKVAEKAEISLCGRSLTNPTVSVRIMLHAGLMYSRRAVVSRVAKSWSFAYMPDLVSRLNRLDLPTLV

SEQ ID NO: 147 - DNA, 542 bp, Neisseria meningitidis
  misc_feature (38)..(38): N= Unknown
  misc_feature (254)..(254): N= Unknown
  misc_feature (356)..(356): N= Unknown
  misc_feature (458)..(458): N= Unknown
ggccattactccgaccgcacttggaagccgcgtttggncggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaantacgcctacgggattcaaagtttcttagcaaatacgggcgcggtcgtggcggcgattctgccgtttgtgtttgcgtatatcggtttggcgaacaccgccganaaaggcgttgtgccgcagaccgtggtcgtggcgttttatgtgggtgcggcgttgctggtgattaccagcgcgttcacgattttcaaagtgaaggaatacganccggaaacctacgcccgttaccacggcatcgatgtcgccgcgaatcaggaaaaagccaactggatcgcactcttaaaaccgcgc

SEQ ID NO: 148 - protein, 181 aa, Neisseria meningitidis
  misc_feature (13)..(13): Xaa= any amino acid
  misc_feature (85)..(85): Xaa= any amino acid
  misc_feature (119)..(119): Xaa= any amino acid
  misc_feature (153)..(153): Xaa= any amino acid
  misc_feature (180)..(180): Xaa= any amino acid
GHYSDRTWKPRLXGRRLPYLLYGTLIAVIVMILMPNSGSFGFGYASLAALSFGALMIALLDVSSNMAMQPFKMMVGDMVNEEQKXYAYGIQSFLANTGAVVAAILPFVFAYIGLANTAXKGVVPQTVVVAFYVGAALLVITSAFTIFKVKEYXPETYARYHGIDVAANQEKANWIALLKXA

SEQ ID NO: 149 - DNA, 1356 bp, Neisseria meningitidis
atgtcggaatatacgcctcaaacagcaaaacaaggtttgcccgcgctggcaaaaagcacgatttggatgctcagtttcggctttctcggcgttcagacggcctttaccctgcaaagctcgcaaatgagccgcatttttcaaacgctaggcgcagacccgcacaatttgggctggtttttcatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcaaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacgatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcttgtttaacggctctatctgtatgcctcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 150 - protein, 451 aa, Neisseria meningitidis
MSEYTPQTAKQGLPALAKSTIWMLSFGFLGVQTAFTLQSSQMSRIFQTLGADPHNLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYDPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 151 - DNA, 1356 bp, Neisseria meningitidis
atgtcggaatatacgcctcaaacagcaaaacaaggtttgcccgcgctggcaaaaagcacgatttggatgctcagtttcggctttctcggcgttcagacggcctttaccctgcaaagctcgcagatgagccgcatcttccagacgctcggtgccgatccgcacagcctcggctggttctttatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcgaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacaatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcctgtttaacggctctatctgtatgccgcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 152 - protein, 451 aa, Neisseria meningitidis
MSEYTPQTAKQGLPALAKSTIWMLSFGFLGVQTAFTLQSSQMSRIFQTLGADPHSLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYNPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 153 - DNA, 1020 bp, Neisseria gonorrhoeae
atgataggggatcgccgcgccggcaaccatttcggattttccaaagcaaatacttttcaaatcaaaaaaaaggatttactttatgtcggaatatacgcctcaaacagcaaaacaaggtttgcccgcgccggcaaaaagcacgatttggatgttgagcttcggctatctcggcgttcagacggcctttaccctgcaaagctcgcagatgagccgcatttttcaaacgctaggcgcagacccgcacaatttgggctggtttttcatcctgccgccgctggcggggatgctggttcagccgatagtggctactactcagaccgcacttggaagccgcgcttgggcggccgccgcctgccgtatctgctttacggcacgctgattgcggtcatcgtgatgattttgatgccgaactcgggcagcttcggtttcggctatgcgtcgctggcggccttgtcgttcggcgcgctgatgattgcgctgttggacgtgtcgtcgaatatggcgatgcagccgtttaagatgatggtcggcgatatggtcaacgaggagcagaaaagctacgcctacgggattcaaagtttcttagcgaatacggacgcggttgtggcagcgattctgccgtttgtgttcgcgtatatcggtttggcgaacactgccgagaaaggcgttgtgccacaaaccgtggtcgtagcattctatgtgggtgcggcgttactgattattaccagtgcgttcacaatctccaaagtcaaagaatacgacccggaaacctacgcccgttaccacggcatcgatgtcgccgcgaatcaggaaaaagccaactggttcgaactcttaaaaaccgcgcctaaagtgttttggacggttactccggtacagtttttctgctggttcgccttccggtatatgtggacttactcggcaggcgcgattgcagaaaacgtctggcacactaccgatgcgtcttccgtaggccatcaggaggcgggcaaccggtacggcgttttggcggcggtgtag

SEQ ID NO: 154 - protein, 339 aa, Neisseria gonorrhoeae
MIGDRRAGNHFGFSKANTFQIKKKDLLYVGIYASNSKTRFARAGKKHDLDVELRLSRRSDGLYPAKLADEPHFSNARRRPAQFGLVFHPAAAGGDAGSADSGYYSDRTWKPRLGGRRLPYLLYGTLIAVIVMILMPNSGSFGFGYASLAALSFGALMIALLDVSSNMAMQPFKMMVGDMVNEEQKSYAYGIQSFLANTDAVVAAILPFVFAYIGLANTAEKGVVPQTVVVAFYVGAALLIITSAFTISKVKEYDPETYARYHGIDVAANQEKANWFELLKTAPKVFWTVTPVQFFCWFAFRYMWTYSAGAIAENVWHTTDASSVGHQEAGNRYGVLAAV

SEQ ID NO: 155 - DNA, 358 bp, Neisseria meningitidis
  misc_feature (111)..(111): N= Unknown
  misc_feature (122)..(122): N= Unknown
  misc_feature (138)..(138): N= Unknown
  misc_feature (140)..(140): N= Unknown
  misc_feature (243)..(243): N= Unknown
  misc_feature (251)..(251): N= Unknown
  misc_feature (259)..(259): N= Unknown
  misc_feature (291)..(291): N= Unknown
  misc_feature (344)..(344): N= Unknown
atgttgttccgtaaaacgaccgccgccgttttggcgcataccttgatgctgaacggctgtacgttgatgttgtggggaatgaacaacccggtcagcgaaacaatcacccgnaaacacgttgncaaagaccaaatccgngncttcggtgtggttgccgaagacaatgcccaattggaaaagggcagcctggtgatgatgggcggaaaatactggttcgtcgtcaatcccgaagattcggcgaantgacgggnattttganggcagggctggacaaacccttccaaatagttnaggataccccgagctatgctgccaccaagccctgccggtcaaactcggatcgnctggcagccagaat

SEQ ID NO: 156 - protein, 120 aa, Neisseria meningitidis
  misc_feature (41)..(41): Xaa= any amino acid
  misc_feature (47)..(47): Xaa= any amino acid
  misc_feature (81)..(82): Xaa= any amino acid
  misc_feature (87)..(87): Xaa= any amino acid
  misc_feature (98)..(98): Xaa= any amino acid
  misc_feature (104)..(104): Xaa= any amino acid
  misc_feature (116)..(116): Xaa= any amino acid
MLFRKTTAAVLAHTLMLNGCTLMLWGMNNPVSETITRKHVXKDQIRXFGVVAEDNAQLEKGSLVMMGGKYWFVVNPEDSAXXTGILXAGLDKPFQIVXDTPSYXCHQALPVKLGSXGSQN

SEQ ID NO: 157 - DNA, 717 bp, Neisseria meningitidis
atgttgttccgtaaaacgaccgccgccgttttggcggcaaccttgatgctgaacggctgtacgttgatgttgtggggaatgaacaacccggtcagcgaaacaatcacccgcaaacacgttgacaaagaccaaatccgcgccttcggtgtggttgccgaagacaatgcccaattggaaaagggcagcctggtgatgatgggcggaaaatactggttcgtcgtcaatcccgaagattcggcgaagctgacgggcattttgaaggcagggctggacaaacccttccaaatagttgaggataccccgagctatgctcgccaccaagccctgccggtcaaactcgaatcgcctggcagccagaatttcagtaccgaaggcctttgcctgcgctacgataccgacaagcctgccgacatcgccaagctgaaacagctcgggtttgaagcggtcaaactcgacaatcggaccatttacacgcgctgcgtatccgccaaaggcaaatactacgccacaccgcaaaaactgaacgccgattaccattttgagcaaagtgtgcctgccgatatttattacacggttactgaagaacataccgacaaatccaagctgtttgcaaatatcttatatacgcccccctttttgatactggatgcggcgggcgcggtactggccttgcctgcggcggctctgggtgcggtcgtggatgccgcccgcaaatga

SEQ ID NO: 158 - protein, 238 aa, Neisseria meningitidis
MLFRKTTAAVLAATLMLNGCTLMLWGMNNPVSETITRKHVDKDQIRAFGVVAEDNAQLEKGSLVMMGGKYWFVVNPEDSAKLTGILKAGLDKPFQIVEDTPSYARHQALPVKLESPGSQNFSTEGLCLRYDTDKPADIAKLKQLGFEAVKLDNRTIYTRCVSAKGKYYATPQKLNADYHFEQSVPADIYYTVTEEHTDKSKLFANILYTPPFLILDAAGAVLALPAAALGAVVDAARK

SEQ ID NO: 159 - DNA, 714 bp, Neisseria meningitidis
atgttgttccgtaaaacgaccgccgccgttttggcggcaaccttgatgttgaacggctgtacggtaatgatgtggggtatgaacagcccgttcagcgaaacgaccgcccgcaaacacgttgacaaggaccaaatccgcgccttcggtgtggttgccgaagacaatgcccaattggaaaagggcagcctggtgatgatgggcgggaaatactggttcgtcgtcaatcctgaagattcggcgaagctgacgggcattttgaaggccgggttggacaagcagtttcaaatggttgagcccaacccgcgctttgcctaccaagccctgccggtcaaactcgaatcgcccgccagccagaatttcagtaccgaaggcctttgcctgcgctacgataccgacagacctgccgacatcgccaagctgaaacagcttgagtttgaagcggtcgaactcgacaatcggaccatttacacgcgctgcgtctccgccaaaggcaaatactacgccacaccgcaaaaactgaacgccgattatcattttgagcaaagtgtgcctgccgatatttattacacggttacgaaaaaacataccgacaaatccaagttgtttgaaaatattgcatatacgcccaccacgttgatactggatgcggtgggcgcggtgctggccttgcctgtcgcggcgttgattgcagccacgaattcctcagacaaatga

SEQ ID NO: 160 - protein, 237 aa, Neisseria meningitidis
MLFRKTTAAVLAATLMLNGCTVMMWGMNSPFSETTARKHVDKDQIRAFGVVAEDNAQLEKGSLVMMGGKYWFVVNPEDSAKLTGILKAGLDKQFQMVEPNPRFAYQALPVKLESPASQNFSTEGLCLRYDTDRPADIAKLKQLEFEAVELDNRTIYTRCVSAKGKYYATPQKLNADYHFEQSVPADIYYTVTKKHTDKSKLFENIAYTPTTLILDAVGAVLALPVAALIAATNSSDK

SEQ ID NO: 161 - DNA, 714 bp, Neisseria gonorrhoeae
atgttgttccgtaaaacgaccgccgccgttttggcggcaaccttgatactgaacggctgtacgatgatgttgcgggggatgaacaacccggtcagccaaacaatcacccgcaaacacgttgacaaagaccaaatccgcgccttcggtgtggttgccgaagacaatgcccaattggaaaagggcagcctggtgatgatgggcgggaaatactggttcgccgtcaatcccgaagattcggcgaagctgacgggccttttgaaggccgggttggacaagcccttccaaatagttgaggataccccgagctatgcccgccaccaagccctgccggtcaaattcgaagcgcccggcagccagaatttcagtaccggaggtctttgcctgcgctatgataccggcagacctgacgacatcgccaagctgaaacagcttgagtttaaagcggtcaaactcgacaatcggaccatttacacgcgctgcgtatccgccaaaggcaaatactacgccacgccgcaaaaactgaacgccgattatcattttgagcaaagtgtgcccgccgatatttattatacggttactgaaaaacataccgacaaatccaagctgtttggaaatatcttatatacgccccccttgttgatattggatgcggcggccgcggtgctggtcttgcctatggctctgattgcagccgcgaattcctcagacaaatga

SEQ ID NO: 162 - protein, 237 aa, Neisseria meningitidis
MLFRKTTAAVLAATLILNGCTMMLRGMNNPVSQTITRKHVDKDQIRAFGVVAEDNAQLEKGSLVMMGGKYWFAVNPEDSAKLTGLLKAGLDKPFQIVEDTPSYARHQALPVKFEAPGSQNFSTGGLCLRYDTGRPDDIAKLKQLEFKAVKLDNRTIYTRCVSAKGKYYATPQKLNADYHFEQSVPADIYYTVTEKHTDKSKLFGNILYTPPLLILDAAAAVLVLPMALIAAANSSDK

SEQ ID NO: 163 - DNA, 374 bp, Neisseria meningitidis
gtcagtcctgtactgcctattacacacgaacggacagggtttgaaggtgttatcggttatgaaacccatttttcagggcacggacatgaagtacacagtccgttcgatcatcatgattcaaaaagcacttctgatttcagcggcggtgtagacggcggttttactgtttaccaacttcatcgaacatggtcggaaatccatccggaggatgaatatgacgggccgcaagcagcgattatccgccccccggaggagcaagggatatatacagctattatgtcaaaggaacttcaacaaaaacaaagactagtattgtccctcaagccccattttcagaccgttggctagaagaaaatgccggtgccgcctctggt

SEQ ID NO: 164 - protein, 125 aa, Neisseria meningitidis
  misc_feature (79)..(79): Xaa= any amino acid
VSPVLPITHERTGFEGVIGYETHFSGHGHEVHSPFDHHDSKSTSDFSGGVDGGFTVYQLHRTWSEIHPEDEYDGPQAAXYPPPGGARDIYSYYVKGTSTKTKTSIVPQAPFSDRWLEENAGAASG

SEQ ID NO: 165 - DNA, 1452 bp, Neisseria meningitidis
atgaatttgcctattcaaaaattcatgatgctgtttgcagcagcaatatcgttgctgcaaatccccattagtcatgcgaacggtttggatgcccgtttgcgcgatgatatgcaggcaaaacactacgaaccgggtggtaaataccatctgtttggtaatgctcgcggcagtgttaaaaagcgggtttacgccgtccagacatttgatgcaactgcggtcagtcctgtactgcctattacacacgaacggacagggtttgaaggtgttatcggttatgaaacccatttttcagggcacggacatgaagtacacagtccgttcgatcatcatgattcaaaaagcacttctgatttcagcggcggtgtagacggcggttttactgtttaccaacttcatcgaacagggtcggaaatccatccggaggatggatatgacgggccgcaaggcagcgattatccgccccccggaggagcaagggatatatacagctattatgtcaaaggaacttcaacaaaaacaaagactaatattgtccctcaagccccattttcagaccgttggctaaaagaaaatgccggtgccgcctctggttttttcagccgtgcggatgaagcaggaaaactgatatgggaaagcgaccccaataaaaattggtgggctaaccgtatggatgatgttcgcggcatcgtccaaggtgcggttaatccttttttaatgggttttcaaggagtagggattggggcaattacagacagtgcagtaagcccggtcacagatacagccgcgcagcagactctacaaggtattaatgatttaggaaaattaagtccggaagcacaacttgctgccgcgagcctattacaggacagtgcttttgcggtaaaagacggtatcaactctgccaaacaatgggctgatgcccatccaaatataacagctactgcccaaactgccctttccgcagcagaggccgcaggtacggtttggagaggtaaaaaagtagaacttaacccgactaaatgggattgggttaaaaataccggttataaaaaacctgctgcccgccatatgcagactttagatggggagatggcaggtgggaataaacctattaaatctttaccaaacagtgccgctgaaaaaagaaaacaaaattttgagaagtttaatagtaactggagttcagcaagttttgattcagtgcacaaaacactaactcccaatgcacctggtattttaagtcctgataaagttaaaactcgatacactagtttagatggaaaaattacaattataaaagataacgaaaacaactattttagaatccatgataattcacgaaaacagtatcttgattcaaatggtaatgctgtgaaaaccggtaatttacaaggtaagcaagcaaaagattatttacaacaacaaactcatatcaggaacttagacaaatga

SEQ ID NO: 166 - protein, 483 aa, Neisseria meningitidis
MNLPIQKFMMLFAAAISLLQIPISHANGLDARLRDDMQAKHYEPGGKYHLFGNARGSVKKRVYAVQTFDATAVSPVLPITHERTGFEGVIGYETHFSGHGHEVHSPFDHHDSKSTSDFSGGVDGGFTVYQLHRTGSEIHPEDGYDGPQGSDYPPPGGARDIYSYYVKGTSTKTKTNIVPQAPFSDRWLKENAGAASGFFSRADEAGKLIWESDPNKNWWANRMDDVRGIVQGAVNPFLMGFQGVGIGAITDSAVSPVTDTAAQQTLQGINDLGKLSPEAQLAAASLLQDSAFAVKDGINSAKQWADAHPNITATAQTALSAAEAAGTVWRGKKVELNPTKWDWVKNTGYKKPAARHMQTLDGEMAGGNKPIKSLPNSAAEKRKQNFEKFNSNWSSASFDSVHKTLTPNAPGILSPDKVKTRYTSLDGKITIIKDNENNYFRIHDNSRKQYLDSNGNAVKTGNLQGKQAKDYLQQQTHIRNLDK

SEQ ID NO: 167 - DNA, 1449 bp, Neisseria meningitidis
  misc_feature (8)..(8): N= Unknown
  misc_feature (53)..(53): N= Unknown
  misc_feature (66)..(66): N= Unknown
  misc_feature (488)..(489): N= Unknown
  misc_feature (492)..(492): N= Unknown
  misc_feature (807)..(807): N= Unknown
  misc_feature (822)..(822): N= Unknown
  misc_feature (969)..(969): N= Unknown
  misc_feature (1041)..(1041): N= Unknown
  misc_feature (1050)..(1050): N= Unknown
  misc_feature (1193)..(1197): N= Unknown
  misc_feature (1306)..(1306): N= Unknown
  misc_feature (1351)..(1351): N= Unknown
  misc_feature (1365)..(1365): N= Unknown
atgaattngcctattcaaaaattcatgatgctgtttgcagcagcaatatcgtngctgcaaatcccnattagtcatgcgaacggtttggatgcccgtttgcgcgatgatatgcaggcaaaacactacgaaccgggtggtaaataccatctgtttggtaatgctcgcggcagtgttaaaaatcgggtttacgccgtccaaacatttgatgcaactgcggtcggccccatactgcctattacacacgaacggacaggatttgaaggcattatcggttatgaaacccatttttcaggacatggacatgaagtacacagtccgttcgataatcatgattcaaaaagcacttctgatttcagcggcggcgtagacggtggttttaccgtttaccaacttcatcggacagggtcggaaatccatccggaggatggatatgacgggccgcaaggcagcgattatccgccccccggaggagcaagggatatatacanntantatgtcaaaggaacttcaacaaaaacaaagagtaatattgttccccgagccccattttcagaccgctggctaaaagaaaatgccggtgccgcctctggttttttcagccgtgctgatgaagcaggaaaactgatatgggaaagcgaccccaataaaaattggtgggctaaccgtatggatgatattcgcggcatcgtccaaggtgcggttaatccttttttaatgggttttcaaggagtagggattggggcaattacagacagtgcagtaagcccggtcacagatacagccgcgcagcagactctacaaggtatnaatcatttaggaaanttaagtcccgaagcacaacttgcggctgcaaccgcattacaagacagtgcttttgcggtaaaagacggtatcaattccgccagacaatgggctgatgcccatccgaatataactgcaacagcccaaactgcccttgccgtagcagangccgcaactacggtttggggcggtaaaaaagtagaacttaacccgaccaaatgggattgggttaaaaatacnggctataanacacctgctgttcgcaccatgcatactttggatggggaaatggccggtgggaatagaccgcctaaatctataacgtccaacagcaaagcagatgcttccacacaaccgtctttacaagcgcaactaattggagaacaaattannnnngggcatgcttataacaagcatgtcataagacaacaagaatttacggatttaaatatcaattcaccagcagattttgctcggcatattgaaaatattgttagccatccancaaatatgaaagagttacctcgcggtagaactgcgtattgggatnataaaacagggacnatagttatccgagataaaaattctgacgatggaggtacagcatttagaccaacatcaggtaaaaaatattatgatgatttatag

SEQ ID NO: 168 - protein, 482 aa, Neisseria meningitidis
  misc_feature (3)..(3): Xaa= any amino acid
  misc_feature (18)..(18): Xaa= any amino acid
  misc_feature (163)..(164): Xaa= any amino acid
  misc_feature (269)..(269): Xaa= any amino acid
  misc_feature (274)..(274): Xaa= any amino acid
  misc_feature (323)..(323): Xaa= any amino acid
  misc_feature (350)..(350): Xaa= any amino acid
  misc_feature (398)..(399): Xaa= any amino acid
  misc_feature (436)..(436): Xaa= any amino acid
  misc_feature (451)..(451): Xaa= any amino acid
MNXPIQKFMMLFAAAISXLQIPISHANGLDARLRDDMQAKHYEPGGKYHLFGNARGSVKNRVYAVQTFDATAVGPILPITHERTGFEGIIGYETHFSGHGHEVHSPFDNHDSKSTSDFSGGVDGGFTVYQLHRTGSEIHPEDGYDGPQGSDYPPPGGARDIYXXYVKGTSTKTKSNIVPRAPFSDRWLKENAGAASGFFSRADEAGKLIWESDPNKNWWANRMDDIRGIVQGAVNPFLMGFQGVGIGAITDSAVSPVTDTAAQQTLQGXNHLGXLSPEAQLAAATALQDSAFAVKDGINSARQWADAHPNITATAQTALAVAXAATTVWGGKKVELNPTKWDWVKNTGYXTPAVRTMHTLDGEMAGGNRPPKSITSNSKADASTQPSLQAQLIGEQIXXGHAYNKHVIRQQEFTDLNINSPADFARHIENIVSHPXNMKELPRGRTAYWDXKTGTIVIRDKNSDDGGTAFRPTSGKKYYDDL

SEQ ID NO: 169 - DNA, 8 bp, Neisseria gonorrhoeae
  misc_feature (1)..(8): N= Unknown
nnnnnnnn

SEQ ID NO: 170 - protein, 468 aa, Neisseria gonorrhoeae
MNLPIQKFMMLFAAAISLLQIPISHANGLDARLRDDMQAKHYEPGGKYHLFGNARGSVKNRVCAVQTFDATAVGPILPITHERTGFEGVIGYETHFSGHGHEVHSPFDNHDSKSTSDFSGGVDGGFTVYQLHRTGSEIHPEDGYDGPQGGGYPPPGGARDIYSYHIKGTSTKTKINTVPQAPFSDRWLKENAGAASGFLSRADEAGKLIWENDPDKNWRANRMDDIRGIVQGAVNPFLTGFQGLGVGAITDSAVSPVTYAAARKTLQGIHNLGNLSPEAQLAAATALQDSAFAVKDSINSARQWADAHPNITATAQTALAVTEAATTVWGGKKVELNPAKWDWVKNTGYKKPAARHMQTVDGEMAGGNKPLESKNTVTTNNFFENTGYTEKVLRQASNGDYHGFPQSVDAFSENGTVIQIVGGDNIVRHKLYIPGSYKGKDGNFEYIREADGKINHRLFVPNQQLPEK

SEQ ID NO: 171 - DNA, 1497 bp, Neisseria gonorrhoeae
atgaatttgcctattcaaaaattcatgatgctgttggcagcggcaatatcgatgctgcatatccccattagtcatgcgaacggtttggatgcccgtttgcgcgatgatatgcaggcaaaacactacgaaccgggtggcaaataccatctgtttggtaatgctcgcggcagtgttaaaaatcgggtttgcgccgtccaaacatttgatgcaactgcggtcggccccatactgcctattacacacgaacggacaggatttgaaggtgttatcggctatgaaacccatttttcaggacacggacacgaagtacacagtccgttcgataatcatgattcaaaaagcacttctgatttcagcggcggcgtagacggcggttttaccgtttaccaacttcatcggacagggtcggaaatacatcccgcagacggatatgacgggcctcaaggcggcggttatccggaaccacaaggggcaagggatatatacagctaccatatcaaaggaacttcaaccaaaacaaagataaacactgttccgcaagcccctttttcagaccgctggctaaaagaaaatgccggtgccgcttccggttttctcagccgtgcggatgaagcaggaaaactgatatgggaaaacgaccccgataaaaattggcgggctaaccgtatggatgatattcgcggcatcgtccaaggtgcggttaatccttttttaacgggttttcaaggggtagggattggggcaattacagacagtgcggtaagcccggtcacagatacagccgctcagcagactctacaaggtattaatgatttaggaaatttaagtccggaagcacaacttgccgccgcgagcctattacaggacagtgcctttgcggtaaaagacggcatcaattccgccagacaatgggctgatgcccatccgaatataacagcaacagcccaaactgcccttgccgtagcagaggccgcaggtacggtttggcgcggtaaaaaagtagaacttaacccgaccaaatgggattgggttaaaaataccggctataaaaaacctgctgcccgccatatgcagactgtagatggggagatggcaggggggaatagaccgcctaaatctataacgtcggaaggaaaagctaatgctgcaacctatcctaagttggttaatcagctaaatgagcaaaacttaaataacattgcggctcaagatccaagattgagtctagctattcatgagggtaaaaaaaattttccaataggaactgcaacttatgaagaggcagatagactaggtaaaatttgggttggtgagggtgcaagacaaactagtggaggcggatggttaagtagagatggcactcgacaatatcggccaccaacagaaaaaaaatcacaatttgcaactacaggtattcaagcaaattttgaaacttatactattgattcaaatgaaaaaagaaataaaattaaaaatggacatttaaatattaggtaa

SEQ ID NO: 172 - protein, 498 aa, Neisseria gonorrhoeae
MNLPIQKFMMLLAAAISMLHIPISHANGLDARLRDDMQAKHYEPGGKYHLFGNARGSVKNRVCAVQTFDATAVGPILPITHERTGFEGVIGYETHFSGHGHEVHSPFDNHDSKSTSDFSGGVDGGFTVYQLHRTGSEIHPADGYDGPQGGGYPEPQGARDIYSYHIKGTSTKTKINTVPQAPFSDRWLKENAGAASGFLSRADEAGKLIWENDPDKNWRANRMDDIRGIVQGAVNPFLTGFQGVGIGAITDSAVSPVTDTAAQQTLQGINDLGNLSPEAQLAAASLLQDSAFAVKDGINSARQWADAHPNITATAQTALAVAEAAGTVWRGKKVELNPTKWDWVKNTGYKKPAARHMQTVDGEMAGGNRPPKSITSEGKANAATYPKLVNQLNEQNLNNIAAQDPRLSLAIHEGKKNFPIGTATYEEADRLGKIWVGEGARQTSGGGWLSRDGTRQYRPPTEKKSQFATTGIQANFETYTIDSNEKRNKIKNGHLNIR

SEQ ID NO: 173 - DNA, 126 bp, Neisseria meningitidis
atgaaaaaacaaatcaccgcagccgtaatgatgctgtctatgattgcccccgcaatggcaaacggcttggacaatcaggcatttgaagaccaaatgttccacacgcgggcagatgcaccgatgcag

SEQ ID NO: 174 - protein, 42 aa, Neisseria meningitidis
MKKQITAAVMMLSMIAPAMANGLDNQAFEDQMFHTRADAPMQ

SEQ ID NO: 175 - DNA, 546 bp, Neisseria meningitidis
atgaaaaaacaaatcaccgcagccgtaatgatgctgtctatgattgcccccgcaatggcaaacggcttggacaatcaggcatttgaagaccaagtgttccacacgcgggcagatgcaccgatgcagttggcggagctttctcaaaaggagatgaaggagacagagggggcgtttcttccattggctatcttgggtggtgctgccattggtatgtggacacagcatggttttagttatgcaacgacaggcagaccagcttctgttagagatgttgctattgctggcggattaggcgcaattcctggtggtgtaggcgccgcaggaaaggttgtttcctttgctaaatatggacgtgagattaaaatcggcaataatatgcggatagcccctttcggtaatagaacaggtcatcctattggaaaatttccccattatcatcgtcgagttacggataatacgggcaagactttgcctggacagggaattggtcgtcatcgcccttgggaatcaaaatctacggacagatcatggaaaaaccgcttctaa

SEQ ID NO: 176 - protein, 181 aa, Neisseria meningitidis
MKKQITAAVMMLSMIAPAMANGLDNQAFEDQVFHTRADAPMQLAELSQKEMKETEGAFLPLAILGGAAIGMWTQHGFSYATTGRPASVRDVAIAGGLGAIPGGVGAAGKVVSFAKYGREIKIGNNMRIAPFGNRTGHPIGKFPHYHRRVTDNTGKTLPGQGIGRHRPWESKSTDRSWKNRF

SEQ ID NO: 177 - DNA, 546 bp, Neisseria meningitidis
  misc_feature (159)..(159): N= Unknown
  misc_feature (164)..(164): N= Unknown
  misc_feature (185)..(185): N= Unknown
  misc_feature (308)..(308): N= Unknown
  misc_feature (420)..(420): N= Unknown
atgaaaaaacaaatcaccgcagccgtaatgatgctgtctatgattgcccccgcaatggcaaacggcttggacaatcaggcatttgaagaccaagtgttccacacgcgggcagatgcaccgatgcagttggcggagctttctcaaaaggagatgaagganacagngggggcgtttcttccattggntatcttgggtggtgctgccattggtatgtggacacagcatggttttagttatgcaacgacaggcagaccagcttctgttagagatgttgctattgctggcggattaggcgcaattcctggtgntgtaggcgccgcaggaaaggttgtttcctttgctaaatatggacgtgagattaaaatcggcaataatatgcggatagcccctttcggtaatagaacaggtcatcctattggnaaatttccccattatcatcgtcgagttacggataatacgggcaagactttgcctggacagggaattggtcgtcatcgcccttgggaatcaaaatctacggacagatcatggaaaaaccgcttctaa

SEQ ID NO: 178 - protein, 181 aa, Neisseria meningitidis
  misc_feature (53)..(53): Xaa= any amino acid
  misc_feature (55)..(55): Xaa= any amino acid
  misc_feature (62)..(62): Xaa= any amino acid
  misc_feature (103)..(103): Xaa= any amino acid
MKKQITAAVMMLSMIAPAMANGLDNQAFEDQVFHTRADAPMQLAELSQKEMKXTXGAFLPLXILGGAAIGMWTQHGFSYATTGRPASVRDVAIAGGLGAIPGXVGAAGKVVSFAKYGREIKIGNNMRIAPFGNRTGHPIGKFPHYHRRVTDNTGKTLPGQGIGRHRPWESKSTDRSWKNRF

SEQ ID NO: 179 - DNA, 540 bp, Neisseria meningitidis
atgaaaaaacaaatcaccgcagccgtaatgatgctgtctatgatcgcccccgcaatggcaaacggattggacaatcaggcatttgaagaccaagtgttccacacgcgggcagatgcgccgatgcagttggcggagctttctcagaaggagatgaaggagactgaaggggcttttcttccattggctatcttgggtggtgctgccattggtatgtggacacagcatggttttagttatgcaacgacaggcagaccagcttctgttagagatgttgctggcggattaggcgcaattcctggtgatgtaggtgctgcaggaaaggttgtttcctttgctaaatatggacgtgagattaaaatcggcaataatatgcggatagcccctttcggtaatagaacaggtcatcctattggaaaatttccccattatcatcgtcgagttacggataatacgggcaagactttgcctggacagggaattggtcgtcatcgcccttgggaatcaaaatctacggacagatcatggaaaaaccgcttctaa

SEQ ID NO: 180 - protein, 179 aa, Neisseria gonorrhoeae
MKKQITAAVMMLSMIAPAMANGLDNQAFEDQVFHTRADAPMQLAELSQKEMKETEGAFLPLAILGGAAIGMWTQHGFSYATTGRPASVRDVAGGLGAIPGDVGAAGKVVSFAKYGREIKIGNNMRIAPFGNRTGHPIGKFPHYHRRVTDNTGKTLPGQGIGRHRPWESKSTDRSWKNRF

SEQ ID NO: 181 - DNA, 251 bp, Neisseria meningitidis
atgaataaaactctctatcgtgtaattttcaaccgcaaacgtggggctgtgrtagccgttgctgaaactaccaagcgcgaaggtaaaagctgtgccgatagtgattcaggcagcgctcatgtgaaatctgttccttttggtactactcatgcacctgtttgtgcgttacaaatatcttttctttttctttattgggcttttctttatgtttggctgtaggtacggycaatattgcttttgctgatggcatt

SEQ ID NO: 182 - protein, 84 aa, Neisseria meningitidis
  misc_feature (18)..(18): Xaa= any amino acid
  misc_feature (55)..(55): Xaa= any amino acid
  misc_feature (76)..(76): Xaa= any amino acid
MNKTLYRVIFNRKRGAVXAVAETTKREGKSCADSDSGSAHVKSVPFGTTHAPVCXVTNIFSFSLLGFSLCLAVGTXNIAFADGI

SEQ ID NO: 183 - DNA, 249 bp, Neisseria meningitidis
atgaataaaactctctatcgtgtaattttcaaccgcaaacgtggggctgtggtagccgttgctgaaactaccaagcgcgaaggtaaaagctgtgccgatagtgattcaggcagcgctcatgtgaaatctgttccttttggtactactcatgcacctgtttgtcgttcaaatatcttttctttttctttattgggcttttctttatgtttggctgtaggtacggccaatattgcttttgctgatggcatt

SEQ ID NO: 184 - protein, 83 aa, Neisseria meningitidis
MNKTLYRVIFNRKRGAVVAVAETTKREGKSCADSDSGSAHVKSVPFGTTHAPVCRSNIFSFSLLGFSLCLAVGTANIAFADGI

SEQ ID NO: 185 - protein, 792 aa, Neisseria gonorrhoeae
ATGAACAAAACCCTCTATCGTGTGATTTTCAACCGCAAACGCGGTGCTGTGGTAGCTGTTGCCGAAACCACCAAGCGCGAAGGTAAAAGCTGTGCCGATAGTGGTTCGGGCAGCGTTTATGTGAAATCCGTTTCTTTCATTCCTACTCATTCCAAAGCCTTTTGTTTTTCTGCATTAGGCTTTTCTTTATGTTTGGCTTTGGGTACGGTCAATATTGCTTTTGCTGACGGCATTATTACTGATAAAGCTGCTCCTAAAACCCAACAAGCCACGATTCTGCAAACAGGTAACGGCATACCGCAAGTCAATATTCAAACCCCTACTTCGGCAGGGGTTTCTGTTAATCAATATGCCCAGTTTGATGTGGGTAATCGCGGGGCGATTTTAAACAACAGTCGCAGCAACACCCAAACACAGCTAGGCGGTTGGATTCAAGGCAATCCTTGGTTGACAAGGGGCGAAGCACGTGTGGTTGTAAACCAAATCAACAGCAGCCATCCTTCACAACTGAATGGCTATATTGAAGTGGGTGGACGACGTGCAGAAGTCGTTATTGCCAATCCGGCAGGGATTGCAGTCAATGGTGGTGGTTTTATCAATGCTTCCCGTGCCACTTTGACGACAGGCCAACCGCAATATCAAGCAGGAGACTTTAGCGGCTTTAAGATAAGGCAAGGCAATGCTGTAATCGCCGGACACGGTTTGGATGCCCGTGATACCGATTTCACACGTATTCTTGTATGCCAACAAAATCACCTTGATCAGTACGGCCGAACAAGCAGGCATTCGTAA

SEQ ID NO: 186 - protein, 263 aa, Neisseria gonorrhoeae
MNKTLYRVIFNRKRGAVVAVAETTKREGKSCADSGSGSVYVKSVSFIPTHSKAFCFSALGFSLCLALGTVNIAFADGIITDKAAPKTQQATILQTGNGIPQVNIQTPTSAGVSVNQYAQFDVGNRGAILNNSRSNTQTQLGGWIQGNPWLTRGEARVVVNQINSSHPSQLNGYIEVGGRRAEVVIANPAGIAVNGGGFINASRATLTTGQPQYQAGDFSGFKIRQGNAVIAGHGLDARDTDFTRILVCQQNHLDQYGRTSRHS

SEQ ID NO: 187 - DNA, 243 bp, Neisseria meningitidis
atgaatactcctccttttgtctgttggattttttgcaaggtcatcgacaatttcggcgacatcggcgtttcgtggcggctcgcccgtgttttgcaccgcgaactcggttggcaggtgcatttgtggacggacgatgtgtccgccttgcgtgcgctttgccctgatttgcccgatgttccctgcgttcatcaggatattcatgtccgcacttggcattccgatgcggcagatattgataccgcg

SEQ ID NO: 188 - protein, 81 aa, Neisseria meningitidis
MNTPPFVCWIFCKVIDNFGDIGVSWRLARVLHRELGWQVHLWTDDVSALRALCPDLPDVPCVHQDIHVRTWHSDAADIDTA

SEQ ID NO: 189 - DNA, 1149 bp, Neisseria meningitidis
atgaatactcctccttttgtctgttggattttttgcaaggtcatcgacaatttcggcgacatcggcgtttcgtggcggctcgcccgtgttttgcaccgcgaactcggttggcaggtgcatttgtggacggacgatgtgtccgccttgcgtgcgctttgccctgatttgcccgatgttccctgcgttcatcaggatattcatgtccgcacttggcattccgatgcggcagatattgataccgcgcctgttcccgatgtcgtcatcgaaacttttgcctgcgacctgcccgaaaatgtgctgcacattatccgccgacacaagccgctttggctgaattgggaatatttgagcgcggaggaaagcaatgaaaggctgcatctgatgccttcgccgcaggagggtgttcaaaaatatttttggtttatgggtttcagcgaaaaaagcggcgggttgatacgcgaacgtgattactgcgaagccgtccgtttcgatactgaagccctgcgagagcggctgatgctgcccgaaaaaaacgcctccgaatggctgcttttcggctatcggagcgatgtttgggcaaagtggctggaaatgtggcgacaggcaggcagcccgatgacactgttgctggcggggacgcaaatcatcgacagcctcaaacaaagcggcgttattccgcaagatgccctgcaaaacgacggcgatgtttttcagacggcatccgtccgcctcgtcaaaatccctttcgtgccgcaacaggacttcgaccaactgctgcaccttgccgactgcgccgtcatccgcggcgaagacagtttcgtgcgcgcccagcttgcgggcaaacccttcttttggcacatctacccgcaagacgagaatgtccatctcgacaaactccacgccttttgggataaggcacacggtttctacacgcccgaaaccgtgtcggcacaccgccgtctttcggacgacctcaacggcggagaggctttatccgcaacacaacgcctcgaatgttggcaaaccctgcaacaacatcaaaacggctggcggcaaggcgcggaggattggagccgttatcttttcgggcagccgtcagctcctgaaaaactcgctgcctttgtttcaaagcatcaaaaaatacgctag

SEQ ID NO: 190 - protein, 383 aa, Neisseria meningitidis
MNTPPFVCWIFCKVIDNFGDIGVSWRLARVLHRELGWQVHLWTDDVSALRALCPDLPDVPCVHQDIHVRTWHSDAADIDTAPVPDVVIETFACDLPENVLHIIRRHKPLWLNWEYLSAEESNERLHLMPSPQEGVQKYFWFMGFSEKSGGLIRERDYCEAVRFDTEALRERLMLPEKNASEWLLFGYRSDVWAKWLEMWRQAGSPMTLLLAGTQIIDSLKQSGVIPQDALQNDGDVFQTASVRLVKIPFVPQQDFDQLLHLADCAVIRGEDSFVRAQLAGKPFFWHIYPQDENVHLDKLHAFWDKAHGFYTPETVSAHRRLSDDLNGGEALSATQRLECWQTLQQHQNGWRQGAEDWSRYLFGQPSAPEKLAAFVSKHQKIRW

SEQ ID NO: 191 - DNA, 1149 bp, Neisseria meningitidis
  misc_feature (28)..(28): N= Unknown
  misc_feature (179)..(179): N= Unknown
  misc_feature (251)..(251): N= Unknown
  misc_feature (336)..(336): N= Unknown
  misc_feature (360)..(360): N= Unknown
  misc_feature (379)..(379): N= Unknown
  misc_feature (407)..(407): N= Unknown
  misc_feature (414)..(414): N= Unknown
  misc_feature (439)..(441): N= Unknown
  misc_feature (536)..(536): N= Unknown
  misc_feature (633)..(633): N= Unknown
  misc_feature (642)..(642): N= Unknown
atgaatactcctcctttttctgctgganttttttgcaaggtcatcgacaatttcggcgacatcggcgtttcgtggcggcttgcccgtgttttgcaccgcgaactcggttggcaggtgcatttgtggacggacgatgtgtccgccttgcgtgcgctttgccctgatttgcccgatgttcnctgcgttcatcaggatattcatgtccgcacttggcattccgatgcggcagatattgataccgcgcctgttcncgatgtcgtcatcgaaacttttgcctgcgacctgcccgaaaatgtgctgcacatcatccgccgacacaagccgctttggctgaantgggaatatttgagcgcggagganagcaatgaaaggctgcacntgatgccttcgccgcaggagagtgttcnaaaatanttttggtttatgggtttcagcgaannnagcggcggactgatacgcgaacgcgattactgcgaagccgtccgtttcgatagcggagccttgcgcaagaggctgatgcttcccgaaaaaaacgnccccgaatggctgcttttcggctatcggagcgatgtttgggcaaagtggctggaaatgtggcgacaggcaggcagtccgttgacacttttgctggcnggggcgcanattatcgacagcctcaaacaaaacggcgttattccgcaagatgccctgcaaaacgacggcgatgtttttcagacggcatccgtccgcctcgtcaaaatccctttcgtgccgcaacaggacttcgacaaactgctgcaccttgccgactgcgccgtcatccgcggcgaagacagtttcgtgcgcgcccagcttgcgggcaaacccttcttttggcacatctacccgcaagatgagaatgtccatctcgacaaactccacgccttttgggataaggcacacggtttctacacgcccgaaaccgcatcggcacaccgccgcctttcagacgacctcaacggcggagaggctttatccgcaacacaacgcctcgaatgttggcaaatcctgcaacaacatcaaaacggctggcggcaaggcgcggaggattggagccgttatctttttgggcagccttccgcatccgaaaaactcgccgcctttgtttcaaagcatcaaaaaatacgctag

SEQ ID NO: 192 - protein, 382 aa, Neisseria meningitidis
  misc_feature (10)..(10): Xaa= Unknown
  misc_feature (60)..(60): Xaa= Unknown
  misc_feature (84)..(84): Xaa= Unknown
  misc_feature (112)..(112): Xaa= Unknown
  misc_feature (120)..(120): Xaa= Unknown
  misc_feature (127)..(127): Xaa= Unknown
  misc_feature (136)..(136): Xaa= Unknown
  misc_feature (138)..(138): Xaa= Unknown
  misc_feature (147)..(147): Xaa= Unknown
  misc_feature (179)..(179): Xaa= Unknown
  misc_feature (214)..(214): Xaa= Unknown
MNTPPFSAGXFCKVIDNFGDIGVSWRLARVLHRELGWQVHLWTDDVSALRALCPDLPDVXCVHQDIHVRTWHSDAADIDTAPVXDVVIETFACDLPENVLHIIRRHKPLWLXWEYLSAEXSNERLHXMPSPQESVXKXFWFMGFSEXSGGLIRERDYCEAVRFDSGALRKRLMLPEKNXPEWLLFGYRSDVWAKWLEMWRQAGSPLTLLLAGAXIIDSLKQNGVIPQDALQNDGDVFQTASVRLVKIPFVPQQDFDKLLHLADCAVIRGEDSFVRAQLAGKPFFWHIYPQDENVHLDKLHAFWDKAHGFYTPETASAHRRLSDDLNGGEALSATQRLECWQILQQHQNGWRQGAEDWSRYLFGQPSASEKLAAFVSKHQKIR

SEQ ID NO: 193 - DNA, 8 bp, Neisseria gonorrhoeae
  misc_feature (1)..(8): N= Unknown
nnnnnnnn

SEQ ID NO: 194 - protein, 345 aa, Neisseria gonorrhoeae
MVMNTYAFPVCWIFCKVIDNFGDIGVSWRLARVLHRELGWQVHLWTDDVSALRALCPDLPDVPFVHQDIHVRTWHSDAADIDTAPVPDAVIETFACDLPENVLNIIRRHKPLWLNWEYLSAEESNERLHLMPSPQEGVQKYFWFMGFSEKSGGLIRERDYREAVRFDTEALRRRLVLPEKNAPEWLLFGYRGDVWAKWLDMWQQAGSLMTLLLAGAQIIDSLKQSGVIPQNALQNEGGVFQTASVRLVKIPFVPQQDFDKLLHLADCAVIRGEDSFVRTQLAGKPFFWHIYPQDENVHLDKLHAFWDKAYGFYTPETASVHRLLSDDLNGGEALSATQRLECGVL

SEQ ID NO: 195 - protein, 1152 aa, Neisseria gonorrhoeae
ATGAATACATACGCTTTTCCTGTCTGTTGGATTTTTTGCAAGGTCATCGACAATTTCGGCGACATCGGCGTTTCGTGGCGGCTCGCCCGTGTTTTGCACCGCGAACTCGGTTGGCAGGTGCATTTGTGGACGGACGACGTGTCCGCCTTGCGCGCGCTTTGTCCCGATTTGCCCGATGTTCCCTTCGTTCATCAGGATATTCATGTCCGCACTTGGCATTCCGATGCGGCAGACATTGATACCGCGCCCGTTCCCGATGCCGTTATCGAAACTTTTGCCTGCGACCTGCCCGAAAATGTGCTGAACATCATCCGCCGACACAAACCGCTTTGGCTGAATTGGGAATATTTGAGCGCGGAGGAAAGCAATGAAAGGCTGCACCTGATGCCTTCGCCGCAGGAGGGCGTTCAAAAATATTTTTGGTTTATGGGTTTCAGCGAAAAAAGCGGCGGGTTGATACGCGAACGCGATTACCGCGAAGCCGTCCGTTTCGATACCGAAGCCCTGCGCCGGCGGCTGGTGCTGCCCGAAAAAAACGCCCCCGAATGGCTGCTTTTCGGCTATCGGGGCGATGTTTGGGCAAAGTGGCTGGACATGTGGCAACAGGCAGGCAGCCTGATGACCCTACTGCTGGCGGGGGCGCAAATTATCGACAGCCTCAAACAAAGCGGCGTTATTCCGCAAAACGCCCTGCAAAATGAAGGCGGTGTCTTTCAGACGGCATCCGTCCGCCTTGTCAAAATCCCGTTCGTGCCGCAACAGGACTTCGACAAATTGCTGCACCTCGCCGACTGCGCCGTGATACGCGGCGAAGACAGTTTCGTGCGTACCCAGCTTGCCGGAAAACCCTTTTTTTGGCACATCTACCCGCAAGACGAGAATGTCCATCTCGACAAACTCCACGCCTTTTGGGATAAGGCATACGGCTTCTACACGCCCGAAACCGCATCGGTGCACCGCCTCCTTTCGGACGACCTCAACGGCGGAGAGGCTTTATCCGCAACACAACGCCTCGAATGTTGGCAAACCCTGCAACAACATCAAAACGGCTGGCGGCAAGGCGCGGAGGATTGGAGCCGTTATCTTTTCGGGCAGCCTTCCGCATCCGAAAAACTCGCCGCCTTTGTTTCAAAGCATCAAAAAATACGCTAG

SEQ ID NO: 196 - protein, 383 aa, Neisseria meningitidis
MNTYAFPVCWIFCKVIDNFGDIGVSWRLARVLHRELGWQVHLWTDDVSALRALCPDLPDVPFVHQDIHVRTWHSDAADIDTAPVPDAVIETFACDLPENVLNIIRRHKPLWLNWEYLSAEESNERLHLMPSPQEGVQKYFWFMGFSEKSGGLIRERDYREAVRFDTEALRRRLVLPEKNAPEWLLFGYRGDVWAKWLDMWQQAGSLMTLLLAGAQIIDSLKQSGVIPQNALQNEGGVFQTASVRLVKIPFVPQQDFDKLLHLADCAVIRGEDSFVRTQLAGKPFFWHIYPQDENVHLDKLHAFWDKAYGFYTPETASVHRLLSDDLNGGEALSATQRLECWQTLQQHQNGWRQGAEDWSRYLFGQPSASEKLAAFVSKHQKIR

SEQ ID NO: 197 - DNA, 428 bp, Neisseria meningitidis
  misc_feature (15)..(15): N= Unknown
  misc_feature (59)..(59): N= Unknown
  misc_feature (97)..(97): N= Unknown
  misc_feature (136)..(136): N= Unknown
  misc_feature (394)..(394): N= Unknown
  misc_feature (410)..(410): N= Unknown
ttgttcctgcgtgtnaaagtggggcgttttttcagcagtccggcgacgtggtttcgggncaaagaccctgtaaatcaggcggtgttgcggctgtatncggacgagtggcggcaacttcggtacgttggaaaatagncgcaacgtcgcacagcctgtggctctgcacgctgctcggaatgctggtgtcggtattgttgctgcttttggtgcggcaatatacgttcaactgggaaagcacgctgttgagcaatgccgcttcggtacgcgcggtggaaatgttggcatggctgccgtcgaaactcggtttccctgtccccgatgcgcggtcggtcatcgaaggccgtctgaacggcaatattgccgatgcgcgggcttggtcggggctgctggtcgncagtatcgcctgctanggcatcctgccgcgcctg

SEQ ID NO: 198 - protein, 143 aa, Neisseria meningitidis
  misc_feature (20)..(20): Xaa= any amino acid
  misc_feature (33)..(33): Xaa= any amino acid
  misc_feature (38)..(38): Xaa= any amino acid
  misc_feature (46)..(46): Xaa= any amino acid
  misc_feature (132)..(132): Xaa= any amino acid
  misc_feature (137)..(137): Xaa= any amino acid
LFLRVKVGRFFSSPATWFRXKDPVNQAVLRLYXDEWRXTSVRWKIXATSHSLWLCTLLGMLVSVLLLLLVRQYTFNWESTLLSNAASVRAVEMLAWLPSKLGFPVPDARSVIEGRLNGNIADARAWSGLLVXSIACXGILPRL

SEQ ID NO: 199 - DNA, 1341 bp, Neisseria meningitidis
atgttgaatccatcccgaaaactggttgagctggtccgtattttggacgaaggcggttttattttcagcggcgatcccgtacaggcgacggaggctttgcgccgcgtggacggcagtacggaggaaaaaatcatccgtcgggcggagatgattgacaggaaccgtatgctgcgggagacgttggaacgtgtgcgtgcggggtcgttctggttgtgggtggtggcggcgacgtttgcattttttaccggtttttcagtcacttatcttctaatggacaatcagggtctgaatttctttttggttttggcgggcgtgttgggcatgaatacgctgatgctggcagtatggttggcaatgttgttcctgcgtgtgaaagtggggcgttttttcagcagtccggcgacgtggtttcggggcaaagaccctgtaaatcaggcggtgttgcggctgtatgcggacgagtggcggcaaccttcggtacgttggaaaataggcgcaacgtcgcacagcctgtggctctgcacgctgctcggaatgctggtgtcggtattgttgctgcttttggtgcggcaatatacgttcaactgggaaagcacgctgttgagcaatgccgcttcggtacgcgcggtggaaatgttggcatggctgccgtcgaaactcggtttccctgtccccgatgcgcgggcggtcatcgaaggccgtctgaacggcaatattgccgatgcgcgggcttggtcggggctgctggtcggcagtatcgcctgctacggcatcctgccgcgcctgctggcttgggtagtgtgtaaaatccttttgaaaacaagcgaaaacggattggatttggaaaagccctattatcaggcggtcatccgccgctggcagaacaaaatcaccgatgcggatacgcgtcgggaaaccgtgtccgccgtttcaccgaaaatcatcttgaacgatgcgccgaaatgggcggtcatgctggagaccgagtggcaggacggcgaatggttcgagggcaggctggcgcaggaatggctggataagggcgttgccaccaatcgggaacaggttgccgcgctggagacagagctgaagcagaaaccggcgcaactgcttatcggcgtgcgcgcccaaactgtgccggaccgcggcgtgttgcggcagattgtccgactctcggaagcggcgcagggcggcgcggtggtgcagcttttggcggaacaggggctttcagacgacctttcggaaaagctggaacattggcgtaacgcgctggccgaatgcggcgcggcgtggcttgagcctgacagggcggcgcaggaagggcgtttgaaagaccaataa

SEQ ID NO: 200 - protein, 446 aa, Neisseria meningitidis
MLNPSRKLVELVRILDEGGFIFSGDPVQATEALRRVDGSTEEKIIRRAEMIDRNRMLRETLERVRAGSFWLWVVAATFAFFTGFSVTYLLMDNQGLNFFLVLAGVLGMNTLMLAVWLAMLFLRVKVGRFFSSPATWFRGKDPVNQAVLRLYADEWRQPSVRWKIGATSHSLWLCTLLGMLVSVLLLLLVRQYTFNWESTLLSNAASVRAVEMLAWLPSKLGFPVPDARAVIEGRLNGNIADARAWSGLLVGSIACYGILPRLLAWVVCKILLKTSENGLDLEKPYYQAVIRRWQNKITDADTRRETVSAVSPKIILNDAPKWAVMLETEWQDGEWFEGRLAQEWLDKGVATNREQVAALETELKQKPAQLLIGVRAQTVPDRGVLRQIVRLSEAAQGGAVVQLLAEQGLSDDLSEKLEHWRNALAECGAAWLEPDRAAQEGRLKDQ

SEQ ID NO: 201 - DNA, 1350 bp, Neisseria meningitidis
  misc_feature (241)..(241): N= Unknown
  misc_feature (248)..(248): N= Unknown
  misc_feature (316)..(316): N= Unknown
  misc_feature (470)..(470): N= Unknown
  misc_feature (814)..(814): N= Unknown
  misc_feature (817)..(817): N= Unknown
  misc_feature (851)..(851): N= Unknown
  misc_feature (853)..(857): N= Unknown
  misc_feature (860)..(862): N= Unknown
  misc_feature (865)..(865): N= Unknown
  misc_feature (1206)..(1206): N= Unknown
atgttgaatccatcccgaaaactggttgagctggtccgtattttggaagaaggcggctttattttcagcggcgatcccgtgcaggcgacggaggctttgcgccgcgtggacggcagtacggaggaaaaaatcatccgtcgggcgaagatgatcgacaggaaccgtatgctgcgggagacgttggaacgtgtgcgtgcggggtcgttctggttgtgggtggcggcggcgacgtttgcgtttnttaccgntttttcagttacttatcttctaatggacaatcagggtctgaatttctttttggttttggcgggcgtgntgggcatgaatacgctgatgctggcagtatggttggcaatgttgttcctgcgcgtgaaagtggggcgttttttcagcagtccggcgacgtggtttcggggcaaagaccctgtcaatcaggcggtgttgcggctgtatgcggacgagtggcggcnaccttcggtacgttggaaaataggcgcaacgtcgcacagcctgtggctctgcacgctgctcggaatgctggtgtcggtattgttgctgcttttggtgcggcaatatacgttcaactgggaaagcacgctgttgggcgattcgtcttcggtacggctggtggaaatgttggcatggctgcctgcgaaactgggttttcccgtgcctgatgcgcgggcggtcatcgaaggtcgtctgaacggcaatattgccgatgcgcgggcttggtcggggctgctggtcggcagtatcgcctgctacggcatcctgccgcgcctcttggcttgggcggtatgcaaaatccttntgnaaacaagcgaaaacggcttggatttggaaaagcncnnnnntcnnncgntcatccgccgctggcagaacaaaatcaccgatgcggatacgcgtcgggaaaccgtgtccgccgtttcgccgaaaatcgtcttgaacgatgcgccgaaatgggcggtcatgctggagaccgaatggcaggacggcgaatggttcgagggcaggctggcgcaggaatggctggataagggcgttgccgccaatcgggaacaggttgccgcgctggagacagagctgaagcagaaaccggcgcaactgcttatcggcgtgcgcgcccaaactgtgcccgaccgcggcgtgttgcggcagatcgtccgactttcggaagcggcgcagggcggcgcggtggtgcancttttggcggaacaggggctttcagacgacctttcggaaaagctggaacattggcgtaacgcgctgaccgaatgcggcgcggcgtggctggaacccgacagagcggcgcaggaaggccgtctgaaaaccaacgaccgcacttga

SEQ ID NO: 202 - protein, 449 aa, Neisseria meningitidis
  misc_feature (81)..(81): Xaa= any amino acid
  misc_feature (83)..(83): Xaa= any amino acid
  misc_feature (106)..(106): Xaa= any amino acid
  misc_feature (157)..(157): Xaa= any amino acid
  misc_feature (272)..(273): Xaa= any amino acid
  misc_feature (284)..(289): Xaa= any amino acid
  misc_feature (402)..(402): Xaa= any amino acid
MLNPSRKLVELVRILEEGGFIFSGDPVQATEALRRVDGSTEEKIIRRAKMIDRNRMLRETLERVRAGSFWLWVAAATFAFXTXFSVTYLLMDNQGLNFFLVLAGVXGMNTLMLAVWLAMLFLRVKVGRFFSSPATWFRGKDPVNQAVLRLYADEWRXPSVRWKIGATSHSLWLCTLLGMLVSVLLLLLVRQYTFNWESTLLGDSSSVRLVEMLAWLPAKLGFPVPDARAVIEGRLNGNIADARAWSGLLVGSIACYGILPRLLAWAVCKILXXTSENGLDLEKXXXXXXIRRWQNKITDADTRRETVSAVSPKIVLNDAPKWAVMLETEWQDGEWFEGRLAQEWLDKGVAANREQVAALETELKQKPAQLLIGVRAQTVPDRGVLRQIVRLSEAAQGGAVVXLLAEQGLSDDLSEKLEHWRNALTECGAAWLEPDRAAQEGRLKTNDRT

SEQ ID NO: 203 - DNA, 8 bp, Neisseria gonorrhoeae
  misc_feature (1)..(8): N= Unknown
nnnnnnnn

SEQ ID NO: 204 - protein, 397 aa, Neisseria gonorrhoeae
MIDRDRMLRDTLERVRAGSFWLWVVVASMMFTAGFSGTYLLMDNQGLNFFLVLAGVLGMNTLMLAVWLATLFLRVKVGRFFSSPATWFRGKGPVNQAVLRLYADQWRQPSVRWKIGATAHSLWLCTLLGMLVSVLLLLLVRQYTFNWESTLLSNAASVRAVEMLAWLPSKLGFPVPDARAVIEGRLNGNIADARAWSGLLVGSIVCYGILPRLLAWVVCKILLKTSENGLDLEKTYYQAVIRRWQNKITDADTRRETVSAVSPKIVLNDAPKWALMLETEWQDGQWFEGRLAQEWLDKGVAANREQVAALETELKQKPAQLLIGVRAQTVPDRGVLRQIVRLSEAAQGGAVVQLLAEQGLSDDLSEKLEHWRNALTECGAAWLEPDRVAQEGRLKDQ

SEQ ID NO: 205 - DNA, 1341 bp, Neisseria gonorrhoeae
atgttgaatccatcccgaaaactggttgagctggtccgtattttgaataaagggggttttattttcagcggcgatcctgtgcaggcgacggaggctttgcgccgcgtggacggcagtacggaggaaaaaatcttccgtcgggcggagatgatcgacagggaccgtatgttgcgggacacgttggaacgtgtgcgtgcggggtcgttctggttatgggtggtggtggcatcgatgatgtttaccgccggattttcaggcacttatcttctgatggacaatcaggggctgaatttctttttagttttggcgggagtgttgggcatgaatacgctgatgctggcagtatggttggcaacgttgttcctgcgcgtgaaagtgggacggtttttcagcagtccggcgacgtggtttcggggcaaaggccctgtaaatcaggcggtgttgcggctgtatgcggaccagtggcggcaaccttcggtacgatggaaaataggcgcaacggcgcacagcttgtggctctgcacgctgctcggaatgctggtgtcggtattgctgctgcttttggtgcggcaatatacgttcaactgggaaagcacgctgttgagcaatgccgcttcggtacgcgcggtggaaatgttggcatggctgccgtcgaaactcggtttccctgtccccgatgcgcgggcggtcatcgaaggtcgtctgaacggcaatattgccgatgcgcgggcttggtcggggctgctggtcggcagtatcgtctgctacggcatcctgccgcgcctcttggcttgggtagtgtgtaaaatccttttgaaaacaagcgaaaacggattggatttggaaaaaacctattatcaggcggtcatccgccgctggcagaacaaaatcaccgatgcggatacgcgtcgggaaaccgtgtccgccgtttcgccgaaaatcgtcttgaacgatgcgccgaaatgggcgctcatgctggagaccgagtggcaggacggccaatggttcgagggcaggctggcgcaggaatggctggataagggcgttgccgccaatcgggaacaggttgccgcgctggagacagagctgaagcagaaaccggcgcaactgcttatcggcgtacgcgcccaaactgtgccggaccggggcgtgctgcggcagattgtgcggctttcggaagcggcgcagggcggcgcggtggtgcagcttttggcggaacaggggctttcagacgacctttcggaaaagctggaacattggcgtaacgcgctgaccgaatgcggcgcggcgtggcttgagcctgacagggtggcgcaggaaggccgtttgaaagaccaataa

SEQ ID NO: 206 - protein, 446 aa, Neisseria gonorrhoeae
MLNPSRKLVELVRILNKGGFIFSGDPVQATEALRRVDGSTEEKIFRRAEMIDRDRMLRDTLERVRAGSFWLWVVVASMMFTAGFSGTYLLMDNQGLNFFLVLAGVLGMNTLMLAVWLATLFLRVKVGRFFSSPATWFRGKGPVNQAVLRLYADQWRQPSVRWKIGATAHSLWLCTLLGMLVSVLLLLLVRQYTFNWESTLLSNAASVRAVEMLAWLPSKLGFPVPDARAVIEGRLNGNIADARAWSGLLVGSIVCYGILPRLLAWVVCKILLKTSENGLDLEKTYYQAVIRRWQNKITDADTRRETVSAVSPKIVLNDAPKWALMLETEWQDGQWFEGRLAQEWLDKGVAANREQVAALETELKQKPAQLLIGVRAQTVPDRGVLRQIVRLSEAAQGGAVVQLLAEQGLSDDLSEKLEHWRNALTECGAAWLEPDRVAQEGRLKDQ

SEQ ID NO: 207 - DNA, 450 bp, Neisseria meningitidis
cagaagagtttgtcgagaatttctttatggggtttgggcggcgtgtttttcggggtgtccggtctggtatggttttctttgggcgtttctttgagtgcgcctgtttttcgggtgtttcttttcggggttcgggacgggggacgtttgtgggcagtacgggggtttctttgagtgtgttttcagcttgtgttccggcgtcgtccggctgcctgtcggtttgagctgtgtcggcaggttgcggtttgacccggtttttcttgggtgcggcaggggacgtcattctcctgccgctttcgtctgtgccgtccggctgtgcgggttcggatgaggcggcgtggtggtgttcgggttgggcggcatcttgttccgactacgccgtttggcagccagaattcggtttcgcgggggctgtcggtgtgttgcggttcggcttgaagggttttgtcgtcc

SEQ ID NO: 208 - protein, 150 aa, Neisseria meningitidis
  misc_feature (31)..(31): Xaa= any amino acid
  misc_feature (65)..(65): Xaa= any amino acid
  misc_feature (81)..(82): Xaa= any amino acid
QKSLSRISLWGLGGVFFGVSGLVWFSLGVSXECACFSGVSFRGSGRGTFVGSTGVSLSVFSACVXGVVRLPVGLSCVGRLXXLTRFFLGAAGDVILLPLSSVPSGCAGSDEAAWWCSGWAASCPTTPFGSQNSVSRGLSVCCGSARVLSS

SEQ ID NO: 209 - DNA, 1362 bp, Neisseria meningitidis
atgatgatgccgttcataatgcttccttggattgckggtgtgcctgccgtgccgggtcagaataggttgtccagaatttctttatggggtttgggcggcgtgtttttcggggtgtccggtttggtatggttttctttgggcgtttctttgggctgcgcctgtttttcgggtgtttcttttcggggttcgggacgggggacgtttgtgggcagtacgggggtttctttgagtgtgttttcagcttgtgttccggcgtcgtccggctgcctgtcggtttgagctgtgtcggcaggttgcggtttgacccggtttttcttgggtgcggcaggggacggcagtccgctgccgctttcgtctgtgccgtccggctgtgcgggttcggatgaggcggcgtggtggtgttcgggttgggcggcatcttgtccgactacgccgtttggcagccagaattcggtttcgcgggggctgtcggtgtgttgcggttcggcttgaagggttttgtcgccgttcgggttgaatgtgctgacgatgcctattgccaatgcgccgatggcggcgatacagatgagcaatacggcgcgtatcaggagtttgggggtcagcctgaagggtttgttcggtttttttgccattttgattgtgcttttggggtgtcgggcaatgccgtctgaaggcggttcagacggcattgccgagtcagcgttggacgtagttttggtagagggtgatgactttttgtacgccgacggtggtgctgactttttgggtaatctgcgcctgttcttcgggggtgaggatgcccataacgtaggttacgttgccgtaggtaacgattttgacgcgcgcctgtgtggcggggctgatgcccaacagcgtggcgcggactttggatgtgttccaagtgtcgccggcgatgtcgccggcagtgcgcggcagggaggcgacggtaatatagttgtacacgccttcggcggcctgttcggaacgtgcaatctgaccgacgaactgtttttcgccttcggtggcgacttgtccgagcagcagcaggtggcggttgtagccgacgacggagatttggggcgtgtagcctttggtttggttgttttggcgcagataggaacgggcggtggtttcgatacgcaacgccataacgttgtcgtcggtttgcgcgccggtggttcggcggtcgacggcggatttcgcgccgacggcggcgcttccgattactgcgctgacgcagccgctaagggcaaggctgaaaatggcggcaatcagggtgcggacggtgtgcggtttgggtttcatcgggtgcttcctttcttgggcgtttcagacggcattgctttgcgccatgccgtctga

SEQ ID NO: 210 - protein, 451 aa, Neisseria meningitidis
MMMPFIMLPWIAGVPAVPGQNRLSRISLWGLGGVFFGVSGLVWFSLGVSLGCACFSGVSFRGSGRGTFVGSTGVSLSVFSACVPASSGCLSVAVSAGCGLTRFFLGAAGDGSPLPLSSVPSGCAGSDEAAWWCSGWAASCPTTPFGSQNSVSRGLSVCCGSARVLSPFGLNVLTMPIANAPMAAIQMSNTARIRSLGVSLKGLFGFFAILIVLLGCRAMPSEGGSDGIAESALDVVLVEGDDFLYADGGADFLGNLRLFFGGEDAHNVGYVAVGNDFDARLCGGADAQQRGADFGCVPSVAGDVAGSARQGGDGNIVVHAFGGLFGTCNLTDELFFAFGGDLSEQQQVAVVADDGDLGRVAFGLVVLAQIGTGGGFDTQRHNVVVGLRAGGSAVDGGFRADGGASDYCADAAAKGKAENGGNQGADGVRFGFHRVLPFLGVSDGIALRHAV

SEQ ID NO: 211 - DNA, 1380 bp, Neisseria meningitidis
  misc_feature (9)..(9): N= Unknown
  misc_feature (15)..(15): N= Unknown
  misc_feature (77)..(77): N= Unknown
  misc_feature (100)..(100): N= Unknown
  misc_feature (148)..(148): N= Unknown
  misc_feature (166)..(166): N= Unknown
  misc_feature (234)..(234): N= Unknown
  misc_feature (296)..(296): N= Unknown
  misc_feature (328)..(328): N= Unknown
  misc_feature (336)..(336): N= Unknown
  misc_feature (413)..(413): N= Unknown
  misc_feature (416)..(416): N= Unknown
  misc_feature (507)..(507): N= Unknown
  misc_feature (522)..(522): N= Unknown
  misc_feature (533)..(533): N= Unknown
  misc_feature (637)..(637): N= Unknown
  misc_feature (734)..(734): N= Unknown
  misc_feature (973)..(973): N= Unknown
  misc_feature (1105)..(1105): N= Unknown
  misc_feature (1184)..(1184): N= Unknown
atgatgatnccgttnataatgcttccttggattgcgggtgtgcctgccgtgccgggtcagaagaggttgtcgagaanttctttatggggtttaggcggcntgtttttcggggtgtccggtttggtatggttttctttgggcgtttctntttctttgggtgtttctntgggctgtgcctgtttttcgggtgtttcttttcggggttcgggacgggggacgtttgtgggcagtacnggggtttctttgagtgtgttttcagcttgtgctccggcgtcgtccggctgcctgtcggtttnagctgtgtcggcaggttgcggtttgacccggnttttcttnggtgcggcaggggacggcagtccgctgccgctttcgtctgtgccgtccggctgtgcgggtgcggatgaggaggcgtngtngtgttcgggttgggcggcatcttgtccgactacgccgtttggcagccagaattcggtttcgcgggggctgtcggtgtgttgcggttcggtntggagggttttgtcnccgttcgggtngaatgtgctgacgatgcctattgccaatgcgccgatggcggtgatacagatgagcaatacggcgcgtatcaggagtttgggggtcagcctgaagggtttgttcngtttttttgccattttgattgtgcttttggggtgtcgggcaatgccgtctgaaggcggttcagacggcattgccgagtcagcgttggacgtagtttnggtagagggtgatgactttttgtacgccgacggtggtgctgactttttgggtaatctgcgcctgttcttcgggggtgaggatgcccataacgtaggttacgttgccgtaggtaacgattttgacgcgcgcctgtgtggcggggctgatgcccaacagcgtggcgcggactttggatgtgttccaagtgtcgccggcgatgtcgccggcagtgcgcggcagggaggcgacggtaatgtanttgtacacgccttcggcggcctgttcggaacgtgcaatctgaccgacgaactgtttctcgccttcggtggcgacttgtccgagcagcagcaggtggcggttgtagccgacaacggagatttggggcgtgtancctttggtttggttgttttggcgcagataggagcgggcggtggtttcgatacgcagcgccattacgttgtcgtcggttngcgcgccggtggttcggcggtcgacggcggatttcgcgccgaccgccgcgccgccgacgactgcgctgacgcagccgccgagggcaaggctgaggacggcggcagtcagggtgcggacggtgtgcggtttgggtttcatcgggtgcttcctttcttgggcgtttcagacggcattgctttgcgccatgccgtctga

SEQ ID NO: 212 - protein, 459 aa, Neisseria meningitidis
  misc_feature (3)..(3): Xaa= any amino acid
  misc_feature (5)..(5): Xaa= any amino acid
  misc_feature (26)..(26): Xaa= any amino acid
  misc_feature (34)..(34): Xaa= any amino acid
  misc_feature (50)..(50): Xaa= any amino acid
  misc_feature (56)..(56): Xaa= any amino acid
  misc_feature (99)..(99): Xaa= any amino acid
  misc_feature (110)..(110): Xaa= any amino acid
  misc_feature (112)..(112): Xaa= any amino acid
  misc_feature (138)..(139): Xaa= any amino acid
  misc_feature (178)..(178): Xaa= any amino acid
  misc_feature (213)..(213): Xaa= any amino acid
  misc_feature (245)..(245): Xaa= any amino acid
  misc_feature (325)..(325): Xaa= any amino acid
  misc_feature (369)..(369): Xaa= any amino acid
  misc_feature (395)..(395): Xaa= any amino acid
MMXPXIMLPWIAGVPAVPGQKRLSRXSLWGLGGXFFGVSGLVWFSLGVSXSLGVSXGCACFSGVSFRGSGRGTFVGSTGVSLSVFSACAPASSGCLSVXAVSAGCGLTRXFXGAAGDGSPLPLSSVPSGCAGADEEAXXCSGWAASCPTTPFGSQNSVSRGLSVCCGSVWRVLSPFGXNVLTMPIANAPMAVIQMSNTARIRSLGVSLKGLFXFFAILIVLLGCRAMPSEGGSDGIAESALDVVXVEGDDFLYADGGADFLGNLRLFFGGEDAHNVGYVAVGNDFDARLCGGADAQQRGADFGCVPSVAGDVAGSARQGGDGNVXVHAFGGLFGTCNLTDELFLAFGGDLSEQQQVAVVADNGDLGRVXFGLVVLAQIGAGGGFDTQRHYVVVGXRAGGSAVDGGFRADRRAADDCADAAAEGKAEDGGSQGADGVRFGFHRVLPFLGVSDGIALRHAV

SEQ ID NO: 213 - DNA, 1380 bp, Neisseria gonorrhoeae
atgatgatgccgttcataatgcttccttggattgcgggtgtgcctgccgtgccgggtcaaaagaggttgtcgagaatctctttatggggtttggccggcgtgtttttcggggtgtccggtttggtatggttttctttgggcgtttctttttctttgggtgtttctttgggctgcgcctgtttttcgggtgtttcttttcggggttcgggatggggggcgtttgtgggcagtacgggggtttctttgagtgtgttttcagcttgtgttccggtgccggttaacgaatcggctgcccgggccgcatccgaagggcgcggtttgacccggtttttcttgggtgcggcaggggacggcagtccgctgccgctttcttctgtgccgtccggctgtgcgggttcggatgaggcggcgtggtggtgttcgggttgggcggcatcttgtccgacggcgccgtttggcagccagaattcggtttcgcgggggctgtcggtgtgttgcggttcggtttggagggttttgtcgccgttcgggttgaatgtgctgacgatgcctactgccaatgcgccgatggcggtgatacagatgagcaatacggcgcgtatcaggagtttgggggtcagcctgaagggtttgttcggtttttttgccattttgattgtgcttttggggtgtcgggcaatgccgtctgaaggcggttcagacggcattgccgagtcagcgttggacgtagttttggtagagggtaatgactttttgtacgccgacggtggtgctgactttttgggtaatctgcgcctgttcttcgggggtgaggatgcccataacgtaggttacattgccgtaggtaatgattttgacgcgcgcctgtgtagcggggctgatgcccagcagcgtggcgcggactttggacgtgttccaagtgtcgccggcgatgtcgcccgcagtgcgcggcagggaggcgacggtaatgtagttgtatacgccttcggcggcctgttcggaacgtgcaatctgaccgacgaactgtttttcgccttcggtggcgacttgtccgagcagcagcaggtggcggttgtagccgacgacggagatttggggcgtgtagcctttggtttggttgttttggcgcaggtaggaacgggcggtggtttcgatacgcaacgccataacgttgtcatcggtttgcgcgccggtggttcggcggtcgatgacggattttgcgccgacggcggccccgccgacgactgcgctgaagcagccgccgagggcaaggctgaggacggcggcaatcagggtgcggacggtgtgtggtttgggtttcatcggggacttcctttcttgggcgtttcagacggcattgctttgcgccatgccgtctga

SEQ ID NO: 214 - protein, 459 aa, Neisseria gonorrhoeae
MMMPFIMLPWIAGVPAVPGQKRLSRISLWGLAGVFFGVSGLVWFSLGVSFSLGVSLGCACFSGVSFRGSGWGAFVGSTGVSLSVFSACVPVPVNESAARAASEGRGLTRFFLGAAGDGSPLPLSSVPSGCAGSDEAAWWCSGWAASCPTAPFGSQNSVSRGLSVCCGSVWRVLSPFGLNVLTMPTANAPMAVIQMSNTARIRSLGVSLKGLFGFFAILIVLLGCRAMPSEGGSDGIAESALDVVLVEGNDFLYADGGADFLGNLRLFFGGEDAHNVGYIAVGNDFDARLCSGADAQQRGADFGRVPSVAGDVARSARQGGDGNVVVYAFGGLFGTCNLTDELFFAFGGDLSEQQQVAVVADDGDLGRVAFGLVVLAQVGTGGGFDTQRHNVVIGLRAGGSAVDDGFCADGGPADDCAEAAAEGKAEDGGNQGADGVWFGFHRGLPFLGVSDGIALRHAV

SEQ ID NO: 215 - DNA, 279 bp, Neisseria meningitidis
atgaaaaccttcttcaaaaccctttccgccgccgcactcgcgctcatcctcgccgcctgcggattcaaaaagacagcgcgcccgccgcatccgcttctgccgccgccgacaacggcgcggcgtaaaaaagaaatcgtcttcggcacgaccgtcggcgacttcggcgatatggtcaaagaacaaatccaagccgagctggagaaaaaaggctacaccgtcaaactggtcgagtttaccgactatgtacgcccgaatctggcattggctgagggcgagttg

SEQ ID NO: 216 - protein, 92 aa, Neisseria meningitidis
MKTFFKTLSAAALALILAACGQKDSAPAASASAAADNGAAKKEIVFGTTVGDFGDMVKEQIQAELEKKGYTVKLVEFTDYVRPNLALAEGEL

SEQ ID NO: 217 - DNA, 864 bp, Neisseria meningitidis
atgaaaaccttcttcaaaaccctttccgccgccgcactcgcgctcatcctcgccgcctgcggcggtcaaaaagacagcgcgcccgccgcatccgcttctgccgccgccgacaacggcgcggcgaaaaaagaaatcgtcttcggcacgaccgtcggcgacttcggcgatatggtcaaagaacaaatccaagccgagctggagaaaaaaggctacaccgtcaaactggtcgagtttaccgactatgtacgcccgaatctggcattggctgagggcgagttggacatcaacgtcttccaacacaaaccctatcttgacgacttcaaaaaagaacacaatctggacatcaccgaagtcttccaagtgccgaccgcgcctttgggactgtacccgggcaagctgaaatcgctggaagaagtcaaagacggcagcaccgtatccgcgcccaacgacccgtccaacttcgcccgcgtcttggtgatgctcgacgaactgggttggatcaaactcaaagacggcatcaatccgttgaccgcatccaaagcggacatcgccgagaacctgaaaaacatcaaaatcgtcgagcttgaagccgcgcaactgccgcgtagccgcgccgacgtggattttgccgtcgtcaacggcaactacgccataagcagcggcatgaagctgaccgaagccctgttccaagaaccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaatcccctgccgcatggaatgaaggcgcagccaaataa

SEQ ID NO: 218 - protein, 287 aa, Neisseria meningitidis
MKTFFKTLSAAALALILAACGGQKDSAPAASASAAADNGAAKKEIVFGTTVGDFGDMVKEQIQAELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 219 - DNA, 864 bp, Neisseria meningitidis
  misc_feature (126)..(126): N= Unknown
  misc_feature (183)..(183): N= Unknown
  misc_feature (233)..(233): N= Unknown
  misc_feature (250)..(250): N= Unknown
  misc_feature (294)..(294): N= Unknown
  misc_feature (302)..(302): N= Unknown
  misc_feature (305)..(305): N= Unknown
  misc_feature (320)..(320): N= Unknown
  misc_feature (328)..(328): N= Unknown
  misc_feature (349)..(350): N= Unknown
  misc_feature (357)..(357): N= Unknown
  misc_feature (411)..(412): N= Unknown
  misc_feature (423)..(423): N= Unknown
  misc_feature (455)..(457): N= Unknown
  misc_feature (464)..(464): N= Unknown
  misc_feature (497)..(497): N= Unknown
  misc_feature (514)..(514): N= Unknown
  misc_feature (521)..(533): N= Unknown
  misc_feature (535)..(535): N= Unknown
  misc_feature (537)..(537): N= Unknown
  misc_feature (539)..(539): N= Unknown
  misc_feature (541)..(543): N= Unknown
  misc_feature (546)..(546): N= Unknown
  misc_feature (548)..(554): N= Unknown
  misc_feature (556)..(559): N= Unknown
  misc_feature (561)..(575): N= Unknown
  misc_feature (577)..(578): N= Unknown
  misc_feature (581)..(587): N= Unknown
  misc_feature (589)..(601): N= Unknown
  misc_feature (604)..(605): N= Unknown
  misc_feature (607)..(612): N= Unknown
  misc_feature (615)..(619): N= Unknown
  misc_feature (621)..(622): N= Unknown
  misc_feature (624)..(626): N= Unknown
  misc_feature (628)..(632): N= Unknown
  misc_feature (634)..(635): N= Unknown
  misc_feature (637)..(645): N= Unknown
  misc_feature (647)..(651): N= Unknown
  misc_feature (653)..(654): N= Unknown
  misc_feature (656)..(657): N= Unknown
atgaaaaccttcttcaaaaccctttccgccgccgcactcgcgctcatcctcgccgcctgcggcggtcaaaaagatagcgcgcccgccgcatccgcttctgccgccgccgacaacggcgcggcgaanaaagaaatcgtcttcggcacgaccgtcggcgacttcggcgatatggtcaaagaacanatccaacccgagctggagaaaaaaggctacaccgtcaaactggtcgagtntaccgactatgtgcgcncgaatctggcattggctgagggcgagttggacatcaacgtcttncaacacanacnctatcttgacgactncaaaaaanaacacaatctggacatcaccnnagtcttncaagtgccgaccgcgcctttgggactgtacccgggcaagctgaaatcgctggannaagtcaaaganggcagcaccgtatccgcgcccaacgacccgtnnnacttcgnccgcgtcttggtgatgctcgacgaactgggttngatcaaactcaaagacngcatcannnngnngnnnnnancnanannnganannnnnnnannnntnnnnnnnnnnnnnnncnncgnnnnnnnannnnnnnnnnnnncgnntnnnnnngcnnnnntnnannntnnnnncnncnnnnnnnnntnnnnnannannagcggcatgaagctgaccgaagccctgttccaagaaccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaatcccctgccgcatggaatgaaggcgcagccaaataa

SEQ ID NO: 220 - protein, 287 aa, Neisseria meningitidis
  misc_feature (42)..(42): Xaa= any amino acid
  misc_feature (61)..(61): Xaa= any amino acid
  misc_feature (78)..(78): Xaa= any amino acid
  misc_feature (84)..(84): Xaa= any amino acid
  misc_feature (98)..(98): Xaa= any amino acid
  misc_feature (101)..(102): Xaa= any amino acid
  misc_feature (107)..(107): Xaa= any amino acid
  misc_feature (110)..(110): Xaa= any amino acid
  misc_feature (117)..(117): Xaa= any amino acid
  misc_feature (119)..(119): Xaa= any amino acid
  misc_feature (137)..(138): Xaa= any amino acid
  misc_feature (141)..(141): Xaa= any amino acid
  misc_feature (152)..(153): Xaa= any amino acid
  misc_feature (155)..(155): Xaa= any amino acid
  misc_feature (166)..(166): Xaa= any amino acid
  misc_feature (172)..(172): Xaa= any amino acid
  misc_feature (174)..(204): Xaa= any amino acid
  misc_feature (206)..(219): Xaa= any amino acid
MKTFFKTLSAAALALILAACGGQKDSAPAASASAAADNGAAXKEIVFGTTVGDFGDMVKEXIQPELEKKGYTVKLVEXTDYVRXNLALAEGELDINVXQHXXYLDDXKKXHNLDITXVXQVPTAPLGLYPGKLKSLXXVKXGSTVSAPNDPXXFXRVLVMLDELGXIKLKDXIXXXXXXXXXXXXXXXXXXXXXXXXXXXXXXXAXXXXXXXXXXXXXXSGMKLTEALFQEPSFAYVNWSAVKTADKDSQWLKDVTEAYNSDAFKAYAHKRFEGYKSPAAWNEGAAK

SEQ ID NO: 221 - DNA, 864 bp, Neisseria meningitidis
atgaaaaccttcttcaaaaccctttccgccgccgcactcgcgctcatcctcgccgcctgcggcggtcaaaaagatagcgcgcccgccgcatccgcttctgccgccgccgacaacggcgcggcgaaaaaagaaatcgtcttcggcacgaccgtcggcgacttcggcgatatggtcaaagaacaaatccaacccgagctggagaaaaaaggctacaccgtcaaactggtcgagtttaccgactatgtgcgcccgaatctggcattggctgagggcgagttggacatcaacgtcttccaacacaaaccctatcttgacgacttcaaaaaagaacacaatctggacatcaccgaagtcttccaagtgccgaccgcgcctttgggactgtacccgggcaagctgaaatcgctggaagaagtcaaagacggcagcaccgtatccgcgcccaacgacccgtccaacttcgcccgcgtcttggtgatgctcgacgaactgggttggatcaaactcaaagacggcatcaatccgctgaccgcatccaaagcggacattgccgaaaacctgaaaaacatcaaaatcgtcgagcttgaagccgcgcaactgccgcgtagccgcgccgacgtggattttgccgtcgtcaacggcaactacgccataagcagcggcatgaagctgaccgaagccctgttccaagaaccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaatcccctgccgcatggaatgaaggcgcagccaaataa

SEQ ID NO: 222 - protein, 287 aa, Neisseria meningitidis
MKTFFKTLSAAALALILAACGGQKDSAPAASASAAADNGAAKKEIVFGTTVGDFGDMVKEQIQPELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 223 - DNA, 8 bp, Neisseria gonorrhoeae
  misc_feature (1)..(8): N= Unknown
nnnnnnnn

SEQ ID NO: 224 - protein, 288 aa, Neisseria gonorrhoeae
MKTFFKTLSTASLALILAACGGQKDSAPAASAAAPSADNGAAKKEIVFGTTVGDFGDMVKEQIQAELEKKGYTVKLVEFTDYVRPNLALAEGELDINVFQHKPYLDDFKKEHNLDITEAFQVPTAPLGLYPGKLKSLEEVKDGSTVSAPNDPSNFARALVMLNELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKYPAAWNEGAAK

SEQ ID NO: 225 - DNA, 867 bp, Neisseria gonorrhoeae
atgaaaaccttcttcaaaaccctttccgccgccgcactcgcgctcatcctcgcagcctgcggcggtcaaaaagacagcgcgcccgcagcctctgccgccgccccttctgccgataacggcgcggcgaaaaaagaaatcgtcttcggcacgaccgtgggcgacttcggcgatatggtcaaagaacaaatccaagccgagctggagaaaaaaggctacaccgtcaaattggtcgaatttaccgactatgtgcgcccgaatctggcattggcggagggcgagttggacatcaacgtcttccaacacaaaccctatcttgacgatttcaaaaaagaacacaacctggacatcaccgaagccttccaagtgccgaccgcgcctttgggactgtatccgggcaaactgaaatcgctggaagaagtcaaagacggcagcaccgtatccgcgcccaacgacccgtccaacttcgcacgcgccttggtgatgctgaacgaactgggttggatcaaactcaaagacggcatcaatccgctgaccgcatccaaagccgacatcgcggaaaacctgaaaaacatcaaaatcgtcgagcttgaagccgcacaactgccgcgcagccgcgccgacgtggattttgccgtcgtcaacggcaactacgccataagcagcggcatgaagctgaccgaagccctgttccaagagccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaataccctgccgcatggaatgaaggcgcagccaaataa

SEQ ID NO: 226 - protein, 288 aa, Neisseria gonorrhoeae
MKTFFKTLSAAALALILAACGGQKDSAPAASAAAPSADNGAAKKEIVFGTTVGDFGDMVKEQIQAELEKKGYTVKLVEFTDYVRPNLALAEGELDINVFQHKPYLDDFKKEHNLDITEAFQVPTAPLGLYPGKLKSLEEVKDGSTVSAPNDPSNFARALVMLNELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKYPAAWNEGAAK

SEQ ID NO: 227 - DNA, 907 bp, Neisseria meningitidis
cctcgtcgtcctcggcatgctccagtttcaaggggcgatttactccaaggcggtggaacgtatgctcggcacggtcatcgggctgggcgcgggtttgggcgttttatggctgaaccagcattatttccacggcaacctcctcttctacctcaccgtcggcacggcaagcgcactggccggctgggcggcggtcggcaaaaacggctacgtccctmtgctggcagggctgacgatgtgtatgctcatcggcgacaacggcagcgaatggctcgacagcggactcatgcgcgccatgaacgtcctcatcggcgyggccatcgccatcgccgccgccaaactgctgccgctgaaatccacactgatgtggcgtttcatgcttgccgacaacctggccgactgcagcaaaatgattgccgaaatcagcaacggcaggcgcatgacccgcgaacgcctcgaggagaacatggcgaaaatgcgccaaatcaacgcacgcatggtcaaaagccgcagccatctcgccgccacatcgggcgaaagctgcatcagccccgccatgatggaagccatgcagcacgcccaccgtaaaatcgtcaacaccaccgagctgctcctgaccaccgccgccaagctgcaatctcccaaactcaacggcagcgaaatccggctgcttgaccgccacttcacactgctccaaacgcagacacgcccgccgcatccgcatcgacaccgccatcaaccccgaactggaagccctcgccgaacacctccactaccaatggcagggcttcctctggctcagcaccgatatgcgtcaggaaatttccgccctcgtcatcctgctgcaacgcacccgccgcaaatggctggatgcccacgaacgccaacacctgcgccaaagcctgcttga

SEQ ID NO: 228 - protein, 301 aa, Neisseria meningitidis
  misc_feature (72)..(72): Xaa= any amino acid
  misc_feature (195)..(195): Xaa= any amino acid
  misc_feature (224)..(224): Xaa= any amino acid
PRRPRHAPVSRGDLLQGGGTYARHGHRAGRGFGRFMAEPALFPRQPPLLPHRRHGKRTGRLGGGRQKRLRPXAGRADDVYAHRRQRQRMARQRTHARHERPHRRGHRHRRRQTAAAEIHTDVAFHACRQPGRLQQNDCRNQQRQAHDPRTPRGEHGENAPNQRTHGQKPQPSRRHIGRKLHQPRHDGSHAARPPXNRQHHRAAPDHRRQAAISQTQRQRNPAAXPPLHTAPNQTRPPHPHRHRHQPRTGSPRRTPPLPMAGLPLAQHRYASGNFRPRHPAATHPPQMAGCPRTPTPAPKPA

SEQ ID NO: 229 - DNA, 8 bp, Neisseria gonorrhoeae
  misc_feature (1)..(8): N= Unknown
nnnnnnnn

SEQ ID NO: 230 - protein, 318 aa, Neisseria gonorrhoeae
MDRDDRLRRPRHAPVPRRDLLQRGGTYARYGHRAGRGFGRFMAEPALFPRQPPLLPDHRHGKRTGRLGGGRQKRLRPYVGGADDVHAHRRQRQRMARQRPDARDERPHRRRHRHCRRQTAAAEIHTDVAFHACRQPGRLQQNDCRNQQRQAYDARTFGAEYGQNAPNQRTHGQKPQPPRRHIGRKPHQPLHDGSHAARPPQNRQHHRAAPDHRRQAAISQTQRQRNPAARPPLHTAPNRPATNRRPHQRQTRPPHPHRHRHQPRTGSPRRTPPLPMAGFPLAQHQYASGNFRPRHPPATHPPQMAGCPRTPTPAPKPA

SEQ ID NO: 231 - DNA, 567 bp, Neisseria meningitidis
  misc_feature (22)..(22): N= Unknown
  misc_feature (40)..(40): N= Unknown
gaaatcagcctgcggtccgacnacaggccggtttccgtgncgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggcggatggaaatgtccgcatcgtcggttgcgctgtgtgcggagaattcaaaaaggcacaagtgcaggaacagctcgcccgaaaaatcgagtggctgccgtcttccgcacaggctttggcatacgcaaccactaccgccaccccgaagaacacggttccgaccgctggttcaacgccttgggcagccgccgcttcagccgcaacgcctgcgtcgtcgtcagttgcggcacggcggtaacggttgacgcgctcaccgatgacggacattatctcggagaggaaccatcatgcccggtttccacctgatgaaagaatcgctcgccgtccgaaccgccaacctcaaccggcacgccggtaagcgttatcctttcccgaccgg

SEQ ID NO: 232 - protein, 189 aa, Neisseria meningitidis
  misc_feature (8)..(8): Xaa= any amino acid
  misc_feature (14)..(14): Xaa= any amino acid
  misc_feature (102)..(102): Xaa= any amino acid
  misc_feature (156)..(156): Xaa= any amino acid
EISLRSDXRPVSVXKRRDSERFLLLDGGNSRLKWAWVENGTFATVGSAPYRDLSPLGAEWAEKADGNVRIVGCAVCGEFKKAQVQEQLARKIEWLPSSAQAXGIRNHYRHPEEHGSDRWFNALGSRRFSRNACVVVSCGTAVTVDALTDDGHYLGXGTIMPGFHLMKESLAVRTANLNRHAGKRYPFPT

SEQ ID NO: 233 - DNA, 1779 bp, Neisseria meningitidis
atgacggttttgaagctttcgcactggcgggtgttggcggagcttgccgacggtttgccgcaacacgtctcgcaactggcgcgtatggcggatatgaagccgcagcagctcaacggtttttggcagcagatgccggcgcacatacgcgggctgttgcgccaacacgacggctattggcggctggtgcgcccattggcggttttcgatgccgaaggtttgcgcgagctgggggaaaggtcgggttttcagacggcattgaagcacgagtgcgcgtccagcaacgacgagatactggaattggcgcggattgcgccggacaaggcgcacaaaaccatatgcgtgacccacctgcaaagtaagggcagggggcggcaggggcggaagtggtcgcaccgtttgggcgagtgtctgatgttcagttttggctgggtgtttgaccggccgcagtatgagttgggttcgctgtcgcctgttgcggcagtggcgtgtcggcgcgccttgtcgcgtttaggtttggatgtgcagattaagtggcccaatgatttggttgtcggacgcgacaaattgggcggcattctgattgaaacggtcaggacgggcggcaaaacggttgccgtggtcggtatcggcatcaattttgtcctgcccaaggaagtagaaaatgccgcttccgtgcaatcgctgtttcagacggcatcgcggcggggcaatgccgatgccgccgtgctgctggaaacgctgttggtggaactggacgcggtgttgttgcaatatgcgcgggacggatttgcgccttttgtggcggaatatcaggctgccaaccgcgaccacggcaaggcggtattgctgttgcgcgacggcgaaaccgtgttcgaaggcacggttaaaggcgtggacggacaaggcgttttgcacttggaaacggcagagggcaaacagacggtcgtcagcggcgaaatcagcctgcggtccgacgacaggccggtttccgtgccgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggcggatggaaatgtccgcatcgtcggttgcgctgtgtgcggagaattcaaaaaggcacaagtgcaggaacagctcgcccgaaaaatcgagtggctgccgtcttccgcacaggctttgggcatacgcaaccactaccgccaccccgaagaacacggttccgaccgctggttcaacgccttgggcagccgccgcttcagccgcaacgcctgcgtcgtcgtcagttgcggcacggcggtaacggttgacgcgctcaccgatgacggacattatctcgggggaaccatcatgcccggtttccacctgatgaaagaatcgctcgccgtccgaaccgccaacctcaaccggcacgccggtaagcgttatcctttcccgaccacaacgggcaatgccgtcgccagcggcatgatggatgcggtttgcggctcggttatgatgatgcacgggcgtttgaaagaaaaaaccggggcgggcaagcctgtcgatgtcatcattaccggcggcggcgcggcaaaagttgccgaagccctgccgcctgcatttttggcggaaaataccgtgcgcgtggcggacaacctcgtcatttacgggttgttgaacatgattgccgccgaaggcagggaatatgaacatatttaa

SEQ ID NO: 234 - protein, 592 aa, Neisseria meningitidis
MTVLKLSHWRVLAELADGLPQHVSQLARMADMKPQQLNGFWQQMPAHIRGLLRQHDGYWRLVRPLAVFDAEGLRELGERSGFQTALKHECASSNDEILELARIAPDKAHKTICVTHLQSKGRGRQGRKWSHRLGECLMFSFGWVFDRPQYELGSLSPVAAVACRRALSRLGLDVQIKWPNDLVVGRDKLGGILIETVRTGGKTVAVVGIGINFVLPKEVENAASVQSLFQTASRRGNADAAVLLETLLVELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKADGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIYGLLNMIAAEGREYEHI

SEQ ID NO: 235 - DNA, 1779 bp, Neisseria meningitidis
atgacggttttgaagccttcgcactggcgggtgttggcggagcttgccgacggtttgccgcaacacgtctcgcaactggcgcgtatggcggatatgaagccgcagcagctcaacggtttttggcagcagatgccggcgcacatacgcgggctgttgcgccaacacgacggctattggcggctggtgcgcccattggcggttttcgatgccgaaggtttgcgcgagctgggggaaaggtcgggttttcagacggcattgaagcacgagtgcgcgtccagcaacgacgagatactggaattggcgcggattgcgccggacaaggcgcacaaaaccatatgtgtgacccacctgcaaagtaagggcagggggcggcaggggcggaagtggtcgcaccgtttgggcgagtgtctgatgttcagttttggctgggtgtttgaccggccgcagtatgagttgggttcgctgtcgcctgttgcggcagtggcgtgccggcgcgccttgtcgcgtttgggtttgaaaacgcaaatcaagtggccaaacgatttggtcgtcggacgcgacaaattgggcggcattctgattgaaacggtcaggacgggcggcaaaacggttgccgtggtcggtatcggcatcaatttcgtgctgcccaaggaagtggaaaacgccgcttccgtgcaatcgctgtttcagacggcatcgcggcggggaaatgccgatgccgccgtgttgctggaaacgctgttggcggaacttgatgcggtgttgttgcaatatgcgcgggacggatttgcgccttttgtggcggaatatcaggctgccaaccgcgaccacggcaaggcggtattgctgttgcgcgacggcgaaaccgtgttcgaaggcacggttaaaggcgtggacggacaaggcgttctgcacttggaaacggcagagggcaaacagacggtcgtcagcggcgaaatcagcctgcggtccgacgacaggccggtttccgtgccgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggtggatggaaatgtccgcatcgtcggttgcgccgtgtgcggagaattcaaaaaggcacaagtgcaggaacagctcgcccgaaaaatcgagtggctgccgtcttccgcacaggctttgggcatacgcaaccactaccgccaccccgaagaacacggttccgaccgctggttcaacgccttgggcagccgccgcttcagccgcaacgcctgcgtcgtcgtcagttgcggcacggcggtaacggttgacgcgctcaccgatgacggacattatctcgggggaaccatcatgcccggtttccacctgatgaaagaatcgctcgccgtccgaaccgccaacctcaaccggcacgccggtaagcgttatcctttcccgaccacaacgggcaatgccgtcgccagcggcatgatggatgcggtttgcggctcggttatgatgatgcacgggcgtttgaaagaaaaaaccggggcgggcaagcctgtcgatgtcatcattaccggcggcggcgcggcaaaagttgccgaagccctgccgcctgcatttttggcggaaaataccgtgcgcgtggcggacaacctcgtcattcacgggctgctgaacctgattgccgccgaaggcggggaatcggaacatacttaa

SEQ ID NO: 236 - protein, 592 aa, Neisseria meningitidis
MTVLKPSHWRVLAELADGLPQHVSQLARMADMKPQQLNGFWQQMPAHIRGLLRQHDGYWRLVRPLAVFDAEGLRELGERSGFQTALKHECASSNDEILELARIAPDKAHKTICVTHLQSKGRGRQGRKWSHRLGECLMFSFGWVFDRPQYELGSLSPVAAVACRRALSRLGLKTQIKWPNDLVVGRDKLGGILIETVRTGGKTVAVVGIGINFVLPKEVENAASVQSLFQTASRRGNADAAVLLETLLAELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKVDGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIHGLLNLIAAEGGESEHT

SEQ ID NO: 237 - DNA, 8 bp, Neisseria gonorrhoeae
  misc_feature (1)..(8): N= Unknown
nnnnnnnn

SEQ ID NO: 238 - protein, 455 aa, Neisseria gonorrhoeae
MFSFGWAFDRPQYELGSLSPVAALACRRALGCLGLETQIKWPNDLVVGRDKLGGILIETVRAGGKTVAVVGIGINFVLPKEVENAASVQSLFQTASRRGNADAAVLLETLLAELGAVLEQYAEEGFAPFLNEYETANRDHGKAVLLLRDGETVCEGTVKGVDGRGVLHLETAEGEQTVVSGEISLRPDNRSVSVPKRPDSERFLLLEGGNSRLKWAWVENGTFATVGSAPYRDLSPLGAEWAEKADGNVRIVGCAVCGESKKAQVKEQLARKIEWLPSSAQALGIRNHYRHPEEHGSDRWFNALGSRRFSRNACVVVSCGTAVTVDALTDDGHYLGGTIMPGFHLMKESLAVRTANLNRPAGKRYPFPTTTGNAVASGMMDAVCGSIMMMHGRLKEKNGAGKPVDVIITGGGAAKVAEALPPAFLAENTVRVADNLVIHGLLNLIAAEGGESEHA

SEQ ID NO: 239 - DNA, 1779 bp, Neisseria gonorrhoeae
atgacggttttgaagccttcgcattggcgggtgttggcggagcttgccgacggtttgccgcaacacgtatcgcaattggcgcgtgaggcggacatgaagccgcagcagctcaacggtttttggcagcagatgccggcgcatatacgcgggctgttgcgccaacacgacggctattggcggctggtgcgccccttggcggttttcgatgccgaaggtttgcgcgatctgggggaaaggtcgggttttcagacggcattgaagcacgagtgcgcgtccagcaacgacgagatactggaattggcgcggattgcgccggacaaggcgcacaaaaccatatgcgtgacccacctgcaaagtaagggcagggggcggcaggggcggaagtggtcgcaccgtttgggcgagtgcctgatgttcagtttcggctgggcgtttgaccggccgcagtatgagttgggttcgctgtcgcctgttgcggcacttgcgtgccggcgcgctttggggtgtttgggtttggaaacgcaaatcaagtggccaaacgatttggtcgtcggacgcgacaaattgggcggcattctgattgaaacagtcagggcgggcggtaaaacggttgccgtggtcggtatcggcatcaatttcgtgctgcccaaggaagtggaaaacgccgcttccgtgcagtcgctgtttcagacggcatcgcggcggggcaatgccgatgccgccgtattgctggaaacattgcttgcggaactgggcgcggtgttggaacaatatgcggaagaagggttcgcgccatttttaaatgagtatgaaacggccaaccgcgaccacggcaaggcggtattgctgttgcgcgacggcgaaaccgtgtgcgaaggcacggttaaaggcgtggacggacgaggcgttctgcacttggaaacggcagaaggcgaacagacggtcgtcagcggcgaaatcagcctgcggcccgacaacaggtcggtttccgtgccgaagcggccggattcggaacgttttttgctgttggaaggcgggaacagccggctcaagtgggcgtgggtggaaaacggcacgttcgcaaccgtgggcagcgcgccgtaccgcgatttgtcgcctttgggcgcggagtgggcggaaaaggcggatggaaatgtccgcatcgtcggttgcgccgtgtgcggagaatccaaaaaggcacaagtgaaggaacagctcgcccgaaaaatcgagtggctgccgtcttccgcacaggctttgggcatacgcaaccactaccgccaccccgaagaacacggttccgaccgttggttcaacgccttgggcagccgccgcttcagccgcaacgcctgcgtcgtcgtcagttgcggcacggcggtaacggttgacgcgctcaccgatgacggacattatctcggcggaaccatcatgcccggcttccacctgatgaaagaatcgctcgccgtccgaaccgccaacctcaaccgccccgccggcaaacgttaccctttcccgaccacaacgggcaacgccgtcgcaagcggcatgatggacgcggtttgcggctcgataatgatgatgcacggccgtttgaaagaaaaaaacggcgcgggcaagcctgtcgatgtcatcattaccggcggcggcgcggcgaaagtcgccgaagccctgccgcctgcatttttggcggaaaataccgtgcgcgtggcggacaacctcgtcatccacgggctgctgaacctgattgccgccgaaggcggggaatcggaacacgcttaa

SEQ ID NO: 240 - protein, 592 aa, Neisseria gonorrhoeae
MTVLKPSHWRVLAELADGLPQHVSQLAREADMKPQQLNGFWQQMPAHIRGLLRQHDGYWRLVRPLAVFDAEGLRDLGERSGFQTALKHECASSNDEILELARIAPDKAHKTICVTHLQSKGRGRQGRKWSHRLGECLMFSFGWAFDRPQYELGSLSPVAALACRRALGCLGLETQIKWPNDLVVGRDKLGGILIETVRAGGKTVAVVGIGINFVLPKEVENAASVQSLFQTASRRGNADAAVLLETLLAELGAVLEQYAEEGFAPFLNEYETANRDHGKAVLLLRDGETVCEGTVKGVDGRGVLHLETAEGEQTVVSGEISLRPDNRSVSVPKRPDSERFLLLEGGNSRLKWAWVENGTFATVGSAPYRDLSPLGAEWAEKADGNVRIVGCAVCGESKKAQVKEQLARKIEWLPSSAQALGIRNHYRHPEEHGSDRWFNALGSRRFSRNACVVVSCGTAVTVDALTDDGHYLGGTIMPGFHLMKESLAVRTANLNRPAGKRYPFPTTTGNAVASGMMDAVCGSIMMMHGRLKEKNGAGKPVDVIITGGGAAKVAEALPPAFLAENTVRVADNLVIHGLLNLIAAEGGESEHA

SEQ ID NO: 241 - DNA, 648 bp, Neisseria meningitidis
atgttttaccaaatccttgccctgattatctggagcagctcgtttattgccgccaaatatgtctatggcggcatcgatcccgcattgatggtcggcgtgcgcctgctaattgccgcgctgcctgcactgcccgcctgccgccgtcatgtcggcaagattccgcgtgaggaatggaagccgttgctgattgtgtcgttcgtcaactatgtgctgaccctgctgcttcagtttgtcgggttgaaatacacttccgccgccagcgcatcggtcattgtcggactcgagccgctgctgatggtgtttgtcggacactttttcttcaacgacaaagcgcgtgcctaccactggatatgcggcgcggcggcatttgccggtgtcgcgctgctgatggcgggcggtgcggaagagggcggcgaagtcggctggttcggctgcctgctggtgttgttggcgggcgcgggcttttgtgccgctatgcgtccgacgcaaaggctgattgcacgcatcggcgcaccggcattcacatctgtttccattgccgccgcatcgttgatgtgcctgccgttttcgcttgctttggcgcaaagttataccgtggactggagcgtcgggatggtattgtcgctgctgtatttgggtttggggtgc

SEQ ID NO: 242 - protein, 216 aa, Neisseria meningitidis
MFYQILALIIWSSSFIAAKYVYGGIDPALMVGVRLLIAALPALPACRRHVGKIPREEWKPLLIVSFVNYVLTLLLQFVGLKYTSAASASVIVGLEPLLMVFVGHFFFNDKARAYHWICGAAAFAGVALLMAGGAEEGGEVGWFGCLLVLLAGAGFCAAMRPTQRLIARIGAPAFTSVSIAAASLMCLPFSLALAQSYTVDWSVGMVLSLLYLGLGC

SEQ ID NO: 243 - DNA, 855 bp, Neisseria meningitidis
atgttttaccaaatccttgccctgattatctggagcagctcgtttattgccgccaaatatgtctatggcggcatcgatcccgcattgatggtcggcgtgcgcctgctaattgccgcgctgcctgcactgcccgcctgccgccgtcatgtcggcaagattccgcgtgaggaatggaagccgttgctgattgtgtcgttcgtcaactatgtgctgaccctgctgcttcagtttgtcgggttgaaatacacttccgccgccagcgcatcggtcattgtcggactcgagccgctgctgatggtgtttgtcggacactttttcttcaacgacaaagcgcgtgcctaccactggatatgcggcgcggcggcatttgccggtgtcgcgctgctgatggcgggcggtgcggaagagggcggcgaagtcggctggttcggctgcctgctggtgttgttggcgggcgcgggcttttgtgccgctatgcgtccgacgcaaaggctgattgcacgcatcggcgcaccggcattcacatctgtttccattgccgccgcatcgttgatgtgcctgccgttttcgcttgctttggcgcaaagttataccgtggactggagcgtcgggatggtattgtcgctgctgtatttgggtttggggtgcggctggtacgcctattggctgtggaacaaggggatgagccgtgttcctgccaatgtttcgggactgttgatttcgctcgaacccgtcgtcggcgtgctgctggcggttttgattttgggcgaacacctgtcgcccgtgtccgccttgggcgtgtttgtcgtcatcgccgccaccttggttgccggccggctgtcgcatcaaaaataa

SEQ ID NO: 244 - protein, 284 aa, Neisseria meningitidis
MFYQILALIIWSSSFIAAKYVYGGIDPALMVGVRLLIAALPALPACRRHVGKIPREEWKPLLIVSFVNYVLTLLLQFVGLKYTSAASASVIVGLEPLLMVFVGHFFFNDKARAYHWICGAAAFAGVALLMAGGAEEGGEVGWFGCLLVLLAGAGFCAAMRPTQRLIARIGAPAFTSVSIAAASLMCLPFSLALAQSYTVDWSVGMVLSLLYLGLGCGWYAYWLWNKGMSRVPANVSGLLISLEPVVGVLLAVLILGEHLSPVSALGVFVVIAATLVAGRLSHQK

SEQ ID NO: 245 - DNA, 855 bp, Neisseria meningitidis
atgttttaccaaatccttgccctgattatctggagcagctcgtttattgccgccaaatatgtctatggcggcatcgatcccgcattgatggtcggcgtgcgcctgctgattgctgcgctgcctgcactgcccgcctgccgccgtcatgtcggcaagattccgcgtgaggaatggaagccgttgctgattgtgtcgttcgtcaactatgtgctgaccctgctacttcagtttgtcgggttgaaatacacttccgccgccagcgcatcggtcattgtcggactcgagccactgctgatggtgtttgtcggacactttttcttcaacgacaaagcgcgtgcctaccactggatatgcggcgcggcggcatttgccggtgtcgcgctgctgatggcgggcggtgcggaagagggcggcgaagtcggctggttcggctgcctgctggtgttgttggcgggcgcgggcttttgtgccgctatgcgtccgacgcaaaggctgattgcacgcatcggcgcaccggcattcacatctgtttccattgccgccgcatcgttgatgtgcctgccgttttcgcttgctttggcgcaaagttataccgtggactggagcgtcggaatggtattgtcgctgctgtatttgggcgtggggtgcagctggtacgcctattggctgtggaacaaggggatgagccgtgttcctgccaacgtttcgggactgttgatttcgctcgaacccgtcgtcggcgtgctgctggcggttttgattttgggcgaacacctgtcgcccgtgtccgtcttgggcgtgtttgtcgtcatcgccgccaccttggttgccggccggctgtcgcatcaaaaataa

SEQ ID NO: 246 - protein, 284 aa, Neisseria meningitidis
MFYQILALIIWSSSFIAAKYVYGGIDPALMVGVRLLIAALPALPACRRHVGKIPREEWKPLLIVSFVNYVLTLLLQFVGLKYTSAASASVIVGLEPLLMVFVGHFFFNDKARAYHWICGAAAFAGVALLMAGGAEEGGEVGWFGCLLVLLAGAGFCAAMRPTQRLIARIGAPAFTSVSIAAASLMCLPFSLALAQSYTVDWSVGMVLSLLYLGVGCSWYAYWLWNKGMSRVPANVSGLLISLEPVVGVLLAVLILGEHLSPVSVLGVFVVIAATLVAGRLSHQK

SEQ ID NO: 247 - DNA, 876 bp, Neisseria gonorrhoeae
atgttttaccaaatccttgccctgattatctggggcagctcgtttattgccgccaaatatgtctatggcggcatcgatcccgcattgatggtcggcgtgcgcctgctgattgccgcgctgcctgcactgcccgcctgccgccgtcatgtcggcaagattccgcgtgaggaatggaagccgttgctgattgtgtcgttcgtcaactatgtgctgaccctgctgcttcagtttgtcgggttgaaatacacttccgccgccagcgcatcggtcattgtcggactcgagccgctgctgatggtgtttgtcggacactttttcttcaacgacaaagcgcgtgcctaccactggatatgcggcgcggcggcatttgccggtgtcgcgctgctgatggcgggcggtgcggaagagggcggcgaagtcggctggttcggctgcctgctggtgttgttggcgggcgcgggcttttgtgccgctatgcgtccgacgcaaaggctgattgcccgcatcggcgcaccggcattcacatctgtttccattgccgccgcatcgttgatgtgcctgccgttttcgcttgctttggcgcaaagttataccgtggactggagcgtcgggatggtattgtcgctgttgtatttgggtttggggtgcggctggtacgcctattggctgtggaacaaggggatgagccgtgttcctgccaacgcgtcgggactgttgatttcgctcgaacccgtcgtcggcgtgctgttggcggttttgattttgggcgaacatttatcgcccgtgtccgccttgggcgtgtttgtcgtcatcgccgccactttcgccgccggccggctgtcgcgcagggacgcgcaaaacggcaatgccgtctga

SEQ ID NO: 248 - protein, 291 aa, Neisseria gonorrhoeae
MFYQILALIIWGSSFIAAKYVYGGIDPALMVGVRLLIAALPALPACRRHVGKIPREEWKPLLIVSFVNYVLTLLLQFVGLKYTSAASASVIVGLEPLLMVFVGHFFFNDKARAYHWICGAAAFAGVALLMAGGAEEGGEVGWFGCLLVLLAGAGFCAAMRPTQRLIARIGAPAFTSVSIAAASLMCLPFSLALAQSYTVDWSVGMVLSLLYLGLGCGWYAYWLWNKGMSRVPANASGLLISLEPVVGVLLAVLILGEHLSPVSALGVFVVIAATFAAGRLSRRDAQNGNAV

SEQ ID NO: 249 - DNA, 1182 bp, Neisseria meningitidis
atgcgccgttttctaccgatcgcagccatatgcgcmgwmstcctgkkgtasggactgacggcggcaaccggcagcaccagttcgctggcggattatttctggtggattgttgcgttcagcgcaatgctgctgctggtgttgtccgccgttttggcacgttatgtcatattgctgttgaaagacaggcgcgacggcgtattcggttcgctasrtygccaaagsgcctgkkstgggatgtttacgctggttgccgkactgcccggcgtgtttctgttcggctttcccgcacagttcatcaacggcacgattaattcgtggttcggcaacgatacccacgaggcgcttgaacgcagcctcaatttgagcaagtccgcattgaatttggcggcagacaacgccctcggcaacgccgtccccgtgcagatagacctcatcggcgcggcttccctgcccggggatatgggcagggtgctggaacattacgccggcagcggttttgcccagcttgccctgtacaaykscgcaagcggcaaaatcgaaaaaagcatcaacccgcacaagctcgatcagccgtttccaggtaaggcgcgttgggaaaaaatccaacgggcgggttcggtcagggatttggaaagcataggcggcgtattgtacgcgcagggctggctgtcggcgggtacgcacwacgggcgcgattacgccttgtttttccgtcagccggttcccaaaggcgtggcagaggatgccgtyttaatcgaaaaggcaagggcgaaatatgctgagttgagttacagcaaaaaaggtttgcagacctttttcctggcaaccctgctgattgcctcgctgctgtcgatttttcttgcactggtcatggcactgtatttcgcccgccgtttcgtcgaacccgtcctatcgcttgccgagggggcgaaggcggtggcgcaaggcgatttcagccagacgcgccccgtgttgcgcaacgacgagttcggacgcttgaccargttgttcaaccacatgaccgagcagctttccatcgccaaagatgcagacgagcgcaaccgccggcgcgaggaagccgccaggcattatcttgaatgcgtgttggaggggctgaccacgggcgtggtggtgtttgacgaacaaggctgtctgaaaaccttcaacaaagcggcgggtacc

SEQ ID NO: 250 - protein, 394 aa, Neisseria meningitidis
  misc_feature (13)..(14): Xaa= any amino acid
  misc_feature (16)..(17): Xaa= any amino acid
  misc_feature (70)..(71): Xaa= any amino acid
  misc_feature (74)..(74): Xaa= any amino acid
  misc_feature (76)..(78): Xaa= any amino acid
  misc_feature (85)..(85): Xaa= any amino acid
  misc_feature (174)..(174): Xaa= any amino acid
  misc_feature (229)..(229): Xaa= any amino acid
  misc_feature (335)..(335): Xaa= any amino acid
MRRFLPIAAICAXXLXXGLTAATGSTSSLADYFWWIVAFSAMLLLVLSAVLARYVILLLKDRRDGVFGSXXAKXPXXXMFTLVAXLPGVFLFGFPAQFINGTINSWFGNDTHEALERSLNLSKSALNLAADNALGNAVPVQIDLIGAASLPGDMGRVLEHYAGSGFAQLALYNXASGKIEKSINPHKLDQPFPGKARWEKIQRAGSVRDLESIGGVLYAQGWLSAGTHXGRDYALFFRQPVPKGVAEDAVLIEKARAKYAELSYSKKGLQTFFLATLLIASLLSIFLALVMALYFARRFVEPVLSLAEGAKAVAQGDFSQTRPVLRNDEFGRLTXLFNHMTEQLSIAKDADERNRRREEAARHYLECVLEGLTTGVVVFDEQGCLKTFNKAAGT

SEQ ID NO: 251 - DNA, 2121 bp, Neisseria meningitidis
atgcgccgttttctaccgatcgcagccatatgcgccgtcgtcctgttgtacggactgacggcggcaaccggcagcaccagttcgctggcggattatttctggtggattgttgcgttcagcgcaatgctgctgctggtgttgtccgccgttttggcacgttatgtcatattgctgttgaaagacaggcgcgacggcgtattcggttcgcagattgccaaacgcctttctgggatgtttacgctggttgccgtactgcccggcgtgtttctgttcggcgtttccgcacagttcatcaacggcacgattaattcgtggttcggcaacgatacccacgaggcgcttgaacgcagcctcaatttgagcaagtccgcattgaatttggcggcagacaacgccctcggcaacgccgtccccgtgcagatagacctcatcggcgcggcttccctgcccggggatatgggcagggtgctggaacattacgccggcagcggttttgcccagcttgccctgtacaatgccgcaagcggcaaaatcgaaaaaagcatcaacccgcacaagctcgatcagccgtttccaggtaaggcgcgttgggaaaaaatccaacgggcgggttcggtcagggatttggaaagcataggcggcgtattgtacgcgcagggctggctgtcggcgggtacgcacaacgggcgcgattacgccttgtttttccgtcagccggttcccaaaggcgtggcagaggatgccgtcttaatcgaaaaggcaagggcgaaatatgctgagttgagttacagcaaaaaaggtttgcagacctttttcctggcaaccctgctgattgcctcgctgctgtcgatttttcttgcactggtcatggcactgtatttcgcccgccgtttcgtcgaacccgtcctatcgcttgccgagggggcgaaggcggtggcgcaaggcgatttcagccagacgcgccccgtgttgcgcaacgacgagttcggacgcttgaccaagttgttcaaccacatgaccgagcagctttccatcgccaaagaagcagacgagcgcaaccgccggcgcgaggaagccgccaggcattatcttgaatgcgtgttggaggggctgaccacgggcgtggtggtgtttgacgaacaaggctgtctgaaaaccttcaacaaagcggcggaacagattttggggatgccgcttacccccctgtggggcagcagccggcacggttggcacggcgtttcggcgcagcagtccctgcttgccgaagtgtttgccgccatcggcgcggcggcaggtacggacaaaccggtccatgtgaaatatgccgcgccggacgatgccaaaatcctgctgggcaaggcaaccgtcctgcccgaagacaacggcaacggcgtggtaatggtgattgacgacatcaccgttttgatacacgcgcaaaaagaagccgcgtggggcgaagtggcgaagcggctggcacacgaaatccgcaatccgctcacgcccatccagctttccgccgaacggctggcgtggaaattgggcgggaagctggatgagcaggatgcgcaaatcctgacgcgttcgaccgacaccatcgtcaaacaggtggcggcattgaaggaaatggtcgaagcattccgcaattatgcgcgttccccttcgctcaaattggaaaatcaggatttgaacgccttaatcggcgatgtgttggcattgtatgaagccggtccgtgccggtttgcggcggagcttgccggcgaaccgctgacggtggcggcggatacgaccgccatgcggcaggtgctgcacaatattttcaaaaatgccgccgaagcggcggaagaagccgatgtgcccgaagtcagggtaaaatcggaaacagggcaggacggtcggattgtcctgacggtttgcgacaacggcaaagggttcggcagggaaatgctgcacaacgccttcgagccgtatgtaacggacaaaccggcgggaacgggattgggtctgcctgtggtgaaaaaaatcattgaagaacacggcggccgcatcagcctgagcaatcaggatgcgggtggcgcgtgtgtcagaatcatcttgccaaaaacggtaaaaacttatgcgtag

SEQ ID NO: 252 - protein, 706 aa, Neisseria meningitidis
MRRFLPIAAICAVVLLYGLTAATGSTSSLADYFWWIVAFSAMLLLVLSAVLARYVILLLKDRRDGVFGSQIAKRLSGMFTLVAVLPGVFLFGVSAQFINGTINSWFGNDTHEALERSLNLSKSALNLAADNALGNAVPVQIDLIGAASLPGDMGRVLEHYAGSGFAQLALYNAASGKIEKSINPHKLDQPFPGKARWEKIQRAGSVRDLESIGGVLYAQGWLSAGTHNGRDYALFFRQPVPKGVAEDAVLIEKARAKYAELSYSKKGLQTFFLATLLIASLLSIFLALVMALYFARRFVEPVLSLAEGAKAVAQGDFSQTRPVLRNDEFGRLTKLFNHMTEQLSIAKEADERNRRREEAARHYLECVLEGLTTGVVVFDEQGCLKTFNKAAEQILGMPLTPLWGSSRHGWHGVSAQQSLLAEVFAAIGAAAGTDKPVHVKYAAPDDAKILLGKATVLPEDNGNGVVMVIDDITVLIHAQKEAAWGEVAKRLAHEIRNPLTPIQLSAERLAWKLGGKLDEQDAQILTRSTDTIVKQVAALKEMVEAFRNYARSPSLKLENQDLNALIGDVLALYEAGPCRFAAELAGEPLTVAADTTAMRQVLHNIFKNAAEAAEEADVPEVRVKSETGQDGRIVLTVCDNGKGFGREMLHNAFEPYVTDKPAGTGLGLPVVKKIIEEHGGRISLSNQDAGGACVRIILPKTVKTYA

SEQ ID NO: 253 - DNA, 2121 bp, Neisseria meningitidis
  misc_feature (427)..(427): N= Unknown
  misc_feature (451)..(451): N= Unknown
  misc_feature (625)..(626): N= Unknown
  misc_feature (657)..(657): N= Unknown
  misc_feature (674)..(675): N= Unknown
  misc_feature (769)..(769): N= Unknown
  misc_feature (772)..(772): N= Unknown
  misc_feature (774)..(776): N= Unknown
  misc_feature (778)..(778): N= Unknown
  misc_feature (819)..(819): N= Unknown
  misc_feature (840)..(840): N= Unknown
  misc_feature (1384)..(1384): N= Unknown
  misc_feature (1560)..(1560): N= Unknown
  misc_feature (1648)..(1648): N= Unknown
  misc_feature (1663)..(1663): N= Unknown
  misc_feature (1999)..(1999): N= Unknown
  misc_feature (2042)..(2042): N= Unknown
  misc_feature (2078)..(2078): N= Unknown
atgcgccgttttctaccgatcgcagccatatgcgccgtcgtcctgttgtacggactgacggcggcaaccggcagcaccagttcgctggcggattatttctggtggattgttgcgttcagcgcaatgctgctgctggtgttgtccgccgttttggcacgttatgtcatattgctgttgaaagacaggcgcgacggcgtattcggttcgcagattgccaaacgcctttccgggatgtttacgctggttgccgtactgcccggcgtgtttctgttcggcgtttccgcacagtttatcaacggcacgattaattcgtggttcggcaacgatacccacgaggcgcttgaacgcagcctcaatttgagcaagtccgcattgaatctggcggcagacaacgcccttggcaacgccatccccgtgcagatagacntcatcggcgcggcttccctgcccngggatatgggcagggtgctggaacattacgccggcagcggttttgcccagcttgccctgtacaatgccgcaagcggcaaaatcgaaaaaagcatcaacccgcacaagctcgatcagccgtttccaggtaaggcgcgttgggaaaaaatccaacaggcgggttcggtcagggatnnggaaagcataggcggcgtattgtacgcgcanggctggctgtcggcagnnacgcacaacgggcgcgattacgccttgtttttccgtcagccggttcccaaaggcgtggcagaggatgccgtcttaatcgaaaaggcaagggcgnaanannntnagttgagttacagcaaaaaaggtttgcagacctttttcctngcaaccctgctgattgcctcnctgctgtcgatttttcttgcactggtcatggcactgtatttcgcccgccgtttcgtcgaacccgtcctatcgcttgccgagggggcgaaggcggtggcgcaaggcgatttcagccagacgcgccccgtgttgcgcaacgacgagttcggacgcttgaccaagttgttcaaccacatgaccgagcagctttccatcgccaaagaagcagacgagcgcaaccgccggcgcgaggaagccgccagacattatctcgaatgcgtgttggaggggctgaccacgggcgtggtggtgtttgacgaacaaggctgtctgaaaaccttcaacaaagcggcggaacagattttggggatgccgcttacccccctgtggggcagcagccggcacggttggcacggcgtttcggcgcagcagtccctgcttgccgaagtgtttgccgccatcggcgcggcggcaggtacggacaaaccggtccatgtgaaatatgccgcgccggacgatgccaaaatcctgctgggcaaggcaaccgtcctgcccgaagacaacngcaacggcgtggtaatggtgattgacgacatcaccgttttgatacacgcgcaaaaagaagccgcgtggggcgaagtggcaaaacggctggcacacgaaatccgcaatccgctcacgcccatccagctttctgccgaacggctggcgtggaaattgggcgggaagctggacgagcangacgcgcaaatcctgacacgttcgaccgacaccatcatcaaacaagtggcggcattaaaagaaatggtcgaggcattccgcaattacncgcgttccccttcgnctcaattggaaaatcaggatttgaacgccttaatcggcgatgtgttggcattgtacgaagctggtccgtgccggtttgcggcggaacttgccggcgaaccgctgatgatggcggcggatacgaccgccatgcggcaggtgctgcacaatattttcaaaaatgccgccgaagcggcggaagaagccgatgtgcccgaagtcagggtaaaatcggaagcggggcaggacggacggattgtcctgacagtttgcgacaacggcaaggggttcggcagggaaatgctgcacaatgccttcgagccgtatgtaacggacaaaccggctggaacgggattgngactgcccgtggtgaaaaaaatcattgaagaacacggcggccncatcagcctgagcaatcaggatgcgggcggcgcgtntgtcagaatcatcttgccaaaaacggtagaaacttatgcgtag

SEQ ID NO: 254 - protein, 706 aa, Neisseria meningitidis
  misc_feature (143)..(143): Xaa= any amino acid
  misc_feature (151)..(151): Xaa= any amino acid
  misc_feature (209)..(209): Xaa= any amino acid
  misc_feature (219)..(219): Xaa= any amino acid
  misc_feature (225)..(225): Xaa= any amino acid
  misc_feature (257)..(260): Xaa= any amino acid
  misc_feature (462)..(462): Xaa= any amino acid
  misc_feature (520)..(520): Xaa= any amino acid
  misc_feature (550)..(550): Xaa= any amino acid
  misc_feature (555)..(555): Xaa= any amino acid
  misc_feature (667)..(667): Xaa= any amino acid
  misc_feature (681)..(681): Xaa= any amino acid
  misc_feature (693)..(693): Xaa= any amino acid
MRRFLPIAAICAVVLLYGLTAATGSTSSLADYFWWIVAFSAMLLLVLSAVLARYVILLLKDRRDGVFGSQIAKRLSGMFTLVAVLPGVFLFGVSAQFINGTINSWFGNDTHEALERSLNLSKSALNLAADNALGNAIPVQIDXIGAASLPXDMGRVLEHYAGSGFAQLALYNAASGKIEKSINPHKLDQPFPGKARWEKIQQAGSVRDXESIGGVLYAXGWLSAXTHNGRDYALFFRQPVPKGVAEDAVLIEKARAXXXXLSYSKKGLQTFFLATLLIASLLSIFLALVMALYFARRFVEPVLSLAEGAKAVAQGDFSQTRPVLRNDEFGRLTKLFNHMTEQLSIAKEADERNRRREEAARHYLECVLEGLTTGVVVFDEQGCLKTFNKAAEQILGMPLTPLWGSSRHGWHGVSAQQSLLAEVFAAIGAAAGTDKPVHVKYAAPDDAKILLGKATVLPEDNXNGVVMVIDDITVLIHAQKEAAWGEVAKRLAHEIRNPLTPIQLSAERLAWKLGGKLDEXDAQILTRSTDTIIKQVAALKEMVEAFRNYXRSPSXQLENQDLNALIGDVLALYEAGPCRFAAELAGEPLMMAADTTAMRQVLHNIFKNAAEAAEEADVPEVRVKSEAGQDGRIVLTVCDNGKGFGREMLHNAFEPYVTDKPAGTGLXLPVVKKIIEEHGGXISLSNQDAGGAXVRIILPKTVETYA

SEQ ID NO: 255 - DNA, 8 bp, Neisseria gonorrhoeae
  misc_feature (1)..(8): N= Unknown
nnnnnnnn

SEQ ID NO: 256 - protein, 400 aa, Neisseria gonorrhoeae
MRRFLPIAAICAVVLLYGLTAATGSTSSLADYFWWIVSFSAMLLLVLSAVLARYVILLLKDRRNGVFGSQIAKRLSGMFTLVAVLPGLFLFGISAQFINGTINSWFGNDTHEALERSLNLSKSALDLAADNAVSNAVPVQIDLIGTASLSGNMGSVLEHYAGSGFAQLALYNAASGKIEKSINPHQFDQPLPDKEHWEQIQQTGSVRSLESIGGVLYAQGWLSAGTHNGRDYALFFRQPIPENVAQDAVLIEKARAKYAELSYSKKGLQTFFLVTLLIASLLSIFLALVMALYFARRFVEPILSLAEGAKAVAQGDFSQTRPVLRNDEFGRLTKLFNHMTEQLSIAKEADERNRRREEAARHYLECVLDGLTTGVVVSYPLSCCRTAVFSTCHSSPLSYF

SEQ ID NO: 257 - DNA, 2121 bp, Neisseria gonorrhoeae
atgcgccgcttcctaccgatcgcagccatatgcgccgtcgtcctgctgtacggattgacggcggcgaccggcagcaccagttcgctggcggattatttctggtggatagtctcgttcagcgcaatgctgctgctggtgttgtccgccgttttggcacgttatgtcatattgctgttgaaagacaggcgcaacggcgtgttcggttcgcagattgccaaacgcctttccgggatgttcacgctggtcgccgtactgcccggcttgttcctgttcggcatttccgcgcagtttatcaacggcacgattaattcgtggttcggcaacgacacccacgaagccctcgaacgcagccttaatttgagcaagtccgcactggatttggcggcagacaatgccgtcagcaacgccgttcccgtacagatagacctcatcggcaccgcctccctgtcgggcaatatgggcagtgtgctggaacactacgccggcagcggttttgcccagcttgccctgtacaatgccgcaagcgggaaaatcgaaaaaagcatcaatccgcaccaattcgaccagccgcttcccgacaaagaacattgggaacagattcagcagaccggttcggttcggagtttggaaagcataggcggcgtattgtacgcgcagggatggttgtcggcaggtacgcacaacgggcgcgattacgcgctgttcttccgccagccgattcccgaaaatgtggcacaggatgccgttctgattgaaaaggcgcgggcgaaatatgccgaattgagttacagcaaaaaaggtttgcagaccttttttctggtaaccctgctgattgcctcgctgctgtcgatttttcttgcgctggtaatggcactgtattttgcccgccgtttcgtcgaacccattctgtcgcttgccgagggcgcaaaggcggtggcgcagggtgatttcagccagacgcgccccgtattgcgcaacgacgagttcggacgtttgaccaagctgttcaaccatatgaccgagcagctttccatcgccaaagaagcagacgaacgcaaccgccggcgcgaggaagccgcccgtcactacctcgagtgcgtgttggatgggttgactaccggtgtggtggtgtttgacgaaaaaggccgtttgaaaaccttcaacaaggcggcggaacagattttggggatgccgctcgcccccctgtggggcagcagccggcacggttggcacggcgtttcggcgcagcagtccctgcttgccgaagtgtttgccgccatcggtgcggcggcaggtacggacaaaccggtccaggtggaatatgccgcgccggacgatgccaaaatcctgctgggcaaggcgacggtattgcccgaagacaacggcaacggcgtggtgatggtgattgacgacatcaccgtgctgatacgcgcgcaaaaagaagccgcgtggggtgaagtggcgaagcggctggcacacgaaatccgcaatccgctcacgcccatccagctttccgccgaacggctggcgtggaaattgggcgggaagctggacgatcaggacgcgcaaatcctgacgcgttcgaccgacaccatcatcaaacaggtggcggcgttaaaagaaatggtcgaggcattccgcaattacgcgcgcgccccttcgctcaaactggaaaatcaggatttgaacgccttaatcggcgatgttttggccctgtacgaagccggcccgtgccggtttgaggcggaacttgccggcgaaccgctgatgatggcggcggatacgaccgccatgcggcaggtgctgcacaatattttcaaaaatgccgccgaagcggcggaagaagccgatatgcccgaagtcagggtaaaatcggaaacggggcaggacggacggattgtcctgacggtttgcgacaacggcaagggattcggcaaggaaatgctgcacaatgctttcgagccgtatgtgacggataagccggcgggaacgggactgggtctgcctgtagtgaaaaaaatcattggagaacacggcggccgcatcagcctgagcaatcaggatgcgggtggggcgtgtgtcagaatcatcttgccaaaaacggtagaaacttatgcgtag

SEQ ID NO: 258 - protein, 706 aa, Neisseria gonorrhoeae
MRRFLPIAAICAVVLLYGLTAATGSTSSLADYFWWIVSFSAMLLLVLSAVLARYVILLLKDRRNGVFGSQIAKRLSGMFTLVAVLPGLFLFGISAQFINGTINSWFGNDTHEALERSLNLSKSALDLAADNAVSNAVPVQIDLIGTASLSGNMGSVLEHYAGSGFAQLALYNAASGKIEKSINPHQFDQPLPDKEHWEQIQQTGSVRSLESIGGVLYAQGWLSAGTHNGRDYALFFRQPIPENVAQDAVLIEKARAKYAELSYSKKGLQTFFLVTLLIASLLSIFLALVMALYFARRFVEPILSLAEGAKAVAQGDFSQTRPVLRNDEFGRLTKLFNHMTEQLSIAKEADERNRRREEAARHYLECVLDGLTTGVVVFDEKGRLKTFNKAAEQILGMPLAPLWGSSRHGWHGVSAQQSLLAEVFAAIGAAAGTDKPVQVEYAAPDDAKILLGKATVLPEDNGNGVVMVIDDITVLIRAQKEAAWGEVAKRLAHEIRNPLTPIQLSAERLAWKLGGKLDDQDAQILTRSTDTIIKQVAALKEMVEAFRNYARAPSLKLENQDLNALIGDVLALYEAGPCRFEAELAGEPLMMAADTTAMRQVLHNIFKNAAEAAEEADMPEVRVKSETGQDGRIVLTVCDNGKGFGKEMLHNAFEPYVTDKPAGTGLGLPVVKKIIGEHGGRISLSNQDAGGACVRIILPKTVETYA

SEQ ID NO: 259 - DNA, 465 bp, Neisseria meningitidis
atgtacgcatttaccgccgcacagcaacagaaggcactcttccggctggtgctttttcatatcctcatcatcgccgccagcaactatctggtgcagttccctttccaaattttcggcatccacaccacttggggcgcattttcctttcccttcatcttccttgccaccgacctgaccgtccgcattttcggttctcacttggcacggcggattatcttttgggtgatgttccccgcccttttgctttcctacgtcttttccgttttgttccacaacggcagttggacaggcttgggcgcgctgtccgaattcaacacctttgtcggacgcatcgccttagccagctttgccgcctacgcgatcggacaaatccttgatatttttgtattcaacaaattacgccgtctgaaagcgtggtggattgcaccgaacgcatcaaccgtcatcgggcacgcgttggatacg

SEQ ID NO: 260 - protein, 155 aa, Neisseria meningitidis
MYAFTAAQQQKALFRLVLFHILIIAASNYLVQFPFQIFGIHTTWGAFSFPFIFLATDLTVRIFGSHLARRIIFWVMFPALLLSYVFSVLFHNGSWTGLGALSEFNTFVGRIALASFAAYAIGQILDIFVFNKLRRLKAWWIAPNASTVIGHALDT

SEQ ID NO: 261 - DNA, 687 bp, Neisseria meningitidis
atgtacgcatttaccgccgcacagcaacagaaggcactcttccggctggtgctttttcatatcctcatcatcgccgccagcaactatctggtgcagttccctttccaaattttcggcatccacaccacttggggcgcattttcctttcccttcatcttccttgccaccgacctgaccgtccgcattttcggttctcacttggcacggcggattatcttttgggtgatgttccccgcccttttgctttcctacgtcttttccgttttgttccacaacggcagttggacaggcttgggcgcgctgtccgaattcaacacctttgtcggacgcatcgccttagccagctttgccgcctacgcgatcggacaaatccttgatatttttgtattcaacaaattacgccgtctgaaagcgtggtggattgcaccgaccgcatcaaccgtcatcggcaacgccttggatacgctggtatttttcgccgttgccttctacgcaagcagcgatggatttatggcggcaaactggcagggcatcgcttttgtcgattacctgttcaaacttaccgtctgcaccctcttcttcctgcccgcctacggcgtgatactgaatctgctgacgaaaaaactgacaaccctgcaaaccaaacaggcgcaagaccgccccgcgccctcgctgcaaaatccgtaa

SEQ ID NO: 262 - protein, 228 aa, Neisseria meningitidis
MYAFTAAQQQKALFRLVLFHILIIAASNYLVQFPFQIFGIHTTWGAFSFPFIFLATDLTVRIFGSHLARRIIFWVMFPALLLSYVFSVLFHNGSWTGLGALSEFNTFVGRIALASFAAYAIGQILDIFVFNKLRRLKAWWIAPTASTVIGNALDTLVFFAVAFYASSDGFMAANWQGIAFVDYLFKLTVCTLFFLPAYGVILNLLTKKLTTLQTKQAQDRPAPSLQNP

SEQ ID NO: 263 - DNA, 687 bp, Neisseria meningitidis
atgtacgcatttaccgccgcacagcaacagaaggcactcttctggctggtgctttttcatatcctcatcatcgccgccagcaactatctggtgcagttccccttccaaatttccggcatccacaccacttggggcgcgttttcctttcccttcatcttcctcgccaccgacctgaccgtccgcattttcggttcgcacttggcacggcggattatcttttgggtcatgttccccgcccttttgctttcctacgtcttttccgttttgttccacaacggcagttggacgggcttgggcgcgctgtccgaattcaacacctttgtcggacgcatcgcgctggcaagttttgccgcctacgcgctcggacaaatccttgatatttttgtgttcaacaaattacgccgtctgaaagcgtggtgggttgccccgactgcatcaaccgtcatcggcaacgccttagatacgttggtatttttcgccgttgccttctacgcaagcagcgatggatttatggcggcaaactggcagggcatcgcttttgtcgattacctgttcaaactcaccgtctgcggtctgtttttcctgcccgcctacggcgtgattctgaatctgctgacgaaaaaactgacgaccctgcaaaccaaacaggcgcaagaccgccccgcgccctcgctgcaaaatccgtaa

SEQ ID NO: 264 - protein, 228 aa, Neisseria meningitidis
MYAFTAAQQQKALFWLVLFHILIIAASNYLVQFPFQISGIHTTWGAFSFPFIFLATDLTVRIFGSHLARRIIFWVMFPALLLSYVFSVLFHNGSWTGLGALSEFNTFVGRIALASFAAYALGQILDIFVFNKLRRLKAWWVAPTASTVIGNALDTLVFFAVAFYASSDGFMAANWQGIAFVDYLFKLTVCGLFFLPAYGVILNLLTKKLTTLQTKQAQDRPAPSLQNP

SEQ ID NO: 265 - DNA, 687 bp, Neisseria gonorrhoeae
atgtacgcattgaccgccgcacagcaacagaaggcactcttccggctggtgcttttccatatcctcatcatcgccgccagcaactatctggtgcagttccccttccggattttcggcatccacaccacttggggcgcgttttcctttcccttcatcttcctcgccaccgacctgaccgtccgcattttcggttcgcacttggcgcggcggattatcttttgggtgatgttccccgcccttttgctttcatacgtcttttccgttttgttccacaacggcagttggacgggcttgggcgcgctgtcccaattcaacacctttgtcggacgcatcgcgctggcaagttttgccgcctacgcgctcggacaaatccttgatattttcgtattcgacaaattacgccgtctgaaagcgtggtggattgccccggccgcatcaaccgtcatcggcaatgcactggacacgttagtattttttgccgttgccttttacgcaagcagcgatgaatttatggcggcaaactggcagggcatcgcttttgtcgattacctgttcaaacttaccgtctgcaccctcttcttcctgcccgcctacggcgtgatactgaatctgctgacgaaaaaactgacggccctgcaaaccaaacaggcgcaagaccgccccgtgccctcgctgcaaaatccgtaa

SEQ ID NO: 266 - protein, 228 aa, Neisseria gonorrhoeae
MYALTAAQQQKALFRLVLFHILIIAASNYLVQFPFRIFGIHTTWGAFSFPFIFLATDLTVRIFGSHLARRIIFWVMFPALSLSYVFSVLFHNGSWTGLGAPSQFNTFVGRIALASFAAYALGQILDIFVFDKLRRLKAWWIAPAASTVIGNALDTLVFFAVAFYASSDEFMAANWQGIAFVDYLFKLTVCTLFFLPAYGVILNLLTKKLTALQTKQAQDRPVPSLQNP

SEQ ID NO: 267 - DNA, 519 bp, Neisseria meningitidis
atggtcataaaatatacaaatttgaattttgcgaaattgtcgataattgcaattttgatgatgtattcgtttgaagcgaatgcaaaygcagtmwraatatctgaaactgtttcagttgataccggacaaggtgcgaaaattcataagtttgtacctaaaaatagtaaaacttattcatctgatttaataaaaacggtagatttaacacacayycctacgggcgcaaaagcccgaatcaacgccaaaataaccgccagcgtatcccgcgccggcgtattggcgggggtcggcaaacttgcccgcttaggcgcgaaattcagcacaagggcggttccctatgtcggaacagcccttttagcccacgacgtatacgaaactttcaaagaagacatacaggcacgaggctaccaatacgaccccgaaaccgacaaatttgtaaaaggctacgaatatagtaattgcctttggtacgaagacaaaagacgtattaatagaacctatggctgctacggcgttgat

SEQ ID NO: 268 - protein, 173 aa, Neisseria meningitidis
  misc_feature (32)..(32): Xaa= any amino acid
  misc_feature (71)..(71): Xaa= any amino acid
MVIKYTNLNFAKLSIIAILMMYSFEANANAVXISETVSVDTGQGAKIHKFVPKNSKTYSSDLIKTVDLTHXPTGAKARINAKITASVSRAGVLAGVGKLARLGAKFSTRAVPYVGTALLAHDVYETFKEDIQARGYQYDPETDKFVKGYEYSNCLWYEDKRRINRTYGCYGVD

SEQ ID NO: 269 - DNA, 453 bp, Neisseria meningitidis
atggtcataaaatatacaaatttgaattttgcgaaattgtcgataattgcaattttgatgatgtattcgtttgaagcgaatgcaaatgcagtaaaaatatctgaaactgtttcagttgataccggacaaggtgcgaaaattcataagtttgtacctaaaaatagtaaaacttattcatctgatttaataaaaacggtagatttaacacacatccctacgggcgcaaaagcccgaatcaacgccaaaataaccgccagcgtatcccgcgccggcgtattggcgggggtcggcaaacttgcccgcttaggcgcgaaattcagcacaagggcggttccctatgtcggaacagcccttttagcccacgacgtatacgaaactttcaaagaagacatacaggcacgaggctaccaatacgaccccgaaaccgacaaatttgcaaaggtctcaggctaa

SEQ ID NO: 270 - protein, 150 aa, Neisseria meningitidis
MVIKYTNLNFAKLSIIAILMMYSFEANANAVKISETVSVDTGQGAKIHKFVPKNSKTYSSDLIKTVDLTHIPTGAKARINAKITASVSRAGVLAGVGKLARLGAKFSTRAVPYVGTALLAHDVYETFKEDIQARGYQYDPETDKFAKVSG

SEQ ID NO: 271 - DNA, 453 bp, Neisseria meningitidis; identical to SEQ ID NO: 269

SEQ ID NO: 272 - protein, 150 aa, Neisseria meningitidis; identical to SEQ ID NO: 270

SEQ ID NO: 273 - DNA, 8 bp, Neisseria gonorrhoeae
  misc_feature (1)..(8): N= Unknown
nnnnnnnn

SEQ ID NO: 274 - protein, 526 aa, Neisseria gonorrhoeae
MVTKHTNLNFAKLSIIAILMMYSFEANANAVKISETLSVDTGQGAKVHKFVPKSSNIYSSDLTKAVDLTHIPTGAKARINAKITASVSRAGVLSGVGKLVRQGAKFGTRAVPYVGTALLAHDVYETFKEDIQARGCRYDPETDKFVKGYEYANCLWYEDERRINRTYGCYGVDSSIMRLMPDRSRFPEVKQLMESQMYRLARPFWNWRKEELNKLSSLDWNNFVLNRCTFDWNGGGCAVNKGDDFRAGASFSLGRNPKYKEEMDAKKPEEILSLKVDADPDKYIEATGYPGYSEKVEVAPGTKVNMGPVTDRNGNPVQVAATFGRDAQGNTTADVQVIPRPDLTPASAEAPHAQPLPEVSPAENPANNPDPDENPGTRPNPEPDPDLNPDANPDTDGQPGTSPDSPAVPDRPNGRHRKERKEGEDGGLSCDYFPEILACQEMGKPSDRMFHDISIPQVTDDKTWSSHNFLPSNGVCPQPKTFHVFGRQYRASYEPLCVFAEKIRFAVLLAFIIMSAFVVFGSLGGE

SEQ ID NO: 275 - DNA, 435 bp, Neisseria gonorrhoeae
atggtcacaaaacatacaaatttgaattttgcgaaattgtcgataattgcaattttgatgatgtattcgtttgaagcgaatgcaaatgcagtaaaaatatctgaaactctttcggttgataccggacaaggcgcgaaagttcataagttcgttcctaaatcaagtaatatttattcatctgatttaacaaaagcggtagatttaacgcatatccccacgggcgcaaaagcccgaatcaacgccaaaataaccgccagcgtatcccgcgccggcgtattgtcgggggtcggcaaacttgtccgccaaggcgcgaaattcggcacaagggcggttccctatgtcggaacagcccttttagcccacgacgtatacgaaactttcaaagaagacatacaggcacgaggctgccgatacgatcccgaaaccgacaaattt

SEQ ID NO: 276 - protein, 145 aa, Neisseria gonorrhoeae
MVTKHTNLNFAKLSIIAILMMYSFEANANAVKISETLSVDTGQGAKVHKFVPKSSNIYSSDLTKAVDLTHIPTGAKARINAKITASVSRAGVLSGVGKLVRQGAKFGTRAVPYVGTALLAHDVYETFKEDIQARGCRYDPETDKF

SEQ ID NO: 277 - DNA, 229 bp, Neisseria meningitidis
atgagatttttcggtatcggttttttggtgctgctgtttttggagattatgtcgattgtgtgggttgccgattggctgggcggcggctggacgttgtttttgatggcggcaggttttgccgccggcgtgctgatgctcaggcaaaccggggctgaccggtcttttattggcgggcgcggcaatgagaagcggcgggaaggtatccgtttatcagatgttgtggcctatc

SEQ ID NO: 278 - protein, 76 aa, Neisseria meningitidis
MRFFGIGFLVLLFLEIMSIVWVADWLGGGWTLFLMAAGFAAGVLMLRQTGLTGLLLAGAAMRSGGKVSVYQMLWPI

SEQ ID NO: 279 - DNA, 486 bp, Neisseria meningitidis
atgagatttttcggtatcggttttttggtgctgctgtttttggagattatgtcgattgtgtgggttgccgattggctgggcggcggctggacgttgtttttgatggcggcaggttttgccgccggcgtgctgatgctcaggcatacggggctgtccggtcttttattggcgggcgcggcaatgagaagcggcgggagggtatccgtttatcagatgttgtggcctatccgttatacggtggcggctgtgtgtctgatgagtccgggattcgtatcctcggtgttggcggtattgctgctgctgccgtttaagggaggggcagtgttgcaggcaggaggtgcggaaaattttttcaacatgaaccaatcgggcagaaaagagggcttttcccgcgatgacgatattatcgagggagaatatacggttgaagagccttacggcggcaatcgttcccgaaacgccatcgaacacaaaaaagacgaataa

SEQ ID NO: 280 - protein, 161 aa, Neisseria meningitidis
MRFFGIGFLVLLFLEIMSIVWVADWLGGGWTLFLMAAGFAAGVLMLRHTGLSGLLLAGAAMRSGGRVSVYQMLWPIRYTVAAVCLMSPGFVSSVLAVLLLLPFKGGAVLQAGGAENFFNMNQSGRKEGFSRDDDIIEGEYTVEEPYGGNRSRNAIEHKKDE

SEQ ID NO: 281 - DNA, 486 bp, Neisseria meningitidis
  misc_feature (213)..(213): N= Unknown
  misc_feature (224)..(224): N= Unknown
  misc_feature (254)..(254): N= Unknown
  misc_feature (284)..(284): N= Unknown
  misc_feature (298)..(298): N= Unknown
  misc_feature (303)..(303): N= Unknown
  misc_feature (366)..(366): N= Unknown
  misc_feature (381)..(381): N= Unknown
  misc_feature (385)..(385): N= Unknown
  misc_feature (432)..(432): N= Unknown
  misc_feature (446)..(446): N= Unknown
  misc_feature (463)..(463): N= Unknown
  misc_feature (465)..(465): N= Unknown
atgagatttttcggtatcggttttttggtgctgctgtttttggagattatgtcgattgtgtgggttgccgattggttgggcggcggttggacgctgtttctaatggcggcaacctttgccgccggcgtggtgatgctcaggcatacggggctgtccggtcttttattggcgggcgcggcaatgagaagcggcgggagggtatccgtttatcanatgttgtggcntatccgttatacggtggcggcggtgtgtcngatgagtccgggattcgtatcctcggtgtnggcggtattgctgntgctnccgtttaagggaggtgcagtgttgcaggcaggaggtgcggaaaattttttcaacatgaaccantcgggcagaaaaganggcntttcccgcgatgacgatattatcgagggggaatatacggttgaaganccttacggcggcantcgtttccgaaacgccntngaacacaaaaaagacgaataa

SEQ ID NO: 282 - protein, 161 aa, Neisseria meningitidis
  misc_feature (71)..(71): Xaa= any amino acid
  misc_feature (75)..(75): Xaa= any amino acid
  misc_feature (85)..(85): Xaa= any amino acid
  misc_feature (95)..(95): Xaa= any amino acid
  misc_feature (100)..(100): Xaa= any amino acid
  misc_feature (122)..(122): Xaa= any amino acid
  misc_feature (127)..(127): Xaa= any amino acid
  misc_feature (129)..(129): Xaa= any amino acid
  misc_feature (144)..(144): Xaa= any amino acid
  misc_feature (149)..(149): Xaa= any amino acid
  misc_feature (155)..(155): Xaa= any amino acid
MRFFGIGFLVLLFLEIMSIVWVADWLGGGWTLFLMAATFAAGVVMLRHTGLSGLLLAGAAMRSGGRVSVYXMLWXIRYTVAAVCXMSPGFVSSVXAVLLXLPFKGGAVLQAGGAENFFNMNXSGRKXGXSRDDDIIEGEYTVEXPYGGXRFRNAXEHKKDE

SEQ ID NO: 283 - DNA, 486 bp, Neisseria gonorrhoeae
atgagatttttcggtatcggttttttggtgctgctgtttttggaaattatgtcgattgtgtgggttgccgattggctgggcggcggttggacgctgtttctaatggcggcaacctttgccgccggtgtgctgatgctcaggcatacggggctgtccggtcttttattggctggcgcggcggtaaaaagtagtgggaaggtatctgtttatcagatgttgtggcctatccgttatacggtggcggcggtgtgtctgatgagtccgggattcgtatcctccgtgttggcggtattgctgctgctgccgtttaagggaggggcagtgttgcaggcaggaggtgcggaaaattttttcaacatgaaccaatcgggcagaaaagagggatttttccacgatgacgatattatcgagggagaatatacggttgaaaaacctgacggcggcaatcgttcccgaaacgccatcgaacacgaaaaagacgaataa

SEQ ID NO: 284 - protein, 161 aa, Neisseria gonorrhoeae
MRFFGIGFLVLLFLEIMSIVWVADWLGGGWTLFLMAATFAAGVLMLRHTGLSGLLLAGAAVKSSGKVSVYQMLWPIRYTVAAVCLMSPGFVSSVLAVLLLLPFKGGAVLQAGGAENFFNMNQSGRKEGFFHDDDIIEGEYTVEKPDGGNRSRNAIEHEKDE

SEQ ID NO: 285 - DNA, 862 bp, Neisseria meningitidis
atgtttgtttttcagacggcattcttatgtttcagaaacatttgcagaaagcctccgacagcgtcgtcggagggacattatacgtggttgccacgcccatcggcaatttggcggacattaccctgcgcgctttggcggtattgcaaaaggcggccgaagacacgcgcgttaccgcacagcttttgagcgcgtacggcattcagggcaaactcgtcagtgtgcgcgaacacaacgaacggcagatggcggacaagattgtcggctatctttcagacggcatggttgtggcacaggtttccgatgcgggtacgccggccgtgtgcgacccgggcgcgaaactcgcccgccgcgtgcgtgaggccgggtttaaagtcgttcccgtcgtgggcgcaacgcggtgatggcggctttgagcgtggccggtgtggaaggatccgatttttatttcaacggttttgtaccgccgaaatcgggagaacgcaggaaactgtttgccaaatgggtgcgggcggcgtttcctatcgtcatgtttgaaacgccgcaccgcatcggtgcagcgcttgccgatatggcggaactgttccccgaacgccgattaatgctggcgcgcgaaattacgaaaacgtttgaaacgttcttaagcggcacggttggggaaattcagacggcattgtctgccgacggcgaccaatcgcgcggcgagatggtgttggtgctttatccggcgcaggatgaaaaacacgaaggcttgtccgagtccgcgcaaaacatcatgaaaatcctcacagccgagctgccgaccaaacaggcggcggagcttgctgccaaaatcacgggcgagggaaagaaagctttgtacgat

SEQ ID NO: 286 - protein, 288 aa, Neisseria meningitidis
  misc_feature (9)..(9): Xaa= any amino acid
  misc_feature (132)..(132): Xaa= any amino acid
MFVFQTAFXMFQKHLQKASDSVVGGTLYVVATPIGNLADITLRALAVLQKAAEDTRVTAQLLSAYGIQGKLVSVREHNERQMADKIVGYLSDGMVVAQVSDAGTPAVCDPGAKLARRVREAGFKVVPVVGAXAVMAALSVAGVEGSDFYFNGFVPPKSGERRKLFAKWVRAAFPIVMFETPHRIGAALADMAELFPERRLMLAREITKTFETFLSGTVGEIQTALSADGDQSRGEMVLVLYPAQDEKHEGLSESAQNIMKILTAELPTKQAAELAAKITGEGKKALYD

SEQ ID NO: 287 - DNA, 876 bp, Neisseria meningitidis
atgtttcagaaacatttgcagaaagcctccgacagcgtcgtcggagggacattatacgtggttgccacgcccatcggcaatttggcggacattaccctgcgcgctttggcggtattgcaaaaggcggacatcatctgtgccgaagacacgcgcgttaccgcacagcttttgagcgcgtacggcattcagggcaaactcgtcagtgtgcgcgaacacaacgaacggcagatggcggacaagattgtcggctatctttcagacggcatggttgtggcacaggtttccgatgcgggtacgccggccgtgtgcgacccgggcgcgaaactcgcccgccgcgtgcgtgaggccgggtttaaagtcgttcccgtcgtgggcgcaagcgcggtgatggcggctttgagcgtggccggtgtggaaggatccgatttttatttcaacggttttgtaccgccgaaatcgggagaacgcaggaaactgtttgccaaatgggtgcgggcggcgtttcctatcgtcatgtttgaaacgccgcaccgcatcggtgcgacgcttgccgatatggcggaactgttccccgaacgccgattaatgctggcgcgcgaaattacgaaaacgtttgaaacgttcttaagcggcacggttggggaaattcagacggcattgtctgccgacggcaaccaatcgcgcggcgagatggtgttggtgctttatccggcgcaggatgaaaaacacgaaggcttgtccgagtccgcgcaaaacatcatgaaaatcctcacagccgagctgccgaccaaacaggcggcggagcttgctgccaaaatcacgggcgagggaaagaaagctttgtacgatctggctctgtcttggaaaaacaaatag

SEQ ID NO: 288 - protein, 291 aa, Neisseria meningitidis
MFQKHLQKASDSVVGGTLYVVATPIGNLADITLRALAVLQKADIICAEDTRVTAQLLSAYGIQGKLVSVREHNERQMADKIVGYLSDGMVVAQVSDAGTPAVCDPGAKLARRVREAGFKVVPVVGASAVMAALSVAGVEGSDFYFNGFVPPKSGERRKLFAKWVRAAFPIVMFETPHRIGATLADMAELFPERRLMLAREITKTFETFLSGTVGEIQTALSADGNQSRGEMVLVLYPAQDEKHEGLSESAQNIMKILTAELPTKQAAELAAKITGEGKKALYDLALSWKNK

SEQ ID NO: 289 - DNA, 876 bp, Neisseria meningitidis
atgtttcagaaacatttgcagaaagcctccgacagcgtcgtcggagggacattatacgtggttgccacgcccatcggcaatttggcggacattaccctgcgcgctttggcggtattgcaaaaggcggacatcatctgtgccgaagacacgcgcgttaccgcgcagcttttgagcgcgtacggcattcagggcaaactcgtcagcgtgcgcgaacacaacgaacggcagatggcggacaagattgtcggctatctttcagacggcatggttgtggcacaggtttccgatgcgggtacgccggccgtgtgcgacccgggcgcgaaactcgcccgccgcgtgcgtgaggtcgggtttaaagttgtccctgttgtcggcgcaagcgcggtgatggcggctttgagtgtggctggtgtggcgggatccgatttttatttcaacggttttgtaccgccgaaatcgggcgaacgtaggaaattgtttgccaaatgggtgcgggtggcgtttcccgtcgtgatgtttgaaacgccgcaccgcatcggggcgacgcttgccgatatggcggaactgttccccgaacgccgattaatgctggcgcgcgaaatcacgaaaacgtttgaaacgttcttaagcggcacggttggggaaattcagacggcattggcggcggacggcaaccaatcgcgcggcgagatggtgttggtgctttatccggcgcaggatgaaaaacacgaaggcttgtccgagtccgcgcaaaacatcatgaaaatcctcacagccgagctgccgaccaaacaggcggcggagcttgccgccaaaatcacgggcgagggaaaaaaagctttgtacgatctggcactgtcttggaaaaacaaatga

SEQ ID NO: 290 - protein, 291 aa, Neisseria meningitidis
MFQKHLQKASDSVVGGTLYVVATPIGNLADITLRALAVLQKADIICAEDTRVTAQLLSAYGIQGKLVSVREHNERQMADKIVGYLSDGMVVAQVSDAGTPAVCDPGAKLARRVREVGFKVVPVVGASAVMAALSVAGVAGSDFYFNGFVPPKSGERRKLFAKWVRVAFPVVMFETPHRIGATLADMAELFPERRLMLAREITKTFETFLSGTVGEIQTALAADGNQSRGEMVLVLYPAQDEKHEGLSESAQNIMKILTAELPTKQAAELAAKITGEGKKALYDLALSWKNK

SEQ ID NO: 291 - DNA, 8 bp, Neisseria gonorrhoeae
  misc_feature (1)..(8): N= Unknown
nnnnnnnn

SEQ ID NO: 292 - protein, 300 aa, Neisseria gonorrhoeae
MSVFQTAFFMFQKHLQKASDSVVGGTLYVVATPIGNLADITLRALAVLQKADIICAEDTRVTAQLLSAYGIQGRLVSVREHNERQMADKVIGFLSDGLVVAQVSDAGTPAVCDPGAKLARRVREAGFKVVPVVGASAVMAALSVAGVAESDFYFNGFVPPKSGERRKLFAKWVRAAFPVVMFETPHRIGATLADMAELFPERRLMLAREITKTFETFLSGTVGEIQTALAADGNQSRGEMVLVLYPAQDEKHEGLSESAQNAMKILAAELPTKQAAELAAKITGEGKKALYDLALSWKNK

SEQ ID NO: 293 - DNA, 876 bp, Neisseria gonorrhoeae
atgtttcagaaacacttgcagaaagcctccgacagcgtcgtcggagggacattatacgtggttgccacgcccatcggcaatttggcagacattaccctgcgcgctttggcggtattgcaaaaggcggacatcatttgtgccgaagacacgcgcgttactgcgcagcttttgagcgcgtacggcattcagggcaggttggtcagtgtgcgcgaacacaacgagcggcagatggcggacaaggtaatcggtttcctttcagacggcctggttgtggcgcaggtttccgatgcgggtacgccggccgtgtgcgacccgggcgcgaaactcgcccgccgcgtgcgcgaagcagggttcaaagtcgttcccgtcgtgggcgcaagcgcggtaatggcggcgttgagtgtggccggtgtggcggaatccgatttttatttcaacggttttgtaccgccgaaatcgggcgaacgtaggaaattgtttgccaaatgggtgcgggcggcatttcctgtcgtcatgtttgaaacgccgcaccgaatcggggcaacgcttgccgatatggcggaattgttccccgaacgccgtctgatgctggcgcgcgaaatcacgaaaacgtttgaaacgttcttaagcggcacggttggggaaattcagacggcattggcggcggacggcaaccaatcgcgcggcgagatggtgttggtgctttatccggcgcaggatgaaaaacacgaaggcttgtccgagtctgcgcaaaatgcgatgaaaatccttgcggccgagctgccgaccaagcaggcggcggagcttgccgccaagattacaggtgagggcaaaaaggctttgtacgatttggcactgtcgtggaaaaacaaatga

SEQ ID NO: 294 - protein, 291 aa, Neisseria gonorrhoeae
MFQKHLQKASDSVVGGTLYVVATPIGNLADITLRALAVLQKADIICAEDTRVTAQLLSAYGIQGRLVSVREHNERQMADKVIGFLSDGLVVAQVSDAGTPAVCDPGAKLARRVREAGFKVVPVVGASAVMAALSVAGVAESDFYFNGFVPPKSGERRKLFAKWVRAAFPVVMFETPHRIGATLADMAELFPERRLMLAREITKTFETFLSGTVGEIQTALAADGNQSRGEMVLVLYPAQDEKHEGLSESAQNAMKILAAELPTKQAAELAAKITGEGKKALYDLALSWKNK

SEQ ID NO: 295 - DNA, 185 bp, Neisseria meningitidis
atgaaacagaaaaaaaccgctgccgcagttattgctgcaatgttggcaggttttgcggcagcaaagcacccgaaatcgacccggctttggagttggtcagaaaccagttggagcagggtttgagacaggaaaaagcccgcttgaaaatcgatgcccttttggaagaaaacggtgtcaaaccgtaa

SEQ ID NO: 296 - protein, 60 aa, Neisseria meningitidis
  misc_feature (21)..(21): Xaa= any amino acid
MKQKKTAAAVIAAMLAGFAAXKAPEIDPALELVRNQLEQGLRQEKARLKIDALLEENGVK

SEQ ID NO: 297 - DNA, 759 bp, Neisseria meningitidis
atgaaacagaaaaaaaccgctgccgcagttattgctgcaatgttggcaggttttgcggcagccaaagcacccgaaatcgacccggctttggtggatacgctggtggcgcagatcatgcagcaggcagaccggcatgcggagcagtcccaaaaaccggacgggcaggcaatccgaaacgatgccgtccgccggctacaaactttggaagttttgaaaaacagggcattgaaggaaggtttggataaggataaggatgtccaaaaccgctttaaaatcgccgaagcgtctttttatgccgaggagtacgtccgttttctggaacgttcggaaacggtttccgaagacgagctgcacaagttttacgaacagcaaatccgcatgatcaaattgcagcaggtcagcttcgcaaccgaagaggaggcgcgtcaggcgcagcagctcctgctcaaagggctgtcttttgaagggctgatgaagcgttatccgaacgacgagcaggcttttgacggtttcattatggcgcagcagcttcccgagccgctggcttcgcagtttgccgcgatgaatcggggcgacgttacccgcgatccggtcaaattgggcgaacgctattatctgttcaaactcagcgaggtcgggaaaaaccccgacgcgcagcctttcgagttggtcagaaaccagttggagcagggtttgagacaggaaaaagcccgcttgaaaatcgatgcccttttggaagaaaacggtgtcaaaccgtaa

SEQ ID NO: 298 - protein, 252 aa, Neisseria meningitidis
MKQKKTAAAVIAAMLAGFAAAKAPEIDPALVDTLVAQIMQQADRHAEQSQKPDGQAIRNDAVRRLQTLEVLKNRALKEGLDKDKDVQNRFKIAEASFYAEEYVRFLERSETVSEDELHKFYEQQIRMIKLQQVSFATEEEARQAQQLLLKGLSFEGLMKRYPNDEQAFDGFIMAQQLPEPLASQFAAMNRGDVTRDPVKLGERYYLFKLSEVGKNPDAQPFELVRNQLEQGLRQEKARLKIDALLEENGVKP

SEQ ID NO: 299 - DNA, 759 bp, Neisseria meningitidis
atgaaacagaaaaaaaccgctgccgcagttattgctgcaatgttggcaggttttgcggcagccaaagcacccgaaatcgacccggctttggtggatacgctggtggcgcagatcatgcagcaggcagaccggcatgcggagcagtcccaaaaaccggacgggcaggcaatccgaaacgatgccgtccgtcggctgcaaactttggaagttttgaaaaacagggcattgaaggaaggtttggataaggataaggatgtccaaaaccgctttaaaatcgccgaagcgtctttttatgccgaggagtacgtccgttttctggaacgttcggaaacggtttccgaaagcgcactgcgtcagttttatgagcggcaaatccgcatgatcaaattgcagcaggtcagcttcgcaaccgaagaggaggcgcgtcaggcgcagcagctcctgctcaaagggctgtcttttgaagggctgatgaagcgttatccgaacgacgagcaggcttttgacggtttcattatggcgcagcagcttcccgagccgctggcttcgcagtttgcagcgatgaatcggggcgacgttacccgcgatccggtcaaattgggcgaacgctattatctgttcaaactcagcgaggtcgggaaaaaccccgacgcgcagcctttcgagttggtcagaaaccagttggaacaaggtttgagacaggaaaaagcccgcttgaaaatcgatgccattttggaagaaaacggtgtcaaaccgtaa

SEQ ID NO: 300 - protein, 252 aa, Neisseria meningitidis
MKQKKTAAAVIAAMLAGFAAAKAPEIDPALVDTLVAQIMQQADRHAEQSQKPDGQAIRNDAVRRLQTLEVLKNRALKEGLDKDKDVQNRFKIAEASFYAEEYVRFLERSETVSESALRQFYERQIRMIKLQQVSFATEEEARQAQQLLLKGLSFEGLMKRYPNDEQAFDGFIMAQQLPEPLASQFAAMNRGDVTRDPVKLGERYYLFKLSEVGKNPDAQPFELVRNQLEQGLRQEKARLKIDAILEENGVKP

SEQ ID NO: 301 - DNA, 759 bp, Neisseria gonorrhoeae
atgaaacagaaaaagaccgctgccgcagttattgctgcaatgttggcaggttttgcggcagccaaagcacccgaaatcgacccggctttggtggatacgctggtggcgcagatcatgcagcaggcagaccggcatgcggagcagtcccaaagaccggacgggcaggcaatccgaaacgatgccgtccgccggctgcaaactttggaagttttgaaaaacagggcattgaaggaaggtttggataaggataaggatgtccaaaaccgctttaaaatcgccgaagcgtctttttatgccgaggagtacgtccgttttctggaacgttcggaaacggtttccgaaagcgcactgcgtcagttttatgagcggcaaatccgcatgatcaaattgcagcaggtcagcttcgcaaccgaagaggaggcgcgtcaggcgcagcagctcctgctcaaagggctgtcttttgaagggctgatgaagcgttatccgaacgacgagcaggcgttcgacggtttcattatggcgcagcagcttcccgagccgctggcttcgcagtttgccggtatgaaccgtggcgacgttacccgcaatccggtcaaattgggcgaacgctattacctgttcaaactcggcgcggtcgggaaaaaccccgacgcgcagcctttcgagttggtcagaaaccagttggaacaaggtttgaggcaggaaaaagcccgcttgaaaatcgatgcccttttggaagaaaacggtgtcaaaccgtaa

SEQ ID NO: 302 - protein, 252 aa, Neisseria gonorrhoeae
MKQKKTAAAVIAAMLAGFAAAKAPEIDPALVDTLVAQIMQQADRHAEQSQRPDGQAIRNDAVRRLQTLEVLKNRALKEGLDKDKDVQNRFKIAEASFYAEEYVRFLERSETVSESALRQFYERQIRMIKLQQVSFATEEEARQAQQLLLKGLSFEGLMKRYPNDEQAFDGFIMAQQLPEPLASQFAGMNRGDVTRNPVKLGERYYLFKLGAVGKNPDAQPFELVRNQLEQGLRQEKARLKIDALLEENGVKP

SEQ ID NO: 303 - DNA, 622 bp, Neisseria meningitidis
atgaaaaaatctttccttacgcttgttctgtattcgtctttacttaccgccagcgaaattgccttaccccttggaattggggattgaaaccttaccggcggcaaaaattgcggaaacgtttgcgctgacatttgtgattgctgcgctgtatctgtttgcgcgtaataaggtgacgcgtttgttgattgcggtgttttttgcgttcagcattattgccaacaatgtgcattacgcggattatcaaagctggatgacgcaaaccgtattcgagcagctgcaaaagactcctgacggcaactggctgtttgcctatacctccgatcatggccagtatgttcgccaagatatctacaatcaaggcacggtgcagcccgacagctatctcgtgccgctagtgttgtacagcccggataaggccgtgcaacaggctgccaaccaggcttttgcgccttgcgagattgccttccatcagcagctttcaacgttcctgattcacacgttgggctacgatatgccggtttcaggttgtcgcgaaggctcggtaacgggcaacctgattacgggtgatgcaggcagcttgaacattcgcgacggcaaggcggaatatgtttatccgcaatga

SEQ ID NO: 304 - protein, 206 aa, Neisseria meningitidis
MKKSFLTLVLYSSLLTASEIAYPLELGIETLPAAKIAETFALTFVIAALYLFARNKVTRLLIAVFFAFSIIANNVHYADYQSWMTQTVFEQLQKTPDGNWLFAYTSDHGQYVRQDIYNQGTVQPDSYLVPLVLYSPDKAVQQAANQAFAPCEIAFHQQLSTFLIHTLGYDMPVSGCREGSVTGNLITGDAGSLNIRDGKAEYVYPQ

SEQ ID NO: 305 - DNA, 1575 bp, Neisseria meningitidis
atgaaaaaatctttccttacgcttgttctgtattcgtctttacttaccgccagcgaaattgcctatcgctttgtatttgggattgaaaccttaccggcggcaaaaattgcggaaacgtttgcgctgacatttgtgattgctgcgctgtatctgtttgcgcgttataaggtgacgcgtttgttgattgcggtgttttttgcgttcagcattattgccaacaatgtgcattacgcggtttatcaaagctggatgacgggcatcaattattggctgatgctgaaagaggttaccgaagtcggcagcgcgggtgcgtcgatgttggataagttgtggctgcctgtgttgtggggcgtgttggaagtcatgttgttttgcagccttgccaagttccgccgtaagacgcatttttctgccgatatactgtttgccttcctaatgctgatgattttcgtgcgttcgttcgacacgaaacaagagcacggtatttcgcccaaaccgacatacagccgcatcaaagccaattatttcagcttcggttattttgtcggacgcgtgttgccgtatcagttgtttgatttaagcaggattcccgcctttaagcagcctgctccaagcaaaatcgggcagggcagtgttcaaaatatcgtcctgattatgggcgaaagcgaaagcgcggcgcatttgaagctgtttggctacggacgcgaaacttcgccgtttttaacccggctgtcgcaagccgattttaagccgattgtgaaacaaagttattccgcaggctttatgactgcagtgtccctgcccagttttttcaatgcgataccgcacgccaacggcttggaacaaatcagcggcggcgataccaatatgttccgcctcgccaaagagcagggctatgaaacgtatttttacagcgcgcaggcggaaaacgagatggcgattttgaacttaatcggtaagaaatggatagaccatctgattcagccgacgcaacttggctacggcaacggcgacaatatgcccgatgagaagctgctgccgttgttcgacaaaatcaatttgcagcagggcaagcattttatcgtgttgcaccaacgcggttcgcacgccccatacggcgcattgttgcagcctcaagataaagtattcggcgaagccgatattgtggataagtacgacaacaccatccacaaaaccgaccaaatgattcaaaccgtattcgagcagctgcaaaagcagcctgacggcaactggctgtttgcctatacctccgatcatggccagtatgttcgccaagatatctacaatcaaggcacggtgcagcccgacagctatctcgtgccgctagtgttgtacagcccggataaggccgtgcaacaggctgccaaccaggcttttgcgccttgcgagattgccttccatcagcagctttcaacgttcctgattcacacgttgggctacgatatgccggtttcaggttgtcgcgaaggctcggtaacgggcaacctgattacgggtgatgcaggcagcttgaacattcgcgacggcaaggcggaatatgtttatccgcaatga

SEQ ID NO: 306 - protein, 524 aa, Neisseria meningitidis
MKKSFLTLVLYSSLLTASEIAYRFVFGIETLPAAKIAETFALTFVIAALYLFARYKVTRLLIAVFFAFSIIANNVHYAVYQSWMTGINYWLMLKEVTEVGSAGASMLDKLWLPVLWGVLEVMLFCSLAKFRRKTHFSADILFAFLMLMIFVRSFDTKQEHGISPKPTYSRIKANYFSFGYFVGRVLPYQLFDLSRIPAFKQPAPSKIGQGSVQNIVLIMGESESAAHLKLFGYGRETSPFLTRLSQADFKPIVKQSYSAGFMTAVSLPSFFNAIPHANGLEQISGGDTNMFRLAKEQGYETYFYSAQAENEMAILNLIGKKWIDHLIQPTQLGYGNGDNMPDEKLLPLFDKINLQQGKHFIVLHQRGSHAPYGALLQPQDKVFGEADIVDKYDNTIHKTDQMIQTVFEQLQKQPDGNWLFAYTSDHGQYVRQDIYNQGTVQPDSYLVPLVLYSPDKAVQQAANQAFAPCEIAFHQQLSTFLIHTLGYDMPVSGCREGSVTGNLITGDAGSLNIRDGKAEYVYPQ

SEQ ID NO: 307 - DNA, 1275 bp, Neisseria meningitidis
atgaaaaaatcccttttcgttctctttctgtattcgtccctacttactgccagcgaaattgcttatcgctttgtattcggaattgaaaccttaccggctgcaaaaatggcagaaacgtttgcgctgacatttgtgattgctgcgctgtatctgtttgcgcgttataaggcaacgcgtttgttgattgcggtgtttttcgcgttcagcattattgccaacaatgtgcattacgcggtttatcaaagctggataacgggcattaattattggctgatgctgaaagagattaccgaagttggcggcgcaggggcgtcgatgttggataagttgtggctgcctgcgttgtggggcgtgttggaagtcatgttgttttgcagccttgccaagttccgccgtaagacgcatttttctgccgatatactgtttgccttcctaatgctgatgattttcgtgcgttcgttcgacacgaaacaagaacacggtatttcgcccaaaccgacatacagccgcatcaaagccaattatttcagcttcggttattttgtcggacgcgtgttgccgtatcagttgtttgatttaagcaagattcctgtgttcaaacagcctgctccaagcagaatcgggcaaggcagtattcaaaatatcgtcctgattatgggcgaaagcgaaagcgcggcgcatttgaaattgtttggctacgggcgcgaaacttcgccgtttttgacccagctttcgcaagccgattttaagccgattgtgaaacaaagttattccgcaggctttatgacggcagtatccctgcccagtttctttaacgtcataccgcatgccaacggcttggaacaaatcagcggcggcgatattgtggataagtacgacaacaccatccacaaaaccgaccaaatgattcaaaccgtattcgagcagctgcaaaagcagcctgacggcaactggctgtttgcctatacctccgatcatggccagtatgttcgccaagatatctacaatcaaggcacggtgcagcccgacagctatctcgtgccgctggtgttgtacagcccggataaggccgtgcaacaggctgccaaccaggcttttgcgccttgcgagattgccttccatcagcagctttcaacgttcctgattcacacgttgggctacgatatgccggtttcaggttgtcgcgaaggctcggtaacgggcaacctgattacgggtgatgcaggcagcttgaacattcgcgacggcaaggcggaatatgtttatccgcaatga

SEQ ID NO: 308 - protein, 424 aa, Neisseria meningitidis
MKKSLFVLFLYSSLLTASEIAYRFVFGIETLPAAKMAETFALTFVIAALYLFARYKATRLLIAVFFAFSIIANNVHYAVYQSWITGINYWLMLKEITEVGGAGASMLDKLWLPALWGVLEVMLFCSLAKFRRKTHFSADILFAFLMLMIFVRSFDTKQEHGISPKPTYSRIKANYFSFGYFVGRVLPYQLFDLSKIPVFKQPAPSRIGQGSIQNIVLIMGESESAAHLKLFGYGRETSPFLTQLSQADFKPIVKQSYSAGFMTAVSLPSFFNVIPHANGLEQISGGDIVDKYDNTIHKTDQMIQTVFEQLQKQPDGNWLFAYTSDHGQYVRQDIYNQGTVQPDSYLVPLVLYSPDKAVQQAANQAFAPCEIAFHQQLSTFLIHTLGYDMPVSGCREGSVTGNLITGDAGSLNIRDGKAEYVYPQ

SEQ ID NO: 309 - DNA, 1575 bp, Neisseria gonorrhoeae
atgaaaaaatcccttttcgttctctttctgtattcatccctacttaccgccagcgaaatcgcctatcgctttgtattcggaattgaaaccttaccggctgcaaaaatggcggaaacgtttgcgctgacatttatgattgctgcgctgtatctgtttgcgcgttataaggcttcgcggctgctgattgcggtgtttttcgcgttcagcatgattgccaacaatgtgcattacgcggtttatcaaagctggatgacgggtattaactattggctgatgctgaaagaggttaccgaagtcggcagcgcgggcgcgtcgatgttggataagttgtggctgcctgctttgtggggcgtggcggaagtcatgttgttttgcagccttgccaagttccgccgtaagacgcatttttctgccgatatactgtttgccttcctaatgctgatgattttcgtgcgttcgttcgacacgaaacaagagcacggtatttcgcccaaaccgacatacagccgcatcaaagccaattatttcagcttcggttattttgtcgggcgcgtgttgccgtatcagttgtttgatttaagcaagatccctgtgttcaaacagcctgctccaagcaaaatcgggcaaggcagtattcaaaatatcgtcctgattatgggcgaaagcgaaagcgcggcgcatttgaaattgtttggttacgggcgcgaaacttcgccgtttttaacccggctgtcgcaagccgattttaagccgattgtgaaacaaagttattccgcaggctttatgacggcagtatccctgcccagtttctttaacgtcataccgcacgccaacggcttggaacaaatcagcggcggcgataccaatatgttccgcctcgccaaagagcagggctatgaaacgtatttttacagtgcccaggctgaaaaccaaatggcaattttgaacttaatcggtaagaaatggatagaccatctgattcagccgacgcaacttggctacggcaacggcgacaatatgcccgatgagaagctgctgccgttgttcgacaaaatcaatttgcagcagggcaggcattttatcgtgttgcaccaacgcggttcgcacgccccatacggcgcattgttgcagcctcaagataaagtattcggcgaagccgatattgtggataagtacgacaacaccatccacaaaaccgaccaaatgattcaaaccgtattcgagcagctgcaaaagcagcctgacggcaactggctgtttgcctatacctccgatcatggccagtatgtgcgccaagatatctacaatcaaggcacggtgcagcccgacagctatattgtgcctctggttttgtacagcccggataaggccgtgcaacaggctgccaaccaggcttttgcgccttgcgagattgccttccatcagcagctttcaacgttcctgattcacacgttgggctacgatatgccggtttcaggttgtcgcgaaggctcggtaacaggcaacctgattacgggcgatgcaggcagcttgaacattcgcaacggcaaggcggaatatgtttatccgcaataa

SEQ ID NO: 310 - protein, 524 aa, Neisseria gonorrhoeae
MKKSLFVLFLYSSLLTASEIAYRFVFGIETLPAAKMAETFALTFMIAALYLFARYKASRLLIAVFFAFSMIANNVHYAVYQSWMTGINYWLMLKEVTEVGSAGASMLDKLWLPALWGVAEVMLFCSLAKFRRKTHFSADILFAFLMLMIFVRSFDTKQEHGISPKPTYSRIKANYFSFGYFVGRVLPYQLFDLSKIPVFKQPAPSKIGQGSIQNIVLIMGESESAAHLKLFGYGRETSPFLTRLSQADFKPIVKQSYSAGFMTAVSLPSFFNVIPHANGLEQISGGDTNMFRLAKEQGYETYFYSAQAENQMAILNLIGKKWIDHLIQPTQLGYGNGDNMPDEKLLPLFDKINLQQGRHFIVLHQRGSHAPYGALLQPQDKVFGEADIVDKYDNTIHKTDQMIQTVFEQLQKQPDGNWLFAYTSDHGQYVRQDIYNQGTVQPDSYIVPLVLYSPDKAVQQAANQAFAPCEIAFHQQLSTFLIHTLGYDMPVSGCREGSVTGNLITGDAGSLNIRNGKAEYVYPQ

SEQ ID NO: 311 - DNA, 590 bp, Neisseria meningitidis
accctgctcctcttcatccccctcgtcctcacacgtgcggcacactgaccggcatactcgcccacggcggcggcaaacgctttgccgtcgaacaagaactcgtcgccgcatcgtcccgcgccgccgtcaaagaaatggatttgtccgccytaaaaggacgcaaagccgccytttacgtctccgttatgggcgaccaaggttcgggcaacataagcggcggacgctactctatcgacgcactgatacgcggcggctaccacaacaaccccgaaagtgccacccaatacagctaccccgcctacgacactaccgccaccaccaaatccgacgcgctctccagcgtaaccacttccacatcgcttttgaacgcccccgccgccgycytgacgaaaaacagcggacgcaaaggcgaacgctccgccggactgtccgtcaacggcacgggcgactaccgcaacgaaaccctgctcgccaacccccgcgacgtttccttcctgaccaacctcatccaaaccgtcttctacctgcgcggcatcgaagtcgtaccgcccgratacgccgacaccgacgtattcgtaaccgtcgacgta

SEQ ID NO: 312 - protein, 197 aa, Neisseria meningitidis
  misc_feature (12)..(12): Xaa= any amino acid
  misc_feature (58)..(58): Xaa= any amino acid
  misc_feature (128)..(128): Xaa= any amino acid
  misc_feature (185)..(185): Xaa= any amino acid
TLLLFIPLVLTXCGTLTGILAHGGGKRFAVEQELVAASSRAAVKEMDLSALKGRKAAXYVSVMGDQGSGNISGGRYSIDALIRGGYHNNPESATQYSYPAYDTTATTKSDALSSVTTSTSLLNAPAAXLTKNSGRKGERSAGLSVNGTGDYRNETLLANPRDVSFLTNLIQTVFYLRGIEVVPPXYADTDVFVTVDV

SEQ ID NO: 313 - DNA, 942 bp, Neisseria meningitidis
atgaaaaccctgctcctcctcatccccctcgtcctcacagcctgcggcacactgaccggcatacccgcccacggcggcggcaaacgctttgccgtcgaacaagaactcgtcgccgcatcgtcccgcgccgccgtcaaagaaatggatttgtccgccctaaaaggacgcaaagccgccctttacgtctccgttatgggcgaccaaggttcgggcaacataagcggcggacgctactctatcgacgcactgatacgcggcggctaccacaacaaccccgaaagtgccacccaatacagctaccccgcctacgacactaccgccaccaccaaatccgacgcgctctccagcgtaaccacttccacatcgcttttgaacgcccccgccgccgccctgacgaaaaacagcggacgcaaaggcgaacgctccgccggactgtccgtcaacggcacgggcgactaccgcaacgaaaccctgctcgccaacccccgcgacgtttccttcctgaccaacctcatccaaaccgtcttctacctgcgcggcatcgaagtcgtaccgcccgaatacgccgacaccgacgtattcgtaaccgtcgacgtattcggcaccgtccgcagccgtaccgaactgcacctctacaacgccgaaacccttaaagcccaaaccaagctcgaatatttcgccgttgaccgcgacagccggaaactgctgattacccctaaaaccgccgcctacgaatcccaataccaagaacaatacgccctttggaccggcccttacaaagtcagcaaaaccgtcaaagcctcagaccgcctgatggtcgatttctccgacattaccccctacggcgacacaaccgcccaaaaccgtcccgacttcaaacaaaacaacggtaaaaaacccgatgtcggcaacgaagtcatccgccgccgcaaaggaggataa

SEQ ID NO: 314 - protein, 313 aa, Neisseria meningitidis
MKTLLLLIPLVLTACGTLTGIPAHGGGKRFAVEQELVAASSRAAVKEMDLSALKGRKAALYVSVMGDQGSGNISGGRYSIDALIRGGYHNNPESATQYSYPAYDTTATTKSDALSSVTTSTSLLNAPAAALTKNSGRKGERSAGLSVNGTGDYRNETLLANPRDVSFLTNLIQTVFYLRGIEVVPPEYADTDVFVTVDVFGTVRSRTELHLYNAETLKAQTKLEYFAVDRDSRKLLITPKTAAYESQYQEQYALWTGPYKVSKTVKASDRLMVDFSDITPYGDTTAQNRPDFKQNNGKKPDVGNEVIRRRKGG

SEQ ID NO: 315 - DNA, 942 bp, Neisseria meningitidis
  misc_feature (16)..(16): N= Unknown
atgaaaaccctgctcntcctcatccccctcgtcctcacagcctgcggcacactgaccggcatacccgcccacggcggcggcaaacgctttgccgtcgaacaagaactcgtcgccgcatcgtcccgcgccgccgtcaaagaaatggacttgtccgccctgaaaggacgcaaagccgccctttacgtctccgttatgggcgaccaaggttcgggcaacataagcggcggacgctactctatcgacgcactgatacgcggcggctaccacaacaaccccgaaagtgccacccaatacagctaccccgcctacgacactaccgccaccaccaaatccgacgcgctctccagcgtaaccacttccacatcgcttttgaacgcccccgccgccgccctgacgaaaaacagcggacgcaaaggcgaacgctccgccggactgtccgtcaacggcacgggcgactaccgcaacgaaaccctgctcgccaacccccgcgacgtttccttcctgaccaacctcatccaaaccgtcttctacctgcgcggcatcgaagtcgtaccgcccgaatacgccgacaccgacgtattcgtaaccgtcgacgtattcggcaccgtccgcagccgcaccgaactgcacctctacaacgccgaaacccttaaagcccaaaccaagctcgaatatttcgccgttgaccgcgacagccggaaactgctgattgcccctaaaaccgccgcctacgaatcccaataccaagaacaatacgccctctggatgggaccttacagcgtcggcaaaaccgtcaaagcctcagaccgcctgatggtcgatttctccgacatcaccccctacggcgacacaaccgcccaaaaccgtcccgacttcaaacaaaacaacggtaaaaaacccgatgtcggcaacgaagtcatccgccgccgcaaaggaggataa

SEQ ID NO: 316 - protein, 313 aa, Neisseria meningitidis
  misc_feature (6)..(6): Xaa= any amino acid
MKTLLXLIPLVLTACGTLTGIPAHGGGKRFAVEQELVAASSRAAVKEMDLSALKGRKAALYVSVMGDQGSGNISGGRYSIDALIRGGYHNNPESATQYSYPAYDTTATTKSDALSSVTTSTSLLNAPAAALTKNSGRKGERSAGLSVNGTGDYRNETLLANPRDVSFLTNLIQTVFYLRGIEVVPPEYADTDVFVTVDVFGTVRSRTELHLYNAETLKAQTKLEYFAVDRDSRKLLIAPKTAAYESQYQEQYALWMGPYSVGKTVKASDRLMVDFSDITPYGDTTAQNRPDFKQNNGKKPDVGNEVIRRRKGG

SEQ ID NO: 317 - DNA, 942 bp, Neisseria gonorrhoeae
atgaaaaccctgctcctcctcatccccctcgtactcaccgcctgcggcacactgaccggcatacccgcccacggcggcggcaaacgctttgccgtcgaacaggaactcgtcgccgcatcgtcccgcgccgccgtcaaagaaatggacttgtccgccctgaaaggacgcaaagccgccctttacgtctccgttatgggcgaccaaggttcgggcaacataagcggcggacgctactccatcgacgcactgatacgcggcggctaccacaacaaccccgacagcgccacccgatacagctaccccgcctatgacactaccgccaccaccaaatccgacgcgctctccggcgtaaccacttccacatcgcttttgaacgcccccgccgccgccctgacgaaaaacaacggacgcaaaggcgaacgctccgccggactgtccgtcaacggcacgggcgactaccgcaacgaaaccctgctcgccaacccccgcgacgtttccttcctgaccaacctcatccaaaccgtcttctacctgcgcggcatcgaagtcgtaccgcccgaatacgccgacaccgacgtattcgtaaccgtcgacgtattcggcaccgtccgcagccgtaccgaactgcacctctacaacgccgaaacccttaaagcccaaaccaagctcgaatatttcgccgtcgaccgcgacagccggaaactgctgattgcccctaaaaccgccgcctacgaatcccaataccaagaacaatacgccctctggatgggaccttacagcgtcggcaaaaccgtcaaagcctcagaccgcctgatggtcgatttctccgacatcaccccctacggcgacacaaccgcccaaaaccgtcccgacttcaaacaaaacaacggtaaaaaccccgatgtcggcaacgaagtcatccgccgccgcaaaggaggataa

SEQ ID NO: 318 - protein, 313 aa, Neisseria gonorrhoeae
MKTLLLLIPLVLTACGTLTGIPAHGGGKRFAVEQELVAASSRAAVKEMDLSALKGRKAALYVSVMGDQGSGNISGGRYSIDALIRGGYHNNPDSATRYSYPAYDTTATTKSDALSGVTTSTSLLNAPAAALTKNNGRKGERSAGLSVNGTGDYRNETLLANPRDVSFLTNLIQTVFYLRGIEVVPPEYADTDVFVTVDVFGTVRSRTELHLYNAETLKAQTKLEYFAVDRDSRKLLIAPKTAAYESQYQEQYALWMGPYSVGKTVKASDRLMVDFSDITPYGDTTAQNRPDFKQNNGKNPDVGNEVIRRRKGG

SEQ ID NO: 319 - DNA, 1191 bp, Neisseria meningitidis
atggcagagatctgtttgataaccggcacgcccggttcagggaaaacattaaaaatggtttccatgatggcgaatgatgaaatgtttaagcctgatgaaaaagccatacgccgtaaagtatttacgaacataaaaggcttgaaaataccgcacacctacatagaaacggacgcaaaaaagctgccgaaatcgacagatgagcagctttcggcgcatgatatgtacgaatggataaagaagcccgaaaatatcgggtctattgtcattgtagatgaagctcaagacgtatggccggcacgctcggcaggttcaaaaatccctgaaaatgtccaatggctgaatacgcacagacatcagggcattgatatatttgttttgactcaaggtcctaagcttctagatcaaaatcttagaacgcttgtacggaaacattaccacatcgcttcaaacaagatgggtatgcgtacgcttttagaatggaaaatatgcgcggacgatcccgtaaaaatggcatcaagcgcattctccagtatctatacactggataaaaaagtttatgacttgtaysrrtmmgcggaagttcataccgtaaataaggtcaagcggtcaaagtggttttacactctgccagtaatagtattgctgattcccgtgtttgtcggcctgtcctataaaatgttgagcagttacggaaaaaaacaggaagaacccgcagcacaagaatcggcggcaacagaacagcaggcagtacttccggataaaacagaaggcgagccggtaaataacggcaaccttaccgcagatatgtttgttccgacattgtccgaaaaacccgraagcaagccgatttataacggtgtaaggcaggtaagaacctttgaatatatagcaggctgtatagaaggcggaagaaccggatgcgcctgctattcgcatcaagggacggcattgaaagaagtgacggagttgatgtgccaaggactatgtaaaaaacggcttgccgtttaacccatacaaagaagaaagccaagggcaggaagttcagcaaagcgcgcagcaacattcggacagggcgccaagttgccacattgggcggaaaaccgtagcagaacctaatgtacgataattgggaagaacgcgggaaaccgtttgaaggaatcggacgggggcgtggtcggatcggcaaactga

SEQ ID NO: 320 - protein, 395 aa, Neisseria meningitidis
  misc_feature (190)..(191): Xaa= any amino acid
  misc_feature (279)..(279): Xaa= any amino acid
  misc_feature (368)..(368): Xaa= any amino acid
MAEICLITGTPGSGKTLKMVSMMANDEMFKPDEKAIRRKVFTNIKGLKIPHTYIETDAKKLPKSTDEQLSAHDMYEWIKKPENIGSIVIVDEAQDVWPARSAGSKIPENVQWLNTHRHQGIDIFVLTQGPKLLDQNLRTLVRKHYHIASNKMGMRTLLEWKICADDPVKMASSAFSSIYTLDKKVYDLYXXAEVHTVNKVKRSKWFYTLPVIVLLIPVFVGLSYKMLSSYGKKQEEPAAQESAATEQQAVLPDKTEGEPVNNGNLTADMFVPTLSEKPXSKPIYNGVRQVRTFEYIAGCIEGGRTGCACYSHQGTALKEVTELMCKDYVKNGLPFNPYKEESQGQEVQQSAQQHSDRAQVATLGGKPXQNLMYDNWEERGKPFEGIGGGVVGSAN

SEQ ID NO: 321 - DNA, 1188 bp, Neisseria meningitidis
atggcagagatctgtttgataaccggcacgcccggttcagggaaaacattaaaaatggtttccatgatggcgaatgatgaaatgtttaagcctgatgaaaacggcatacgccgtaaagtatttacgaacataaaaggcttgaaaataccgcacacctacatagaaacggacgcaaaaaagctgccgaaatcgacagatgagcagctttcggcgcatgatatgtacgaatggataaagaagcccgaaaatatcgggtctattgtcattgtagatgaagctcaagacgtatggccggcacgctcggcaggttcaaaaatccctgaaaatgtccaatggctgaatacgcacagacatcagggcattgatatatttgttttgactcaaggtcctaagcttctagatcaaaatcttagaacgcttgtacggaaacattaccacatcgcttcaaacaagatgggtatgcgtacgcttttagaatggaaaatatgcgcggacgatcccgtaaaaatggcatcaagcgcattctccagtatctatacactggataaaaaagtttatgacttgtacgaatcagcggaagttcataccgtaaataaggtcaagcggtcaaagtggttttacactctgccagtaatagtattgctgattcccgtgtttgtcggcctgtcctataaaatgttgagcagttacggaaaaaaacaggaagaacccgcagcacaagaatcggcggcaacagaacagcaggcagtacttccggataaaacagaaggcgagccggtaaataacggcaaccttaccgcagatatgtttgttccgacattgtccgaaaaacccgaaagcaagccgatttataacggtgtaaggcaggtaagaacctttgaatatatagcaggctgtatagaaggcggaagaaccggatgcgcctgctattcgcatcaagggacggcattgaaagaagtgacggagttgatgtgcaaggactatgtaaaaaacggcttgccgtttaacccatacaaagaagaaagccaagggcaggaagttcagcaaagcgcgcagcaacattcggacagggcgcaagttgccacattgggcggaaaaccgtagcagaacctaatgtacgataattgggaagaacgcgggaaaccgtttgaaggaatcggcgggggcgtggtcggatcggcaaactga

SEQ ID NO: 322 - protein, 394 aa, Neisseria meningitidis
MAEICLITGTPGSGKTLKMVSMMANDEMFKPDENGIRRKVFTNIKGLKIPHTYIETDAKKLPKSTDEQLSAHDMYEWIKKPENIGSIVIVDEAQDVWPARSAGSKIPENVQWLNTHRHQGIDIFVLTQGPKLLDQNLRTLVRKHYHIASNKMGMRTLLEWKICADDPVKMASSAFSSIYTLDKKVYDLYESAEVHTVNKVKRSKWFYTLPVIVLLIPVFVGLSYKMLSSYGKKQEEPAAQESAATEQQAVLPDKTEGEPVNNGNLTADMFVPTLSEKPESKPIYNGVRQVRTFEYIAGCIEGGRTGCACYSHQGTALKEVTELMCKDYVKNGLPFNPYKEESQGQEVQQSAQQHSDRAQVATLGGKPQNLMYDNWEERGKPFEGIGGGVVGSAN

SEQ ID NO: 323 - DNA, 1188 bp, Neisseria meningitidis
atggcagagatctgtttgataaccggcacgcccggttcagggaaaacattaaaaatggtttccatgatggcaaacgatgaaatgtttaagccggatgaaaacggcatacgccgtaaagtatttacgaacatcaaaggcttgaagataccgcacacctacatagaaacggacgcgaaaaagctgccgaaatcgacagatgagcagctttcggcgcatgatatgtacgaatggataaagaagcccgaaaatatcgggtctattgtcattgtagatgaagctcaagacgtatggccggcacgctcggcaggttcaaaaatccctgaaaatgtccaatggctgaatacgcacagacatcagggcattgatatatttgttttgactcaaggctctaagcttctagatcaaaatcttagaacgcttgtacggaaacattaccacatcgcttcaaacaagatgggtatgcgtacgcttttagaatggaaaatatgcgcggacgatcccgtaaaaatggcatcaagcgcattctccagtatctatacactggataaaaaagtttatgacttgtacgaatcagcggaagttcataccgtaaataaggtcaagcggtcaaaatggttttatactctgccagtaataatattgctgattcccgtttttgtcggcctgtcctataaaatgttaagtagttatggaaaaaaacaggaagaacccgcagcacaagaatcggcggcaacagaacatcaggcagtatttcaggataaaacagaaggcgagccggtaaacaacggtaaccttaccgcagatatgtttgttccgacattgtccgaaaaacccgaaagcaagccgatttataacggtgtaaggcaggtaagaacctttgaatatatagcaggctgtgtagaaggcggaagaaccggatgcacatgctattcgcatcaagggacggcattgaaagaaattacaaaggaaatgtgcaaggattacgcaagaaacggattgccgtttaacccatataaagaagaaagccaagggcgggatgtccagcaaagtgagcagcaccattcggacagaccgcaagttgccacgttgggcggaaagccgtggcaaaatcttatgtatgataattggcaggagcgcggaaaaccgtttgaaggaatcggcgggggcgtggtcggatcggcaaactga

SEQ ID NO: 324 - protein, 395 aa, Neisseria meningitidis
MAEICLITGTPGSGKTLKMVSMMANDEMFKPDENGIRRKVFTNIKGLKIPHTYIETDAKKLPKSTDEQLSAHDMYEWIKKPENIGSIVIVDEAQDVWPARSAGSKIPENVQWLNTHRHQGIDIFVLTQGSKLLDQNLRTLVRKHYHIASNKMGMRTLLEWKICADDPVKMASSAFSSIYTLDKKVYDLYESAEVHTVNKVKRSKWFYTLPVIILLIPVFVGLSYKMLSSYGKKQEEPAAQESAATEHQAVFQDKTEGEPVNNGNLTADMFVPTLSEKPESKPIYNGVRQVRTFEYIAGCVEGGRTGCTCYSHQGTALKEITKEMCKDYARNGLPFNPYKEESQGRDVQQSEQHHSDRPQVATLGGKPWQNLMYDNWQERGKPFEGIGGGVVGSAN

SEQ ID NO: 325 - DNA, 1188 bp, Neisseria gonorrhoeae
atggcagaaatctgtttgataaccggcacgcccggttcagggaaaacattaaaaatggtttccatgatggcaaacgatgaaatgtttaagccagatgaaaacggcgtacgccgtaaagtatttacgaacatcaaaggtttgaagataccgcacacccacatagaaacagacgcaaagaagctgccgaaatcaaccgatgaacagctttcggcgcatgatatgtatgaatggatcaagaagcctgaaaacgtcggcgcaatcgttattgtcgatgaggcgcaagacgtatggcccgcacgctccgcaggttcgaaaatccccgaaaacgtccaatggctgaacacacacaggcatcagggcatagatatatttgtattgacacaaggtcctaaactcttagatcagaacttgcgaacattggttaaaagacattaccacattgcggccaacaaaatgggtttgcgtaccctgcttgaatggaaagtatgcgcggatgacccggtaaaaatggcatcaagtgcattttccagtatctacacactggataaaaaagtttatgacttgtacgaatccgcagaaattcacacggtaaacaaagtcaagcgttcaaaatggttttatgcattgcccgtcatcatattattgattccgctatttgtcggtttgtcttacaaaatgttgggcagttacggaaaaaaacaggaagaacccgcagcacaagaatcggcggcaacagaacagcaggcagtacttccggataaaacagaaggagaatcggtgaataacggaaaccttacggcagatatgtttgttccgacattgcccgaaaaacccgaaagcaagccgatttataacggtgtaaggcaggtaaggacctttgaatatatagcaggctgtatagaaggcggaagaaccggatgcacctgctattcgcatcaagggacggcattgaaagaagtgacggagttgatgtgcaaggactatgtaaaaaacggcttgccgtttaacccatacaaagaagaaagccaagggcaggaagttcagcaaagcgcgcagcaacattcggacagggcgcaagttgccaccttgggcggaaaaccgcagcagaacctaatgtacgacaattgggaagaacgcgggaaaccgtttgaaggaatcggcgggggcgtggtcggatcggcaaactga

SEQ ID NO: 326 - protein, 395 aa, Neisseria gonorrhoeae
MAEICLITGTPGSGKTLKMVSMMANDEMFKPDENGVRRKVFTNIKGLKIPHTHIETDAKKLPKSTDEQLSAHDMYEWIKKPENVGAIVIVDEAQDVWPARSAGSKIPENVQWLNTHRHQGIDIFVLTQGPKLLDQNLRTLVKRHYHIAANKMGLRTLLEWKVCADDPVKMASSAFSSIYTLDKKVYDLYESAEIHTVNKVKRSKWFYALPVIILLIPLFVGLSYKMLGSYGKKQEEPAAQESAATEQQAVLPDKTEGESVNNGNLTADMFVPTLPEKPESKPIYNGVRQVRTFEYIAGCIEGGRTGCTCYSHQGTALKEVTELMCKDYVKNGLPFNPYKEESQGQEVQQSAQQHSDRAQVATLGGKPQQNLMYDNWEERGKPFEGIGGGVVGSAN

SEQ ID NO: 327 - DNA, 1091 bp, Neisseria meningitidis
gtggttttcctgaatgccgacaacgggatattggttcaggacttgccttttgaagtcaaactgaaaaaattccatatcgatttttacaatacgggtatgccgcgtgatttcgccagcgatattgaagtgacggacaaggcaaccggtgagaaactcgagcgcaccatccgcgtgaaccatcctttgaccttgcacggcatcacgatttatcaggcgagttttgccgacggcggttcggatttgacattcaaggcgtggaatttgggtgatgcttcgcgcgagcctgtcgtgttgaaggcaacatccatacaccagtttccgttggaaattggcaaacacaaatatcgtcttgagttcgatcagttcacttctatgaatgtggaggacatgagcgagggcgcggaacgggaaaaaagcctgaaatccacgctgcccgatgtccgcgccgttactcaggaaggtcacaaatacaccaattaccgtatccgtgatgcgccaggccaggcggtcgaatataaaaactatatgctgccggttttgcaggaacaggattatttttggattaccggcacgcgcagcgcttgcagcagcaataccgctggctgcgtatccccttggacaagcagttgaaagcggacacctttatggcattgcgtgagtttttgaaagatggggaagggcgcaaacgtctgttgccgacgcaaccaaaggcgcacctgccgaaatccgcgaacaattcatgctggctgcggaaaacacgctgaacatctttgcacaaaaaggctatttgggattggacgaatttattacgtccaatatcccgaaagagcagcaggataagatgcagggctatttctacgaaatgctttacggcgtgatgaacgctgctttggatgaaaccatacccggtacggcttgcccgaatggcagcaggatgaagcgcggaatcgtttcctgctgcacagtatggatgcgtacacgggtttgaccgaatatcccgcgcctatgctgctgcaacttgatgggttttccgaggtgcgttcgtcgggtttgcagatgacccgttccccggtccgcttttggtctatctc

SEQ ID NO: 328 - protein, 371 aa, Neisseria meningitidis
  misc_feature (160)..(165): Xaa= any amino acid
  misc_feature (200)..(200): Xaa= any amino acid
  misc_feature (237)..(237): Xaa= any amino acid
  misc_feature (308)..(308): Xaa= any amino acid
  misc_feature (364)..(364): Xaa= any amino acid
MVFLNADNGILVQDLPFEVKLKKFHIDFYNTGMPRDFASDIEVTDKATGEKLERTIRVNHPLTLHGITIYQASFADGGSDLTFKAWNLGDASREPVVLKATSIHQFPLEIGKHKYRLEFDQFTSMNVEDMSEGAEREKSLKSTLPDVRAVTQEGHKYTNXXXXXXYRIRDAPGQAVEYKNYMLPVLQEQDYFWITGTRSXLQQQYRWLRIPLDKQLKADTFMALREFLKDGEGRKRXVADATKGAPAEIREQFMLAAENTLNIFAQKGYLGLDEFITSNIPKEQQDKMQGYFYEMLYGVMNAALDETXTRYGLPEWQQDEARNRFLLHSMDAYTGLTEYPAPMLLQLDGFSEVRSSGLQMTRSXGPLLVYL

SEQ ID NO: 329 - DNA, 2016 bp, Neisseria meningitidis
atgagtaaatcccgtagatctcccccacttctttcccgtccgtggttcgcttttttcagctccatgcgctttgcagtcgctttgctcagtctgctgggtattgcatcggttatcggtacggtgttgcagcaaaaccagccgcagacggattatttggtcaaattcggatcgttttgggcgcagatttttggttttctgggactgtatgacgtctatgcttcggcatggtttgtcgttatcatgatgtttttggtggtttctaccagtttgtgcctgattcgcaatgtgccgccgttctggcgcgaaatgaagtcttttcgggaaaaggttaaagaaaaatctctggcggcgatgcgccattcttcgctgttggatgtaaaaattgcgcccgaggttgccaaacgttatctggaagtacaaggttttcagggaaaaaccattaaccgtgaagacgggtcggttctgattgccgccaaaaaaggcacaatgaacaaatggggctatatctttgcccatgttgctttgattgtcatttgcctgggcgggttgatagacagtaacctgctgttgaaactgggtatgctgaccggtcggattgttccggacaatcaggcggtttatgccaaggatttcaagcccgaaagtattttgggtgcgtccaatctctcatttaggggcaacgtcaatatttccgaggggcagagtgcggatgtggttttcctgaatgccgacaacgggatattggttcaggacttgccttttgaagtcaaactgaaaaaattccatatcgatttttacaatacgggtatgccgcgtgatttcgccagcgatattgaagtgacggacaaggcaaccggtgagaaactcgagcgcaccatccgcgtgaaccatcctttgaccttgcacggcatcacgatttatcaggcgagttttgccgacggcggttcggatttgacattcaaggcgtggaatttgggtgatgcttcgcgcgagcctgtcgtgttgaaggcaacatccatacaccagtttccgttggaaattggcaaacacaaatatcgtcttgagttcgatcagttcacttctatgaatgtggaggacatgagcgagggcgcggaacgggaaaaaagcctgaaatccacgctgaacgatgtccgcgccgttactcaggaaggtaaaaaatacaccaatatcggcccttccattgtttaccgtatccgtgatgcggcagggcaggcggtcgaatataaaaactatatgctgccggttttgcaggaacaggattatttttggattaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaaggcgcacctgccgaaatccgcgaacaattcatgctggctgcggaaaacacgctgaacatctttgcacaaaaaggctatttgggattggacgaatttattacgtccaatatcccgaaagagcagcaggataagatgcagggctatttctacgaaatgctttacggcgtgatgaacgctgctttggatgaaaccatacgccggtacggcttgcccgaatggcagcaggatgaagcgcggaatcgtttcctgctgcacagtatggatgcgtacacgggtttgaccgaatatcccgcgcctatgctgctgcaacttgatgggttttccgaggtgcgttcgtcgggtttgcagatgacccgttccccgggtgcgcttttggtctatctcggctcggtgctgttggtattgggtacggtattgatgttttatgtgcgcgaaaaacgggcgtgggtattgttttcagacggcaaaatccgttttgccatgtcttcggcccgcagcgaacgggatttgcagaaggaatttccaaaacacgtcgagagtctgcaacggctcggcaaggacttgaatcatgactga

SEQ ID NO: 330 - protein, 671 aa, Neisseria meningitidis
MSKSRRSPPLLSRPWFAFFSSMRFAVALLSLLGIASVIGTVLQQNQPQTDYLVKFGSFWAQIFGFLGLYDVYASAWFVVIMMFLVVSTSLCLIRNVPPFWREMKSFREKVKEKSLAAMRHSSLLDVKIAPEVAKRYLEVQGFQGKTINREDGSVLIAAKKGTMNKWGYIFAHVALIVICLGGLIDSNLLLKLGMLTGRIVPDNQAVYAKDFKPESILGASNLSFRGNVNISEGQSADVVFLNADNGILVQDLPFEVKLKKFHIDFYNTGMPRDFASDIEVTDKATGEKLERTIRVNHPLTLHGITIYQASFADGGSDLTFKAWNLGDASREPVVLKATSIHQFPLEIGKHKYRLEFDQFTSMNVEDMSEGAEREKSLKSTLNDVRAVTQEGKKYTNIGPSIVYRIRDAAGQAVEYKNYMLPVLQEQDYFWITGTRSGLQQQYRWLRIPLDKQLKADTFMALREFLKDGEGRKRLVADATKGAPAEIREQFMLAAENTLNIFAQKGYLGLDEFITSNIPKEQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVLMFYVREKRAWVLFSDGKIRFAMSSARSERDLQKEFPKHVESLQRLGKDLNHD

SEQ ID NO: 331 - DNA, 2016 bp, Neisseria meningitidis
atgagtaaatcccgtagatctcccccacttctttcccgtccgtggttcgcttttttcagctccatgcgctttgcggtcgctttgctcagtctgctgggtattgcatcggttatcggtacggtgttgcagcaaaaccagccgcagacggattatttggtcaaattcggatcgttttgggcgcagatttttggttttctgggactgtatgacgtctatgcttcggcatggtttgtcgttatcatgatgtttttggtggtttctaccagtttgtgcctgattcgcaatgtgccgccgttctggcgcgaaatgaagtcttttcgggaaaaggttaaagaaaaatctctggcggcgatgcgccattcttcgctgttggatgtaaaaattgcgcccgaggttgccaaacgttatctggaagtacaaggttttcagggaaaaaccattaaccgtgaagacgggtcggttctgattgccgccaaaaaaggcacaatgaacaaatggggctatatctttgcccatgttgctttgattgtcatttgcctgggcgggttgatagacagtaacctgctgttgaaactgggtatgctgaccggtcggattgttccggacaatcaggcggtttatgccaaggatttcaagcccgaaagtattttgggtgcgtccaatctctcatttaggggcaacgtcaatatttccgaggggcagagtgcggatgtggttttcctgaatgccgacaacgggatattggttcaggacttgccttttgaagtcaaactgaaaaaattccatatcgatttttacaatacgggtatgccgcgcgattttgccagtgatattgaagtaacggataaggcaaccggtgagaaactcgagcgcaccatccgcgtgaaccatcctttgaccttgcacggcatcacgatttatcaggcgagttttgccgacggcggttcggatttgacattcaaggcgtggaatttgggtgatgcttcgcgcgagcctgtcgtgttgaaggcaacatccatacaccagtttccgttggaaattggcaaacacaaatatcgtcttgagttcgatcagtttacttctatgaatgtggaggacatgagcgagggcgcggaacgggaaaaaagcctgaaatccacgctgaacgatgtccgcgccgttactcaggaaggtaaaaaatacaccaatatcggcccttccattgtttaccgtatccgtgatgcggcagggcaggcggtcgaatataaaaactatatgctgccggttttgcaggaacaggattatttttggattaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaaggcgcacctgccgaaatccgcgaacaattcatgctggctgcggaaaacacgctgaacatctttgcacaaaaaggctatttgggattggacgaatttattacgtccaatatcccgaaagagcagcaggataagatgcagggctatttctacgaaatgctttacggcgtgatgaacgctgctttggatgaaaccatacgccggtacggcttgcccgaatggcagcaggatgaagcgcggaatcgtttcctgctgcacagtatggatgcgtacacgggtttgaccgaatatcccgcgcctatgctgctgcaacttgatgggttttccgaggtgcgttcgtcgggtttgcagatgacccgttccccgggtgcgcttttggtctatctcggctcggtgctgttggtattgggtacggtattgatgttttatgtgcgcgaaaaacgggcgtgggtattgttttcagacggcaaaatccgttttgccatgtcttcggcccgcagcgaacgggatttgcagaaggaatttccaaaacacgtcgagagtctgcaacggctcggcaaggacttgaatcatgactga

SEQ ID NO: 332 - protein, 671 aa, Neisseria meningitidis; identical to SEQ ID NO: 330

SEQ ID NO: 333 - DNA, 8 bp, Neisseria gonorrhoeae
  misc_feature (1)..(8): N= Unknown
nnnnnnnn

SEQ ID NO: 334 - protein, 434 aa, Neisseria gonorrhoeae
  misc_feature (398)..(398): Xaa= any amino acid
MVFLNADNGMLVQDLPFEVKLKKFHIDFYNTGMPRDFASDIEVTDKATGEKLERTIRVNHPLTLHGITIYQASFADGGSDLTFKAWNLRDASREPVVLKATSIHQFPLEIGKHKYRLEFDQFTSMNVEDMSEGAEREKSLKSTLNDVRAVTQEGKKYTNIGPSIVYRIRDAAGQAVEYKNYMLPILQDKDYFWLTGTRSGLQQQYRWLRIPLDKQLKADTFMALREFLKDGEGRKRLVADATKDAPAEIREQFMLAAENTLNIFAQKGYLGLDEFITSNIPKGQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVFMFYVPKKRAWVLFSNXKIRFAMSSARSERDLQKEFPKHVESLQRLGKDLNHD

SEQ ID NO: 335 - DNA, 2016 bp, Neisseria gonorrhoeae
atgagtaaatcccgtatatctcccacacttctttcccgtccgtggttcgcttttttcagctccatgcgctttgcggtcgctttgctcagtctgctgggtattgcatcggttatcggcacggtgttacagcaaaaccagccgcagacggattatttggtcaaattcggaccgttttggactcggatttttgattttttgggtttgtatgatgtctatgcttcggcatggtttgtcgttatcatgatgtttctggtggtttctaccagtttgtgtttaatccgtaacgttccgccgttttggcgcgaaatgaagtctttccgggaaaaggttaaagaaaaatctctggcggcgatgcgccattcttcgctgttggatgtaaaaattgcccccgaagttgccaaacgttatctggaggtgcggggttttcagggaaaaaccgtcagccgtgaggacgggtcggttctgattgccgccaaaaaaggcacaatgaacaaatggggctatatctttgcccaagtagctttgattgtcatttgcctgggcgggttgatagacagtaacctgctgctgaagctgggtatgctggccggtcggattgttccggacaatcaggcggtttatgccaaggatttcaagcccgaaagtattttgggtgcgtccaatctctcatttaggggcaacgtcaatatttccgaggggcaaagtgcggatgtggttttcctgaatgccgacaacgggatgttggttcaggacttgccttttgaagtcaaactgaaaaaattccatatcgatttttacaatacgggtatgccgcgcgattttgccagcgatattgaagtaacggacaaggcaaccggtgagaaactcgagcgcaccatccgcgtgaaccatcctttgaccttgcacggcatcacgatttatcaggcgagttttgccgacggcggttcggatttgacattcaaggcgtggaatttgagggatgcttcgcgcgaacctgtcgtgttgaaggcaacctccatacaccagtttccgttggaaatcggcaaacacaaatatcgtcttgagttcgatcagttcacttctatgaatgtggaggacatgagcgagggtgcggaacgggaaaaaagcctgaaatccactctgaacgatgtccgcgccgttactcaggaaggtaaaaaatacaccaatatcggcccttccatcgtgtaccgcatccgtgatgcggcagggcaggcggtcgaatataaaaactatatgctgccgattttgcaggacaaagattatttttggctgaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaagacgcacctgccgaaatccgcgaacaattcatgctggctgcggaaaacacgctgaatatctttgcgcaaaaaggctatttgggattggacgaatttattacgtccaatatcccgaaagggcagcaggataagatgcagggctatttctacgaaatgctttacggcgtgatgaacgctgctttggatgaaaccatacgccggtacggcttgcccgaatggcagcaggatgaagcgcggaaccgtttcctgctgcacagtatggatgcctatacggggctgacggaatatcccgcgcctatgctgctccagcttgacgggttttccgaggtgcgttcctcaggtttgcagatgacccgttcgccgggtgcgcttttggtctatctcggctcggtattgttggttttgggtacggtatttatgttttatgtgcgcgaaaaacgggcgtgggtattgttttcagacggcaaaatccgttttgctatgtcttcggcccgcagcgaacgggatttgcagaaggaatttccaaaacacgtcgagagcctgcaacggctcggcaaggacttgaatcatgactga

SEQ ID NO: 336 - protein, 671 aa, Neisseria gonorrhoeae; identical to SEQ ID NO: 330

SEQ ID NO: 337 - DNA, 489 bp, Neisseria meningitidis
atgatgagtaatamaatggmacaaaaagggtttacattgattgmgmtgatgatagtcgtcgcgatactcggcattatcagcgtcattgccataccttcttatcmaagttatattgaaaaaggctatcagtcccagctttatacggagatggycggtatcaacaatatttccaaacagtttattttgaaaaatcccctggacgataatcagaccatcgagaacaaactggaaatatttgtctcaggctataagatgaatccgaaaattgccaaaaaatatagtgtttcggtaaagtttgtcgataaggaaaaatcaagggcatacaggttggtcggcgttccgaaggcggggacgggttatactttgtcggtatggatgaacagcgtgggcgacggatacaaatgccgtgatgccgcttctgcccaagcccatttggagaccttgtcctcagatgtcggctgtgaagccttctctaatcgtaaaaaataa

SEQ ID NO: 338 - protein, 162 aa, Neisseria meningitidis
  misc_feature (5)..(5): Xaa= any amino acid
  misc_feature (7)..(7): Xaa= any amino acid
  misc_feature (15)..(16): Xaa= any amino acid
  misc_feature (35)..(35): Xaa= any amino acid
  misc_feature (51)..(51): Xaa= any amino acid
MMSNXMXQKGFTLIXXMIVVAILGIISVIAIPSYXSYIEKGYQSQLYTEMXGINNISKQFILKNPLDDNQTIENKLEIFVSGYKMNPKIAKKYSVSVKFVDKEKSRAYRLVGVPKAGTGYTLSVWMNSVGDGYKCRDAASAQAHLETLSSDVGCEAFSNRKK

SEQ ID NO: 339 - DNA, 489 bp, Neisseria meningitidis
atgatgagtaataaaatggaacaaaaagggtttacattgattgagatgatgatagtcgtcgcgatactcggcattatcagcgtcattgccataccttcttatcaaagttatattgaaaaaggctatcagtcccagctttatacggagatggtcggtatcaacaatatttccaaacagtttattttgaaaaatcccctggacgataatcagaccatcgagaacaaactggaaatatttgtctcaggctataagatgaatccgaaaattgccaaaaaatatagtgtttcggtaaagtttgtcgataaggaaaaatcaagggcatacaggttggtcggcgttccgaaggcggggacgggttatactttgtcggtatggatgaacagcgtgggcgacggatacaaatgccgtgatgccgcttctgcccaagcccatttggagaccttgtcctcagatgtcggctgtgaagccttctctaatcgtaaaaaataa

SEQ ID NO: 340 - protein, 162 aa, Neisseria meningitidis
MMSNKMEQKGFTLIEMMIVVAILGIISVIAIPSYQSYIEKGYQSQLYTEMVGINNISKQFILKNPLDDNQTIENKLEIFVSGYKMNPKIAKKYSVSVKFVDKEKSRAYRLVGVPKAGTGYTLSVWMNSVGDGYKCRDAASAQAHLETLSSDVGCEAFSNRKK

SEQ ID NO: 341 - DNA, 489 bp, Neisseria meningitidis
  misc_feature (44)..(44): N= Unknown
  misc_feature (47)..(47): N= Unknown
  misc_feature (49)..(49): N= Unknown
  misc_feature (51)..(51): N= Unknown
  misc_feature (54)..(54): N= Unknown
  misc_feature (56)..(56): N= Unknown
  misc_feature (58)..(58): N= Unknown
  misc_feature (68)..(68): N= Unknown
  misc_feature (70)..(70): N= Unknown
  misc_feature (73)..(73): N= Unknown
  misc_feature (77)..(77): N= Unknown
  misc_feature (88)..(88): N= Unknown
  misc_feature (90)..(90): N= Unknown
  misc_feature (93)..(95): N= Unknown
  misc_feature (97)..(97): N= Unknown
  misc_feature (99)..(99): N= Unknown
  misc_feature (104)..(105): N= Unknown
  misc_feature (179)..(179): N= Unknown
  misc_feature (315)..(315): N= Unknown
atgatgagtaataaaatggaacaaaaagggtttacattgattgngangntnatngncntcgcgatacncngcnttancagcgtcattncnatnnntncntatcnnagttatattgaaaaaggctatcagtcccagctttatacggagatggtcggtatcaacaatatttccaaacagtntattttgaaaaatcccctggacgataatcagaccatcaagagcaaactggaaatatttgtctcaggctataagatgaatccgaaaattgccgaaaaatataatgtttcggtgcattttgtcaatgaggaaaaaccnagggcatacagcttggtcggcgttccaaagacggggacgggttatactttgtcggtatggatgaacagcgtgggcgacggatacaaatgccgtgatgccgcttctgcccgagcccatttggagaccttgtcctcagatgtcggctgtgaagccttctctaatcgtaaaaaatag

SEQ ID NO: 342 - protein, 162 aa, Neisseria meningitidis
  misc_feature (15)..(20): Xaa= any amino acid
  misc_feature (23)..(26): Xaa= any amino acid
  misc_feature (30)..(33): Xaa= any amino acid
  misc_feature (35)..(35): Xaa= any amino acid
  misc_feature (60)..(60): Xaa= any amino acid
MMSNKMEQKGFTLIXXXXXXAIXXXXSVIXXXXYXSYIEKGYQSQLYTEMVGINNISKQXILKNPLDDNQTIKSKLEIFVSGYKMNPKIAEKYNVSVHFVNEEKPRAYSLVGVPKTGTGYTLSVWMNSVGDGYKCRDAASARAHLETLSSDVGCEAFSNRKK

SEQ ID NO: 343 - DNA, 489 bp, Neisseria gonorrhoeae
atgatgagcaataaaatggaacaaaaagggtttacattgattgagatgatgatagttgtcacgatactcggcatcatcagcgtcattgccataccttcttatcagagttatattgaaaaaggctatcagtcccagctttatacggagatggtcggtatcaacaatgttctcaaacagtttattttgaaaaatccccaggacgataatgataccctcaagagcaaactgaaaatatttgtctcaggctataagatgaatccgaaaattgccaaaaaatatagtgtttcggtaaggtttgtcgatgcggaaaaaccaagggcatacaggttggtcggcgttccgaacgcggggacgggttatactttgtcggtatggatgaacagcgtgggcgacggatacaaatgccgtgatgccacttctgcccaggcctattcggacaccttgtccgcagatagcggctgtgaagctttctctaatcgtaaaaaatag

SEQ ID NO: 344 - protein, 162 aa, Neisseria gonorrhoeae
MMSNKMEQKGFTLIEMMIVVTILGIISVIAIPSYQSYIEKGYQSQLYTEMVGINNVLKQFILKNPQDDNDTLKSKLKIFVSGYKMNPKIAKKYSVSVRFVDAEKPRAYRLVGVPNAGTGYTLSVWMNSVGDGYKCRDATSAQAYSDTLSADSGCEAFSNRKK

SEQ ID NO: 345 - DNA, 276 bp, Neisseria meningitidis
  misc_feature (263)..(263): N= Unknown
atgaaaaaatcctccctcatcagcgcattgggcatcggtattttgagcatcggcatggcatttgccgcccctgccgacgcggtaagccaaatccgtcaaaacgccactcaagtattgagcatcttaaaaaacggcgatgccaacaccgctcgccaaaaagccgaagcctatgcgattccctatttcgatttccaacgtatgaccgcattggcggtcggcaacccttggsgcaccggtccgacggcaaaaacaagcgttggccnagaatttcaaccc

SEQ ID NO: 346 - protein, 93 aa, Neisseria meningitidis
  misc_feature (77)..(77): Xaa= any amino acid
  misc_feature (79)..(79): Xaa= any amino acid
  misc_feature (82)..(82): Xaa= any amino acid
  misc_feature (89)..(89): Xaa= any amino acid
MKKSSLISALGIGILSIGMAFAAPADAVSQIRQNATQVLSILKNGDANTARQKAEAYAIPYFDFQRMTALAVGNPWXTXSDXQKQALAXEFQP

SEQ ID NO: 347 - DNA, 591 bp, Neisseria meningitidis
atgaaaaaatcctccctcatcagcgcattgggcatcggtattttgagcatcggcatggcatttgccgcccctgccgacgcggtaagccaaatccgtcaaaacgccactcaagtattgagcatcttaaaaaacggcgatgccaacaccgctcgccaaaaagccgaagcctatgcgattccctatttcgatttccaacgtatgaccgcattggcggtcggcaacccttggcgcaccgcgtccgacgcgcaaaaacaagcgttggccaaagaatttcaaaccctgctgatccgcacctattccggcacgatgctgaaattaaaaaacgccaacgtcaacgtcaaagacaatcccatcgtcaataaaggcggcaaagaaatcatcgtccgcgccgaagtcggcgtacccgggcaaaaacccgtcaacatggacttcaccacctaccaaagcggcggtaaataccgtacctacaacgtcgccatcgaaggcgcgagcctggttaccgtgtaccgcaaccaattcggcgaaattatcaaagcgaaaggcgtggacggactgattgccgagttgaaagccaaaaacggcggcaaataa

SEQ ID NO: 348 - protein, 196 aa, Neisseria meningitidis
MKKSSLISALGIGILSIGMAFAAPADAVSQIRQNATQVLSILKNGDANTARQKAEAYAIPYFDFQRMTALAVGNPWRTASDAQKQALAKEFQTLLIRTYSGTMLKLKNANVNVKDNPIVNKGGKEIIVRAEVGVPGQKPVNMDFTTYQSGGKYRTYNVAIEGASLVTVYRNQFGEIIKAKGVDGLIAELKAKNGGK

SEQ ID NO: 349 - DNA, 591 bp, Neisseria meningitidis
atgaaaaaatcctccttcatcagcgcattgggcatcggtattttgagcatcggcatggcatttgccgcccctgccgacgcggtaaaccaaatccgtcaaaacgccactcaagtattgagcatcttaaaaagcggtgatgccaacaccgcccgccaaaaagccgaagcctatgcgattccctatttcgatttccaacgtatgaccgcattggcggtcggcaacccttggcgcaccgcgtccgacgcgcaaaaacaagcgttggccaaagaatttcaaaccctgctgatccgcacctattccggcacgatgctgaaattaaaaaacgccaacgtcaacgtcaaagacaatcccatcgtcaataaaggcggcaaagaaatcatcgtccgcgccgaagtcggcgtacccgggcaaaaacccgtcaacatggacttcaccacctaccaaagcggcggtaaataccgtacctacaacgtcgccatcgaaggcgcgagcctggttaccgtgtaccgcaaccaattcggcgaaattatcaaagcgaaaggcgtggacggactgattgccgagttgaaggctaaaaacggcagcaagtaa

SEQ ID NO: 350 - protein, 196 aa, Neisseria meningitidis
MKKSSFISALGIGILSIGMAFAAPADAVNQIRQNATQVLSILKSGDANTARQKAEAYAIPYFDFQRMTALAVGNPWRTASDAQKQALAKEFQTLLIRTYSGTMLKLKNANVNVKDNPIVNKGGKEIIVRAEVGVPGQKPVNMDFTTYQSGGKYRTYNVAIEGASLVTVYRNQFGEIIKAKGVDGLIAELKAKNGSK

SEQ ID NO: 351 - DNA, 8 bp, Neisseria gonorrhoeae
  misc_feature (1)..(8): N= Unknown
nnnnnnnn

SEQ ID NO: 352 - protein, 196 aa, Neisseria gonorrhoeae
VKKSSFISALGIGILSIGMAFASPADAVGQIRQNATQVLTILKSGDAASARPKAEAYAVPYFDFQRMTALAVGNPWRTASDAQKQALAKEFQTLLIRTYSGTMLKFKNATVNVKDNPIVNKGGKEIVVRAEVGIPGQKPVNMDFTTYQSGGKYRTYNVAIEGTSLVTVYRNQFGEIIKAKGIDGLIAELKAKNGGK

SEQ ID NO: 353 - DNA, 591 bp, Neisseria gonorrhoeae
atgaaaaaatcctccttcatcagcgcattgggcatcggtattttgagcatcggcatggcatttgcctccccggccgacgcagtgggacaaatccgccaaaacgccacacaggttttgaccatcctcaaaagcggcgacgcggcttctgcacgcccaaaagccgaagcctatgcggttccctatttcgatttccaacgtatgaccgcattggcggtcggcaacccttggcgtaccgcgtccgacgcgcaaaaacaagcgttggccaaagaatttcaaaccctgctgatccgcacctattccggcacgatgctgaaattcaaaaacgcgaccgtcaacgtcaaagacaatcccatcgtcaataagggcggcaaggaaatcgtcgtccgtgccgaagtcggcatccccggtcagaagcccgtcaatatggactttaccacctaccaaagcggcggcaaataccgtacctacaacgtcgccatcgaaggcacgagcctggttaccgtgtaccgcaaccaattcggcgaaatcatcaaagccaaaggcatcgacgggctgattgccgagttgaaagccaaaaacggcggcaaataa

SEQ ID NO: 354 - protein, 196 aa, Neisseria gonorrhoeae
MKKSSFISALGIGILSIGMAFASPADAVGQIRQNATQVLTILKSGDAASARPKAEAYAVPYFDFQRMTALAVGNPWRTASDAQKQALAKEFQTLLIRTYSGTMLKFKNATVNVKDNPIVNKGGKEIVVRAEVGIPGQKPVNMDFTTYQSGGKYRTYNVAIEGTSLVTVYRNQFGEIIKAKGIDGLIAELKAKNGGK

SEQ ID NO: 355 - DNA, 480 bp, Neisseria meningitidis
  misc_feature (138)..(162): N= Unknown
atgaaacacatactccccctgattgccgcatccgcactctgcatttcaaccgcttcggcacatcctgccagcgaaccgtccactcaaaacgaaaccgctatgatcacgcataccctcatctcaaaatacagttttggnnnnnnnnnnnnnnnnnnnnnnnnngccataaaaagcaaagggatggacatttttgccgtcatcgaccatcaggaagccgcacgccgaaacggcttaacgatgcagccggcaaaagtcatcgtcttcggcacgcccaaagccggcacgccgctgatggtcaaagaccccgccttcgccctgcaactgcccctacgcgtcctcgttaccgaaacggacggcaaagtacgcgccgcctataccgatacgcgcgccctcatcgccggcagccgcatcggtttcgacgaagtggcaaacactttggcaaacgccgaaaaactgatacaaaaaaccgtaggcgaataa

SEQ ID NO: 356 - protein, 159 aa, Neisseria meningitidis
  misc_feature (47)..(54): Xaa= any amino acid
MKHILPLIAASALCISTASAHPASEPSTQNETAMITHTLISKYSFGXXXXXXXXAIKSKGMDIFAVIDHQEAARRNGLTMQPAKVIVFGTPKAGTPLMVKDPAFALQLPLRVLVTETDGKVRAAYTDTRALIAGSRIGFDEVANTLANAEKLIQKTVGE

SEQ ID NO: 357 - DNA, 480 bp, Neisseria meningitidis
atgaaacacatactccccctgattgccgcatccgcactctgcatttcaaccgcttcggcacatcctgccagcgaaccgtccacccaaaacgaaaccgctatgaccacgcataccctcacctcaaaatacagttttgacgaaaccgtcagccgccttgaaaccgccataaaaagcaaagggatggacatttttgccgtcatcgaccatcaggaagccgcccgccgaaacggcttaacgatgcagccggcaaaagtcatcgtcttcggcacgcccaaagccggcacgccgctgatggtcaaagaccccgccttcgccctgcaactgcccctacgcgtcctcgttaccgaaacggacggcaaagtacgcgccgcctataccgatacgcgcgccctcatcgccggcagccgcatcggtttcgacgaagtggcaaacactttggcaaacgccgaaaaactgatacaaaaaaccgtaggcgaataa

SEQ ID NO: 358 - protein, 159 aa, Neisseria meningitidis
MKHILPLIAASALCISTASAHPASEPSTQNETAMTTHTLTSKYSFDETVSRLETAIKSKGMDIFAVIDHQEAARRNGLTMQPAKVIVFGTPKAGTPLMVKDPAFALQLPLRVLVTETDGKVRAAYTDTRALIAGSRIGFDEVANTLANAEKLIQKTVGE

SEQ ID NO: 359 - DNA, 480 bp, Neisseria meningitidis
  misc_feature (5)..(5): N= Unknown
  misc_feature (23)..(23): N= Unknown
  misc_feature (26)..(26): N= Unknown
  misc_feature (59)..(60): N= Unknown
  misc_feature (337)..(337): N= Unknown
atganacacatactccccctgantgncgcatccgcactctgcatttcaaccgcttcggnncatcctgccagcgaaccgcaaacccaaaacgaaaccgctatgaccacgcataccctcacctcaaaatacagttttgacgaaaccgtcagccgccttgaaaccgccataaaaagcaaagggatggacatttttgccgtcatcgaccatcaggaagccgcccgccgaaacggcttaacgatgcagccggcaaaagtcatcgtcttcggcacgcccaaagccggtacgccgctgatggtcaaagaccccgccttcgccctgcaactgcccctgcgcgtcntcgttaccgaaacggacggcaaagtacgcgccgcctataccgatacgcgcgccctcatcgccggcagccgcatcggtttcgacgaagtggcaaacactttggcaaacgccgaaaaactgatacaaaaaaccataggcgaataa

SEQ ID NO: 360 - protein, 159 aa, Neisseria meningitidis
  misc_feature (2)..(2): Xaa= any amino acid
  misc_feature (8)..(9): Xaa= any amino acid
  misc_feature (20)..(20): Xaa= any amino acid
  misc_feature (113)..(113): Xaa= any amino acid
MXHILPLXXASALCISTASXHPASEPQTQNETAMTTHTLTSKYSFDETVSRLETAIKSKGMDIFAVIDHQEAARRNGLTMQPAKVIVFGTPKAGTPLMVKDPAFALQLPLRVXVTETDGKVRAAYTDTRALIAGSRIGFDEVANTLANAEKLIQKTIGE

SEQ ID NO: 361 - DNA, 8 bp, Neisseria gonorrhoeae
  misc_feature (1)..(8): N= Unknown
nnnnnnnn

SEQ ID NO: 362 - protein, 159 aa, Neisseria gonorrhoeae
MKHILPPIAASAFCISTASAHPAGKPPTQNETAMTTHTLTSKYSFDETVSRLETAIKSKGMDIFAVIDHQEAARRNGLTMQPAKVIVFGTPKAGTPLMVKDPAFALQLPLRVLVTETDGKVRTAYTDTRALIVGSRISFDEVANTLANAEKLIQKTVGE

SEQ ID NO: 363 - DNA, 480 bp, Neisseria gonorrhoeae
atgaaacacatactccccctgatcgccgcatccgcactctgcatttcaaccgcttcggcacaccctgccggcaaaccgcccacccaaaacgaaaccgctatgaccacgcacaccctcacctcgaaatacagttttgacgaaaccgtcagccgccttgaaaccgccataaaaagcaaagggatggacatttttgccgtcatcgaccatcaggaagcggcacgccgaaacggcctgaccatgcagccggcaaaagtcatcgtcttcggcacgcccaaggccggtacgccgctgatggtcaaagaccccgccttcgccctgcaactgcccctgcgcgtcctcgttaccgaaacggacggcaaagtacgcaccgcctataccgatacgcgcgccctcatcgtcggcagccgcatcagtttcgacgaagtggcaaacactttggcaaacgccgaaaaactgatacaaaaaaccgtaggcgaataa

SEQ ID NO: 364 - protein, 159 aa, Neisseria gonorrhoeae
MKHILPLIAASALCISTASAHPAGKPPTQNETAMTTHTLTSKYSFDETVSRLETAIKSKGMDIFAVIDHQEAARRNGLTMQPAKVIVFGTPKAGTPLMVKDPAFALQLPLRVLVTETDGKVRTAYTDTRALIVGSRISFDEVANTLANAEKLIQKTVGE

SEQ ID NO: 365 - DNA, 597 bp, Neisseria meningitidis
atggcttttattacgcgcttattcaaaagcagtaaatggctgattgtgccgctgatgctccccgcctttcagaatgtggcggcggaggggatagatgtgagccgtgccgaagcgaggataaccgacggcgggcagctttccatcagcagccgcttccaaaccgagctgcccgaccagctccaacaggcgttgcgccggggcgtgccgctcaactttaccttaagctggcagctttccgccccgataatcgcttcttatcggtttaaattggggcaactgattggcgatgacgacaatattgactacaaactgagtttccatccgctgaccaaacgctaccgcgttaccgtcggcgcgttttcgacagactacgacaccttggatgcggcattgcgcgcgaccggcgcggttgccaactggaaagtcctgaacaaaggcgcgctgtccggtgcggaagcaggggaaaccaaggcggaaatccgcctgacgctgtccacttcaaaactgcccaagccttttcaaatcaatgcattgacttctcaaaactggcatttggattcgggttggaaacctctaaacatcatcgggaacaaataa

SEQ ID NO: 366 - protein, 198 aa, Neisseria meningitidis
MAFITRLFKSSKWLIVPLMLPAFQNVAAEGIDVSRAEARITDGGQLSISSRFQTELPDQLQQALRRGVPLNFTLSWQLSAPIIASYRFKLGQLIGDDDNIDYKLSFHPLTKRYRVTVGAFSTDYDTLDAALRATGAVANWKVLNKGALSGAEAGETKAEIRLTLSTSKLPKPFQINALTSQNWHLDSGWKPLNIIGNK

SEQ ID NO: 367 - DNA, 597 bp, Neisseria meningitidis
atggcttttattacgcgcttattcaaaagcagtaaatggctgattgtgccgctgatgctccccgcctttcagaatgtggcggcggaggggatagatgtgagccgtgccgaagcgaggataaccgacggcgggcagctttccatcagcagccgcttccaaaccgagctgcccgaccagctccaacaggcgttgcgccggggcgtgccgctcaactttaccttaagctggcagctttccgccccgataatcgcttcttatcggtttaaattggggcaactgattggcgatgacgacaatattgactacaaactgagtttccatccgctgaccaaccgctaccgcgttaccgtcggcgcgttttcgacagactacgacaccttggatgcggcattgcgcgcgaccggcgcggttgccaactggaaagtcctgaacaaaggcgcgctgtccggtgcggaagcaggggaaaccaaggcggaaatccgcctgacgctgtccacttcaaaactgcccaagccttttcaaatcaatgcattgacttctcaaaactggcatttggattcgggttggaaacctctaaacatcatcgggaacaaataa

SEQ ID NO: 368 - protein, 198 aa, Neisseria meningitidis
MAFITRLFKSSKWLIVPLMLPAFQNVAAEGIDVSRAEARITDGGQLSISSRFQTELPDQLQQALRRGVPLNFTLSWQLSAPIIASYRFKLGQLIGDDDNIDYKLSFHPLTNRYRVTVGAFSTDYDTLDAALRATGAVANWKVLNKGALSGAEAGETKAEIRLTLSTSKLPKPFQINALTSQNWHLDSGWKPLNIIGNK

SEQ ID NO: 369 - DNA, 600 bp, Neisseria meningitidis
  misc_feature (125)..(125): N= Unknown
  misc_feature (147)..(147): N= Unknown
  misc_feature (150)..(150): N= Unknown
  misc_feature (187)..(189): N= Unknown
  misc_feature (193)..(194): N= Unknown
  misc_feature (196)..(196): N= Unknown
  misc_feature (208)..(208): N= Unknown
  misc_feature (218)..(218): N= Unknown
  misc_feature (228)..(228): N= Unknown
  misc_feature (268)..(268): N= Unknown
  misc_feature (298)..(298): N= Unknown
  misc_feature (372)..(372): N= Unknown
atggcttttattacgcgcttattcaaaagcattaaacaatggcttgtgctgctgccgatgctttccgttttgccggacgcggcggcggaggggatagatgtgagccgcgccgaagcgaggataancgacggcgggcagctttccatnagnagccgcttccaaaccgagctgcccgaccagctccaannngcgnngngccggggcgtgncgctcaactntaccttaagntggcagctttccgccccgataatcgcttcttatcggtttnaattggggcaactgattggcgatgacgacnatattgactacaaactgagtttccatccgctgaccaaccgctaccgcgttaccgtcggcgcgttttcgacagantacgacaccttggatgcggcattgcgcgcgaccggcgcggttgccaactggaaagtcctgaacaaaggcgcgctgtccggtgcggaagcaggggaaaccaaggcggaaatccgcctgacgctgtccacttcaaaactgcccaagccttttcaaatcaatgcattgacttctcaaaactggcatttggattcgggttggaaacctctaaacatcatcgggaacaaataa

SEQ ID NO: 370 - protein, 199 aa, Neisseria meningitidis
  misc_feature (42)..(42): Xaa= any amino acid
  misc_feature (49)..(50): Xaa= any amino acid
  misc_feature (63)..(63): Xaa= any amino acid
  misc_feature (65)..(66): Xaa= any amino acid
  misc_feature (70)..(70): Xaa= any amino acid
  misc_feature (73)..(73): Xaa= any amino acid
  misc_feature (76)..(76): Xaa= any amino acid
  misc_feature (90)..(90): Xaa= any amino acid
  misc_feature (100)..(100): Xaa= any amino acid
  misc_feature (124)..(124): Xaa= any amino acid
MAFITRLFKSIKQWLVLLPMLSVLPDAAAEGIDVSRAEARIXDGGQLSXXSRFQTELPDQLQXAXXRGVXLNXTLXWQLSAPIIASYRFXLGQLIGDDDXIDYKLSFHPLTNRYRVTVGAFSTXYDTLDAALRATGAVANWKVLNKGALSGAEAGETKAEIRLTLSTSKLPKPFQINALTSQNWHLDSGWKPLNIIGNK

SEQ ID NO: 371 - DNA, 600 bp, Neisseria gonorrhoeae
atggcttttattacgcgcttattcaaaagcattaaacaatggcttgtgctgttgccgatactctccgttttgccggacgcggcggcggagggcattgccgcgacccgcgccgaagcgaggataaccgacggcgggcggctttccatcagcagccgcttccaaaccgagctgcccgaccagctccaacaggcgttgcgccggggcgtaccgctcaactttaccttaagctggcagctttccgccccgacaatcgcttcttatcggtttaaattggggcaactgattggcgatgacgacaatattgactacaaactaagtttccatccgctgaccaaccgctaccgcgttaccgtcggcgcattttccaccgattacgacactttggatgcggcattgcgcgcgaccggcgcggttgccaactggaaagtcctgaacaaaggcgcgttgtccggtgcggaagcaggggaaaccaaggcggaaatccgcctgacgctgtccacttcaaaactgcccaagcctttccaaatcaacgcattgacttctcaaaactggcatttggattcgggttggaaacctctaaacatcatcgggaacaaataa

SEQ ID NO: 372 - protein, 199 aa, Neisseria gonorrhoeae
MAFITRLFKSIKQWLVLLPILSVLPDAAAEGIAATRAEARITDGGRLSISSRFQTELPDQLQQALRRGVPLNFTLSWQLSAPTIASYRFKLGQLIGDDDNIDYKLSFHPLTNRYRVTVGAFSTDYDTLDAALRATGAVANWKVLNKGALSGAEAGETKAEIRLTLSTSKLPKPFQINALTSQNWHLDSGWKPLNIIGNK

SEQ ID NO: 373 - DNA, 1419 bp, Neisseria meningitidis
atggacacaaaagaaatcctcggtacgcggcaggctcgatcggcagcgcggttttagccgtcatcatcctgccgctgctgtcgtggtatttccccgccgacgacatcgggcgcatcgtgctgatgcagacggcggcggggctgacggtgtcggtgttgtgcctcgggctggatcaggcatacgtccgcgaatactatgccaccgccgacaaagacaccttgttcaaaaccctgttcctgccgccgctgctgtctgccgccgcgatagccgccctgctgctttcccgcccgtccctgccgtctgaaatcctgttttcactcgacgatgccgccgccggcatcgggctggtgctgtttgaactgagcttcctgcccatccgctttctcttactggttttgcgtatggaaggacgcgcccttgccttttcgtccgcgcaactcgtgcccaagctcgccatcctgctgctgtgccgctgacggtcgggctgctgcactttccagcgaacaccgccgtcctgaccgccgtttacgcgctggcaaaccttgccgccgccgcctttttgctgtttcaaaaccgatgccgtctgaaggccgtccggcacgcaccgttttcgcccgccgtcctgcaccgggggtgcgctacggcataccgatcgcactgagcagcatcgcctattgggggctggcatccgccgaccgtttgttcctgaaaaaatatgccggcctggaacagctcggcgtttattcgatgggtatttcgttcggcggggcggcattattgttccaaagcatcttttcaacggtctggacaccgtatattttccgcgcaatcgaagaaaacgccccgcccgctcgcctctcggcaacggcagaatccgccgccgccctgcttgcctccgccctctgctgaccggcattttctcgccccttgcctccctcctgctgccggaaaactacgccgccgtccggtttatcgtcgtatcgtgtatgtgccgccgctgttttgcacgctggcggaaatcagcggcatcggtttgaacgtcgttcgcaaaacgcgcccgatcgcgctcgccaccttgggcgcgctggcggcaaacctgctgctgctggggcttgaccgtgccgtaccggcgaggccgccggcgcggcggttgcctgtgccgcctcattctggctgttttttgccttcaagaccgaaagctcytgccgcctgtggcagccgctcaaacgcctgccgctttatctgcacacattgttctgcctgacctcctcggcggcctacacctgcttcggcacgccggcaaactatcccctgtttgccggcgtatgggcggcatatctggcaggctgcatcctgcgccaccggaaagatttgcacaaactgtttcattatttgaaaaaacaaggtttcccattatga

SEQ ID NO: 374 - protein, 474 aa, Neisseria meningitidis
  misc_feature (8)..(8): Xaa= any amino acid
  misc_feature (157)..(157): Xaa= any amino acid
  misc_feature (213)..(213): Xaa= any amino acid
  misc_feature (304)..(304): Xaa= any amino acid
  misc_feature (332)..(332): Xaa= any amino acid
  misc_feature (382)..(382): Xaa= any amino acid
MDTKEILXYAAGSIGSAVLAVIILPLLSWYFPADDIGRIVLMQTAAGLTVSVLCLGLDQAYVREYYATADKDTLFKTLFLPPLLSAAAIAALLLSRPSLPSEILFSLDDAAAGIGLVLFELSFLPIRFLLLVLRMEGRALAFSSAQLVPKLAILLLXPLTVGLLHFPANTAVLTAVYALANLAAAAFLLFQNRCRLKAVRHAPFSPAVLHRGXRYGIPIALSSIAYWGLASADRLFLKKYAGLEQLGVYSMGISFGGAALLFQSIFSTVWTPYIFRAIEENAPPARLSATAESAAALLASALCXTGIFSPLASLLLPENYAAVRFIVVSCMXPPLFCTLAEISGIGLNVVRKTRPIALATLGALAANLLLLGLDRAVPARPXGAAVACAASFWLFFAFKTESSCRLWQPLKRLPLYLHTLFCLTSSAAYTCFGTPANYPLFAGVWAAYLAGCILRHRKDLHKLFHYLKKQGFPL

SEQ ID NO: 375 - DNA, 1422 bp, Neisseria meningitidis
atggacacaaaagaaatcctcggctacgcggcaggctcgatcggcagcgcggttttagccgtcatcatcctgccgctgctgtcgtggtatttccccgccgacgacatcgggcgcatcgtgctgatgcagacggcggcggggctgacggtgtcggtgttgtgcctcgggctggatcaggcatacgtccgcgaatactatgccaccgccgacaaagacaccttgttcaaaaccctgttcctgccgccgctgctgtctgccgccgcgatagccgccctgctgctttcccgcccgtccctgccgtctgaaatcctgttttcactcgacgatgccgccgccggcatcgggctggtgctgtttgaactgagcttcctgcccatccgctttctcttactggttttgcgtatggaaggacgcgcccttgccttttcgtccgcgcaactcgtgcccaagctcgccatcctgctgctgctgccgctgacggtcgggctgctgcactttccagcgaacaccgccgtcctgaccgccgtttacgcgctggcaaaccttgccgccgccgcctttttgctgtttcaaaaccgatgccgtctgaaggccgtccggcacgcaccgttttcgcccgccgtcctgcaccgggggctgcgctacggcataccgatcgcactgagcagcatcgcctattgggggctggcatccgccgaccgtttgttcctgaaaaaatatgccggcctggaacagctcggcgtttattcgatgggtatttcgttcggcggggcggcattattgttccaaagcatcttttcaacggtctggacaccgtatattttccgcgcaatcgaagaaaacgccccgcccgcccgcctctcggcaacggcagaatccgccgccgccctgcttgcctccgccctctgcctgaccggcattttctcgccccttgcctccctcctgctgccggaaaactacgccgccgtccggtttatcgtcgtatcgtgtatgctgccgccgctgttttgcacgctggcggaaatcagcggcatcggtttgaacgtcgtccgcaaaacgcgcccgatcgcgctcgccaccttgggcgcgctggcggcaaacctgctgctgctggggcttgccgtgccgtccggcggcgcgcgcggcgcggcggttgcctgtgccgcctcattctggctgttttttgccttcaagaccgaaagctcctgccgcctgtggcagccgctcaaacgcctgccgctttatctgcacacattgttctgcctgacctcctcggcggcctacacctgcttcggcacgccggcaaactatcccctgtttgccggcgtatgggcggcatatctggcaggctgcatcctgcgccaccggaaagatttgcacaaactgtttcattatttgaaaaaacaaggtttcccattatga

SEQ ID NO: 376 - protein, 473 aa, Neisseria meningitidis
MDTKEILGYAAGSIGSAVLAVIILPLLSWYFPADDIGRIVLMQTAAGLTVSVLCLGLDQAYVREYYATADKDTLFKTLFLPPLLSAAAIAALLLSRPSLPSEILFSLDDAAAGIGLVLFELSFLPIRFLLLVLRMEGRALAFSSAQLVPKLAILLLLPLTVGLLHFPANTAVLTAVYALANLAAAAFLLFQNRCRLKAVRHAPFSPAVLHRGLRYGIPIALSSIAYWGLASADRLFLKKYAGLEQLGVYSMGISFGGAALLFQSIFSTVWTPYIFRAIEENAPPARLSATAESAAALLASALCLTGIFSPLASLLLPENYAAVRFIVVSCMLPPLFCTLAEISGIGLNVVRKTRPIALATLGALAANLLLLGLAVPSGGARGAAVACAASFWLFFAFKTESSCRLWQPLKRLPLYLHTLFCLTSSAAYTCFGTPANYPLFAGVWAAYLAGCILRHRKDLHKLFHYLKKQGFPL

SEQ ID NO: 377 - DNA, 1422 bp, Neisseria meningitidis
atggacacaaaagaaatcctcggctacgcggcaggctcgatcggcagcgcggttttagccgtcatcatcctgccgctgctgtcgtggtatttccctgccgacgacatcggacgcatcgtgctgatgcagacggcggcggggctgacggtgtcggtgttgtgcctcgggctggatcaggcatacgtccgcgaatactatgccgccgccgacaaagacactttgttcaaaaccctgttcctgccgccgctgctgtctgccgccgcgatagccgccctgctgctttcccgcccatccctgccgtctgaaatcctgttttcgctcgacgatgccgccgccggcatcgggctggtgctgtttgaactgagcttcctgcccatccgctttctcttactggttttgcgtatggaaggacgcgcccttgccttttcgtccgcgcaactcgtgtccaagctcgccatcctgctgctgctgccgctgacggtcgggctgctgcactttccggcgaacaccgccgtcctgaccgccgtttacgcgctggcaaaccttgccgccgccgcctttttgctgtttcaaaaccgatgccgtctgaaggccgtccggcgcgcaccgttttcatccgccgtcctgcatcgcggcctgcgctacggcataccgatcgcactaagcagcatcgcctattgggggctggcatccgccgaccgtttgttcctgaaaaaatatgccggcctagaacagctcggcgtttattcgatgggtatttcgttcggcggagcggcattattgttccaaagcatcttttcaacggtctggacaccgtatattttccgcgcaatcgaagcaaacgccccgcccgcccgcctctcggcaacggcagaatccgccgccgccctgcttgcctccgccctctgcctgaccggcattttctcgcccctcgcctccctcctgctgccggaaaactacgccgccgtccggtttatcgtcgtatcgtgtatgctgcctccgctgttttgcacgctggtagaaatcagcggcatcggtttgaacgtcgtccgaaaaacacgcccgatcgcgctcgccaccttgggcgcgctggcggcaaacctgctgctgctggggcttgccgtaccgtccggcggcgcgcgcggcgcggcggttgcctgtgccgcctcattttggctgttttttgttttcaagaccgaaagctcctgccgcctgtggcagccgctcaaacgcctgccgctttatatgcacacattgttctgcctggcctcctcggcggcctacacctgcttcggcactccggcaaactaccccctgtttgccggcgtatgggcggtatatctggcaggctgcatcctgcgccaccggaaagatttgcacaaactgtttcattatttgaaaaaacaaggtttcccattatga

SEQ ID NO: 378 - protein, 473 aa, Neisseria meningitidis
MDTKEILGYAAGSIGSAVLAVIILPLLSWYFPADDIGRIVLMQTAAGLTVSVLCLGLDQAYVREYYAAADKDTLFKTLFLPPLLSAAAIAALLLSRPSLPSEILFSLDDAAAGIGLVLFELSFLPIRFLLLVLRMEGRALAFSSAQLVSKLAILLLLPLTVGLLHFPANTAVLTAVYALANLAAAAFLLFQNRCRLKAVRRAPFSSAVLHRGLRYGIPIALSSIAYWGLASADRLFLKKYAGLEQLGVYSMGISFGGAALLFQSIFSTVWTPYIFRAIEANAPPARLSATAESAAALLASALCLTGIFSPLASLLLPENYAAVRFIVVSCMLPPLFCTLVEISGIGLNVVRKTRPIALATLGALAANLLLLGLAVPSGGARGAAVACAASFWLFFVFKTESSCRLWQPLKRLPLYMHTLFCLASSAAYTCFGTPANYPLFAGVWAVYLAGCILRHRKDLHKLFHYLKKQGFPL

SEQ ID NO: 379 - DNA, 1422 bp, Neisseria gonorrhoeae
atggacacaaaagaaatcctcggctacgcggcaggctcgatcggcagcgcggttttagccgtcatcatcctgccgctgctgtcgtggtatttccccgccgacgacatcgggcgcatcgtgctgatgcagacggcggcgggactgacggtgtcggtattgtgcctcgggctggatcaggcatacgtccgcgaatactatgccgccgccgacaaagacactttgttcaaaaccctgttcctgccgccgctgctgttttccgccgcgatagccgccctgctgctttcccgcccgtccctgccgtctgaaatcctgttttcgctcgacgatgccgccgccggcatcgggctggtgctgtttgaactgagcttcctgcccatccgctttctcttactggttttgcgtatggaagggcgcgcccttgccttttcgtccgcgcaactcgtgcccaaactcgccattctgctgctgttgccgctgacggtcgggctgctgcactttccggcgaacacctccgtcctgaccgccgtttacgcgctggcaaaccttgccgccgccgcctttttgctgtttcaaaaccgatgccgtctgaaggccgtccggcgcgcgccgttttcgcccgccgtcctgcaccgggggctgcgctacggcataccgctcgcactgagcagccttgcctattgggggctggcatccgccgaccgtttgttcctgaaaaaatatgcgggcctggaacagctcggcgtttattcgatgggtatttcgttcggcggggcggcattattgctccaaagcatcttttcaacggtctggacaccgtatattttccgtgcaatcgaagaaaacgccacgcccgcccgcctctcggcaacggcagaatccgccgccgccctgcttgcctccgccctctgcctgaccggaattttctcgcccctcgcctccctcctgctgccggaaaactacgccgccgtccggtttaccgtcgtatcgtgtatgctgccgccgctgttttacacgctgaccgaaatcagcggcatcggtttgaacgtcgtccgcaaaacgcgtccgatcgcgcttgccaccttgggcgcgctggcggcaaacctgctgctgctggggcttgccgtaccgtccggcggcacgcgcggcgcggcggttgcctgtgccgcctcattctggttgttttttgttttcaagacagaaagctcctgccgcctgtggcagccgctcaaacgcctgccgctttatatgcacacattgttctgcctggcctcctcggcggcctacacctgcttcggcacaccggcaaactaccccctgtttgccggcgtatgggcggcatatctggcaggctgcatcctgcgccaccggaaaaatttgcacaaactgtttcattatttgaaaaaacaaggtttcccattatga

SEQ ID NO: 380 - protein, 473 aa, Neisseria gonorrhoeae
MDTKEILGYAAGSIGSAVLAVIILPLLSWYFPADDIGRIVLMQTAAGLTVSVLCLGLDQAYVREYYAAADKDTLFKTLFLPPLLFSAAIAALLLSRPSLPSEILFSLDDAAAGIGLVLFELSFLPIRFLLLVLRMEGRALAFSSAQLVPKLAILLLLPLTVGLLHFPANTSVLTAVYALANLAAAAFLLFQNRCRLKAVRRAPFSPAVLHRGLRYGIPLALSSLAYWGLASADRLFLKKYAGLEQLGVYSMGISFGGAALLLQSIFSTVWTPYIFRAIEENATPARLSATAESAAALLASALCLTGIFSPLASLLLPENYAAVRFTVVSCMLPPLFYTLTEISGIGLNVVRKTRPIALATLGALAANLLLLGLAVPSGGTRGAAVACAASFWLFFVFKTESSCRLWQPLKRLPLYMHTLFCLASSAAYTCFGTPANYPLFAGVWAAYLAGCILRHRKNLHKLFHYLKKQGFPL

SEQ ID NO: 381 - DNA, 637 bp, Neisseria meningitidis
atcctgaaaccgcataaccagcttaaggaagacatccaacctgatccggccgatcaaaacgccttgtccgaaccggatgctgcgacagaggcagagcagtcggatgcggaaaatgctgccgacaagcagcccgttgccgataaagccgacgaggttgaagaaaaggcgggcgagccggaacgggaagagccggacggacaggcagtgcgtaagaaagcgctgacggaagagcgtgaacaaaccgtcagggaaaaagcgcagaagaaagatgccgaaacggttaaaatacaagcggtaaaaccgtctaaagaaacagagaaaaaagcttcaaaagaagagaaaaaggcggcgaaggaaaaagttgcacccaaaccaaccccggaacaaatcctcaacagcggcagcatcgaaaamgcgcgcagtgccgccgccaaagaagtgcagaaaatgaaaacgtccgacaaggcggaagcaacgcattatctgcaaatgggcgcgtatgccgaccgtcagagcgcggaagggcagcgtgccaaactggcaatcttgggcatatcttccaaggtggtcggttatcaggcgggacataaaacgctttaccgggtgcaaagcggcaatatgtctgccgatgcggtga

SEQ ID NO: 382 - protein, 212 aa, Neisseria meningitidis
  misc_feature (138)..(138): Xaa= any amino acid
  misc_feature (151)..(151): Xaa= any amino acid
  misc_feature (159)..(159): Xaa= any amino acid
ILKPHNQLKEDIQPDPADQNALSEPDAATEAEQSDAENAADKQPVADKADEVEEKAGEPEREEPDGQAVRKKALTEEREQTVREKAQKKDAETVKIQAVKPSKETEKKASKEEKKAAKEKVAPKPTPEQILNSGSIEXARSAAAKEVQKMXNVRQGGSXRIICKWARMPTVRARKGSVPNWQSWAYLPRWSVIRRDIKRFTGCKAAICLPMR

SEQ ID NO: 383 - DNA, 870 bp, Neisseria meningitidis
atgtttatgaacaaattttcccaatccggaaaaggtctgtccggttttttcttcggtttgatactggcgacggtcattattgccggtattttgttttatctgaaccagagcggtcaaaatgcgttcaaaatcccggcttcgtcgaagcagcctgcagaaacggaaatcctgaaaccgaaaaaccagcctaaggaagacatccaacctgaaccggccgatcaaaacgccttgtccgaaccggatgctgcgacagaggcagagcagtcggatgcggaaaaagctgccgacaagcagcccgttgccgataaagccgacgaggttgaagaaaaggcgggcgagccggaacgggaagagccggacggacaggcagtgcgtaagaaagcgctgacggaagagcgtgaacaaaccgtcagggaaaaagcgcagaagaaagatgccgaaacggttaaaaaacaagcggtaaaaccgtctaaagaaacagagaaaaaagcttcaaaagaagagaaaaaggcggcgaaggaaaaagttgcacccaaaccaaccccggaacaaatcctcaacagcggcagcatcgaaaaagcgcgcagtgccgccgccaaagaagtgcagaaaatgaaaacgtccgacaaggcggaagcaacgcattatctgcaaatgggcgcgtatgccgaccgtcagagcgcggaagggcagcgtgccaaactggcaatcttgggcatatcttccaaggtggtcggttatcaggcgggacataaaacgctttaccgggtgcaaagcggcaatatgtctgccgatgcggtgaaaaaaatgcaggacgagttgaaaaaacatgaagtcgccagcctgatccgttctatcgaaagcaaataa

SEQ ID NO: 384 - protein, 289 aa, Neisseria meningitidis
MFMNKFSQSGKGLSGFFFGLILATVIIAGILFYLNQSGQNAFKIPASSKQPAETEILKPKNQPKEDIQPEPADQNALSEPDAATEAEQSDAEKAADKQPVADKADEVEEKAGEPEREEPDGQAVRKKALTEEREQTVREKAQKKDAETVKKQAVKPSKETEKKASKEEKKAAKEKVAPKPTPEQILNSGSIEKARSAAAKEVQKMKTSDKAEATHYLQMGAYADRQSAEGQRAKLAILGISSKVVGYQAGHKTLYRVQSGNMSADAVKKMQDELKKHEVASLIRSIESK

SEQ ID NO: 385 - DNA, 770 bp, Neisseria meningitidis
tgaaccagagcggtcaaaatgcgttcaaaatcccggttccgtcgaagcagcctgcagaaacggaaatcctgaaaccgaaaaaccagcctaaggaagacatccaacctgaaccggccgatcaaaacgccttgtccgaaccggatgctgcgaaagaggcagagcagtcggatgcggaaaaagctgccgacaagcagcccgttgccgacaaagccgacgaggttgaggaaaaggcggacgagccggagcgggaaaagtcggacggacaggcagtgcgcaagaaagcactgacggaagagcgtgaacaaaccgtcggggaaaaagcgcagaagaaagatgccgaaacggttaaaaaacaagcggtaaaaccatctaaagaaacagagaaaaaagcttcaaaagaagagaaaaaggcggagaaggaaaaagttgcacccaaaccgaccccggaacaaatcctcaacagcggcagcatcgaaaaagcgcgcagtgccgctgccaaagaagtgcagaaaatgaaaacgcccgacaaggcggaagcaacgcattatctgcaaatgggcgcgtatgccgaccgccggagcgcggaagggcagcgtgccaaactggcaatcttgggcatatcttccaaggtggtcggttatcaggcgggacataaaacgctttaccgggtgcaaagcggcaatatgtctgccgatgcggtgaaaaaaatgcaggacgagttgaaaaaacatgaagtcgccagcctgatccgttctatcgaaagcaaataa

SEQ ID NO: 386 - protein, 289 aa, Neisseria meningitidis
MFMNKFSQSGKGLSGFFFGLILATVIIAGILFYLNQSGQNAFKIPVPSKQPAETEILKPKNQPKEDIQPEPADQNALSEPDAAKEAEQSDAEKAADKQPVADKADEVEEKADEPEREKSDGQAVRKKALTEEREQTVGEKAQKKDAETVKKQAVKPSKETEKKASKEEKKAEKEKVAPKPTPEQILNSGSIEKARSAAAKEVQKMKTPDKAEATHYLQMGAYADRRSAEGQRAKLAILGISSKVVGYQAGHKTLYRVQSGNMSADAVKKMQDELKKHEVASLIRSIESK

SEQ ID NO: 387 - DNA, 8 bp, Neisseria gonorrhoeae
  misc_feature (1)..(8): N= Unknown
nnnnnnnn

SEQ ID NO: 388 - protein, 267 aa, Neisseria gonorrhoeae
MFMNKFSQSGKGLSGFFFGLILATVIIAGILLYLNQGGQNAFKIPAPSKQPAETEILKLKNQPKEDIQPEPADQNALSEPDVAKEAEQSDAEKAADKQPVADKADEVEEKAGEPEREEPDGQAVRKKALTEEREQTVREKAQKKDAETVKKKAVKPSKETEKKASKEEKKAAKEKVAPKPTPEQILNSRSIEKARSAAAKEVQKMKNFGQGGSQRIICKWARMPNPGARKGSVPNWQSWAYLPKWSAIRRDIKRFTACKAAICPPMR

SEQ ID NO: 389 - DNA, 873 bp, Neisseria gonorrhoeae
atgtttatgaacaaattttcccaatccggaaaaggtctgtccggtttcttcttcggtttgatactggcaacggtcattattgccggtattttgctttatctgaaccagggcggtcaaaatgcgttcaaaatcccggctccgtcgaagcagcctgcagaaacggaaatcctgaaactgaaaaaccagcctaaggaagacatccaacctgaaccggccgatcaaaacgccttgtccgaaccggatgttgcgaaagaggcagagcagtcggatgcggaaaaagctgccgacaagcagcccgttgccgacaaagccgacgaggttgaagaaaaggcgggcgagccggaacgggaagagccggacggacaggcagtgcgcaagaaagcactgacggaagagcgtgaacaaaccgtcagggaaaaagcgcagaagaaagatgccgaaacggttaaaaaacaagcggtaaaaccgtctaaagaaacagagaaaaaagcttcaaaagaagagaaaaaggcggcgaaagaaaaagttgcacccaaaccgaccccggaacaaatcctcaacagccgcagcatcgaaaaagcgcgtagtgccgctgccaaagaagtgcagaaaatgaaaaactttgggcaaggcggaagccaacgcattatctgcaaatgggcgcgtatgccgaccgtccggagcgcggaagggcagcgtgccaaactggcaatcttgggcatatcttccgaagtggtcggctatcaggcgggacataaaacgctttaccgcgtgcaaagcggcaatatgtccgccgatgcggtgaaaaaaatgcaggacgagttgaaaaagcatggggttgccagcctgatccgtgcgattgaaggcaaataa

SEQ ID NO: 390 - protein, 290 aa, Neisseria gonorrhoeae
MFMNKFSQSGKGLSGFFFGLILATVIIAGILLYLNQGGQNAFKIPAPSKQPAETEILKLKNQPKEDIQPEPADQNALSEPDVAKEAEQSDAEKAADKQPVADKADEVEEKAGEPEREEPDGQAVRKKALTEEREQTVREKAQKKDAETVKKQAVKPSKETEKKASKEEKKAAKEKVAPKPTPEQILNSRSIEKARSAAAKEVQKMKNFGQGGSQRIICKWARMPTVRSAEGQRAKLAILGISSEVVGYQAGHKTLYRVQSGNMSADAVKKMQDELKKHGVASLIRAIEGK

SEQ ID NO: 391 - DNA, 668 bp, Neisseria meningitidis
atgaaccacgacatcactttcctcaccctgttcctactcggtktcttcggcggaacgcactgcatcggtatgtgcggcggattaagcagcgcgtttgsstccaactccccccgcatatcaaccgcttttggctgatcctgctgcttaacacaggacgggtaagcagctatacggcaatcggcctgatactcggattaatcggacaggtcggcgtttcactcgaccaaacccgcgtcctgcagaatattttatacacggccgccaacctcctgctgctctttttaggcttatacttgagcggtatttcttccttggcggcaaaaatcgagaaaatcggcaaaccgatatggcggaacctgaacccgatactcaaccggctgttacccataaaatccatacccgcctgccttgcggtcggaatattatggggctggctgccgtgcggactggtttacagcgcgtcgctttacgcgctgggaagcggtagtgcggcaacgggcgggttatatatgcttgcctttgcactgggtacgctgcccaatcttttagcaatcggcattttttccctgcaactgaawaaaatcatgcaaaaccgatatatccgcctgtgtacgggattatccgtatcattatgggcattatggaaacttgccgtcctgtggctgtaa

SEQ ID NO: 392 - protein, 222 aa, Neisseria meningitidis
  misc_feature (15)..(15): Xaa= any amino acid
  misc_feature (33)..(34): Xaa= any amino acid
  misc_feature (193)..(193): Xaa= any amino acid
MNHDITFLTLFLLGXFGGTHCIGMCGGLSSAFXXQLPPHINRFWLILLLNTGRVSSYTAIGLILGLIGQVGVSLDQTRVLQNILYTAANLLLLFLGLYLSGISSLAAKIEKIGKPIWRNLNPILNRLLPIKSIPACLAVGILWGWLPCGLVYSASLYALGSGSAATGGLYMLAFALGTLPNLLAIGIFSLQLXKIMQNRYIRLCTGLSVSLWALWKLAVLWL

SEQ ID NO: 393 - DNA, 669 bp, Neisseria meningitidis
atgaaccacgacatcactttcctcaccctgttcctactcggtttcttcggcggaacgcactgcatcggtatgtgcggcggattaagcagcgcgtttgcgctccaactccccccgcatatcaaccgcttttggctgatcctgctgcttaacacaggacgggtaagcagctatacggcaatcggcctgatactcggattaatcggacaggtcggcgtttcactcgaccaaacccgcgtcctgcagaatattttatacacggccgccaacctcctgctgctctttttaggcttatacttgagcggtatttcttccttggcggcaaaaatcgagaaaatcggcaaaccgatatggcggaacctgaacccgatactcaaccggctgttacccataaaatccatacccgcctgccttgcggtcggaatattatggggctggctgccgtgcggactggtttacagcgcgtcgctttacgcgctgggaagcggtagtgcggcaacgggcgggttatatatgcttgcctttgcactgggtacgctgcccaatcttttagcaatcggcattttttccctgcaactgaaaaaaatcatgcaaaaccgatatatccgcctgtgtacgggattatccgtatcattatgggcattatggaaacttgccgtcctgtggctgtaa

SEQ ID NO: 394 - protein, 222 aa, Neisseria meningitidis
MNHDITFLTLFLLGFFGGTHCIGMCGGLSSAFALQLPPHINRFWLILLLNTGRVSSYTAIGLILGLIGQVGVSLDQTRVLQNILYTAANLLLLFLGLYLSGISSLAAKIEKIGKPIWRNLNPILNRLLPIKSIPACLAVGILWGWLPCGLVYSASLYALGSGSAATGGLYMLAFALGTLPNLLAIGIFSLQLKKIMQNRYIRLCTGLSVSLWALWKLAVLWL

SEQ ID NO: 395 - DNA, 669 bp, Neisseria meningitidis
  misc_feature (9)..(9): N= Unknown
  misc_feature (129)..(129): N= Unknown
  misc_feature (238)..(238): N= Unknown
  misc_feature (548)..(548): N= Unknown
  misc_feature (577)..(577): N= Unknown
atgaaccangacatcactttcctcaccctgttcctactcggtttcttcggcggaacgcactgcatcggtatgtgcggcggattaagcagcgcgtttgcgctccaactccccccgcatatcaaccgcttntggctgatcctgctgcttaacacaggacgggtaagcagctatacggcaatcggcctgatactcggattaatcggacaggtcggcgtttcactcgaccaaacccgcgtcntgcagaatattttatacacggccgccaacctcctgctgctctttttaggcttatacttgagcggtatttcttccttggcggcaaaaatcgagaaaatcggcaaaccgatatggcggaacctgaacccgatactcaaccggctgttacccataaaatccatacccgcctgccttgcggtcggaatattatggggctggctgccgtgcggactagtttacagcgcgtcgctttacgcgctgggaagcggtagtgcggcaacgggcgggttatatatgcttgcctttgcactgggtacgctgcccaatctttnggcaatcggcattttttccctgcaactgnaaaaaatcatgcaaaaccgatatatccgcctgtgtacgggattatccgtatcattatgggcattatggaaacttgccgtcctgtggctgtaa

SEQ ID NO: 396 - protein, 222 aa, Neisseria meningitidis
  misc_feature (3)..(3): Xaa= any amino acid
  misc_feature (43)..(43): Xaa= any amino acid
  misc_feature (80)..(80): Xaa= any amino acid
  misc_feature (183)..(183): Xaa= any amino acid
  misc_feature (193)..(193): Xaa= any amino acid
MNXDITFLTLFLLGFFGGTHCIGMCGGLSSAFALQLPPHINRXWLILLLNTGRVSSYTAIGLILGLIGQVGVSLDQTRVXQNILYTAANLLLLFLGLYLSGISSLAAKIEKIGKPIWRNLNPILNRLLPIKSIPACLAVGILWGWLPCGLVYSASLYALGSGSAATGGLYMLAFALGTLPNLXAIGIFSLQLXKIMQNRYIRLCTGLSVSLWALWKLAVLWL

SEQ ID NO: 397 - DNA, 669 bp, Neisseria gonorrhoeae
atgaaccacgacatcactttcctcaccctgttcctgctcggtttcttcggcggaactcactgcatcggtatgtgcggcggattaagcagcgcgtttgcgctccaactccccccgcatatcaaccgcttttggctgattctgctgcttaacacaggacggataagcagctatacggcaatcggcctgatgctcggattaatcggacaactcggcatttcactcgaccaaacccgcgtcctgcaaaatattttatacacagcctccaacctcctgctgctctttttaggcttatacttgagcggtatttcttccttggcggcaaaaatcgagaaaatcggcaaaccgatatggcgcaacctgaacccgatactcaaccggctgctgcccataaaatccatacccgcctgccttgctgtcggaatattatggggctggctgccgtgcggactggtttacagcgcatcactttacgcgctgggaagcggtagtgcgacaaccggcggactgtatatgcttgcctttgcactgggtacgctgcccaatcttttggcaatcggcattttttccctgcaactgaaaaaaatcatgcaaaaccgatatatccgcctgtgtacaggattatccgtatcattatgggcattatggaagcttgccgtcctgtggctgtaa

SEQ ID NO: 398 - protein, 222 aa, Neisseria gonorrhoeae
MNHDITFLTLFLLGFFGGTHCIGMCGGLSSAFALQLPPHINRFWLILLLNTGRISSYTAIGLMLGLIGQLGISLDQTRVLQNILYTASNLLLLFLGLYLSGISSLAAKIEKIGKPIWRNLNPILNRLLPIKSIPACLAVGILWGWLPCGLVYSASLYALGSGSATTGGLYMLAFALGTLPNLLAIGIFSLQLKKIMQNRYIRLCTGLSVSLWALWKLAVLWL

SEQ ID NO: 399 - DNA, 832 bp, Neisseria meningitidis
atggaaaaccaaaggccgctcctaggctttcgcttggcacttttggcggcgatgacgtggggaacgctgccgattccgtgcggcaggtattgaagtttgtcgatgcgccgacgctggtgtgggtgcgttttaccgtggcggcggcggtattgtttgttttgctggcactgggcgggcggctgccgaagcggcgaggatttttcttggtgctcattcaggctgctgctgctcggcgtggcgggcatttcggcaaactttgtgctgattgcccaagggctgcattatatttcgccgaccacgacgcaggttttgtggcagatttcgccgtttacgatgattgtwgtcggtgtgttggtgtttaaagaccggatgactgccgctcagaaaatcggcttggttttgctgcttgccggtttgcttatgtattttaacgataaattcggcgagttgtcgggtttgggcgcgtatgcaagggcgtgttgctgtgtgcggcaggcagtatggcatgggtgtgtaatgccgtggcgcaaaagctgctgtcggcgcaattcgggccgcaacagattctgctgttgatttatgcggcaagtgccgccgtgttcctgccgtttgccgaaccggcacacatcggaagtatggacggtacgttggcgtgggtatgtattgcgtattgctgcttgaatacgttaatcggttacggctcgttcggcgaggcgttgaaacattgggaggcttccaaagtcagcgcggtaacaaccttgctccccgtgtttaccgtaataaatactttgctcgggcattatgtgatgcctgaaacttttgccgcgccgga

SEQ ID NO: 400 - protein, 277 aa, Neisseria meningitidis
  misc_feature (25)..(25): Xaa= any amino acid
  misc_feature (157)..(157): Xaa= any amino acid
MENQRPLLGFRLALLAAMTWGTLPXSVRQVLKFVDAPTLVWVRFTVAAAVLFVLLALGGRLPKRRDFSWCSFRLLLLGVAGISANFVLIAQGLHYISPTTTQVLWQISPFTMIVVGVLVFKDRMTAAQKIGLVLLLAGLLMYFNDKFGELSGLGAYXKGVLLCAAGSMAWVCNAVAQKLLSAQFGPQQILLLIYAASAAVFLPFAEPAHIGSMDGTLAWVCIAYCCLNTLIGYGSFGEALKHWEASKVSAVTTLLPVFTVINTLLGHYVMPETFAAP

SEQ ID NO: 401 - DNA, 833 bp, Neisseria meningitidis
atggaaaaccaaaggccgctcctaggcttcgcgttggcacttttggcggcgatgacgtggggaacgctgccgattgccgtgcggcaggtattgaagtttgtcgatgcgccgacgctggtgtgggtgcgttttaccgtggcggcggcggtattgtttgttttgctggcactgggcgggcggctgccgaagcggcgggatttttcttggtgctcattcaggctgctgctgctcggcgtggcgggcatttcggcaaactttgtgctgattgcccaagggctgcattatatttcgccgaccacgacgcaggttttgtggcagatttcgccgtttacgatgattgttgtcggtgtgttggtgtttaaagaccggatgactgccgctcagaaaatcggcttggttttgctgcttgccggtttgcttatgttttttaacgataaattcggcgagttgtcgggtttgggcgcgtatgcgaagggcgtgttgctgtgtgcggcaggcagtatggcatgggtgtgttatgccgtggcgcaaaagctgctgtcggcgcaattcgggccgcaacagattctgctgttgatttatgcggcaagtgccgccgtgttcctgccgtttgccgaaccggcacacatcggaagtttggacggtacgttggcgtgggtttgttttgcgtattgctgcttgaatacgttaatcggttacggctcgttcggcgaggcgttgaaacattgggaggcttccaaagtcagcgcggtaacaaccttgctccccgtgtttaccgtaatawtwwctttgctcgggcattatgtgatgcctgaaacttttgccgcgccgga

SEQ ID NO: 402 - protein, 277 aa, Neisseria meningitidis
  misc_feature (262)..(263): Xaa= any amino acid
MENQRPLLGFALALLAAMTWGTLPIAVRQVLKFVDAPTLVWVRFTVAAAVLFVLLALGGRLPKRRDFSWCSFRLLLLGVAGISANFVLIAQGLHYISPTTTQVLWQISPFTMIVVGVLVFKDRMTAAQKIGLVLLLAGLLMFFNDKFGELSGLGAYAKGVLLCAAGSMAWVCYAVAQKLLSAQFGPQQILLLIYAASAAVFLPFAEPAHIGSLDGTLAWVCFAYCCLNTLIGYGSFGEALKHWEASKVSAVTTLLPVFTVIXXLLGHYVMPETFAAP

SEQ ID NO: 403 - DNA, 924 bp, Neisseria meningitidis
atggaaaaccaaaggccgctcctaggcttcgcgttggcacttttggcggcgatgacgtggggaacgctgccgattgccgtgcggcaggtattgaagtttgtcgatgcgccgacgctggtgtgggtgcgttttaccgtggcggcggcggtattgtttgttttgctggcattgggcgggcggctgccgaagtggcgggatttttcttggtgctcattcaggctgctgctgctcggcgtggcgggcatttcggcaaactttgtgctgattgcccaagggctgcattatatttcgccgaccacgacgcaggttttgtggcagatttcgccgtttacgatgattgttgtcggtgtgttggtgtttaaagaccggatgactgccgctcagaaaatcggcttggttttgctgcttgccggtttgcttatgttttttaacgataaattcggcgagttgtcgggtttgggcgcgtatgcgaagggcgtgttgctgtgtgcggcaggcagtatggcatgggtgtgttatgccgtggcgcaaaagctgctgtcggcgcaattcgggccgcaacagattctgctgttgatttatgcggcaagtgccgccgtgttcctgccgtttgccgaactggcacacatcggaagtttggacggtacgttggcgtgggtttgttttgcgtattgctgcttgaatacgttaatcggttacggctcgttcggcgaggcgttgaaacattgggaggcttccaaagtcagcgcggtaacaaccttgctccccgtgtttaccgtaatattttctttgctcgggcattatgtgatgcctgatacttttgccgcgccggatatgaacggtttgggttatgccggcgcactggtcgtggtcgggggtgcggttacggcggcggtgggggacaggctgttcaaacgccgctag

SEQ ID NO: 404 - protein, 307 aa, Neisseria meningitidis
MENQRPLLGFALALLAAMTWGTLPIAVRQVLKFVDAPTLVWVRFTVAAAVLFVLLALGGRLPKWRDFSWCSFRLLLLGVAGISANFVLIAQGLHYISPTTTQVLWQISPFTMIVVGVLVFKDRMTAAQKIGLVLLLAGLLMFFNDKFGELSGLGAYAKGVLLCAAGSMAWVCYAVAQKLLSAQFGPQQILLLIYAASAAVFLPFAELAHIGSLDGTLAWVCFAYCCLNTLIGYGSFGEALKHWEASKVSAVTTLLPVFTVIFSLLGHYVMPDTFAAPDMNGLGYAGALVVVGGAVTAAVGDRLFKRR

SEQ ID NO: 405 - DNA, 8 bp, Neisseria gonorrhoeae
  misc_feature (1)..(8): N= Unknown
nnnnnnnn

SEQ ID NO: 406 - protein, 307 aa, Neisseria gonorrhoeae
  misc_feature (204)..(204): Xaa= any amino acid
MENQRPLLGFALALLAAMTWGTLPIAVRQVLKFVDAPTLVWVRFTVAAAVLFVLLALGGRLPKRRDFSWHSFRLLLLGVTGISANFVLIAQGLHYISPTTTQVLWQISPFTMIVVGVLVFKDRMTAAQKIGLVLLLVGLLMFFNDKFGELSGLGAYAKGVLLCAAGSMAWVCYAVAQKLLSAQFGPQQILLLIYAASAAVFLLXAEPAHIGSLDGTLAWVCFVYCCLNTLIGYGSFGEALKHWEASKVSAVTTLLPVFTVIFSLLGHYVMPDTFAAPDMNGLGYVGALVVVGGAVTAAVGDRPFKRR

SEQ ID NO: 407 - DNA, 924 bp, Neisseria gonorrhoeae
atggaaaaccaaaggccgctcctaggcttcgcgttggcacttttggcggcgatgacgtgggggacgctgccgattgccgtgcggcaggtattgaagtttgtcgatgcgccgacgctggtgtgggtgcgttttaccgtggcggcggcggtattgtttgttttgctggcattgggcgggcggctgccgaagcggcgggatttttcttggcattcattcaggctgctgctgctcggcgtgacgggcatttcggcaaactttgtgctgattgcccaagggctgcattatatttcgccgaccacgacgcaggttttgtggcagatttcgccgtttacgatgattgttgtcggcgtgttggtgtttaaagaccggatgactgccgcgcagaaaatcggtttggttttgctgcttgtcggtttgcttatgttttttaacgacaaattcggcgagttgtcgggtttgggcgcgtatgcgaagggcgtgttgctgtgtgcggcaggcagtatggcctgggtgtgttatgccgtggcgcaaaagctgctgtcggcgcaattcgggccgcaacagattctgctgttgatttatgcggcaagtgccgccgtgttcctgccgtttgccgaaccggcacacatcggaagtttggacggtacgttggcgtgggtttgttttgtgtattgctgcttgaatacgttaatcggttacggctcgttcggcgaggcgttgaaacattgggaggcttccaaagtcagcgcggtaacaaccttgctccccgtgtttaccgtaatattttctttgctcgggcattatgtgatgcctgatacttttgccgcgccggatatgaacggtttgggttatgtcggcgcactggtcgtggtcgggggtgcggttacggcggcggtgggggacaggccgttcaaacgccgctag

SEQ ID NO: 408 - protein, 307 aa, Neisseria gonorrhoeae
MENQRPLLGFALALLAAMTWGTLPIAVRQVLKFVDAPTLVWVRFTVAAAVLFVLLALGGRLPKRRDFSWHSFRLLLLGVTGISANFVLIAQGLHYISPTTTQVLWQISPFTMIVVGVLVFKDRMTAAQKIGLVLLLVGLLMFFNDKFGELSGLGAYAKGVLLCAAGSMAWVCYAVAQKLLSAQFGPQQILLLIYAASAAVFLPFAEPAHIGSLDGTLAWVCFVYCCLNTLIGYGSFGEALKHWEASKVSAVTTLLPVFTVIFSLLGHYVMPDTFAAPDMNGLGYVGALVVVGGAVTAAVGDRPFKRR

SEQ ID NO: 409 - DNA, 933 bp, Neisseria meningitidis
atggtagctcgtcgggctcataacccgaaggtcgtaggttcgaatcctgtcccgcaacctaatttcaaacccctcggttcaatgccgaggggttttgttttgcctgtttcctgtttcctgtttcctgccgcctccgttttttgccggattttccttccggccgcaatatcggaacggcagaccgccgtctgtttgcggttgcaaattcaggcagtttggctacaatcttccgcattgtcttcaagaaagccaaccatgccgaccgtccgttttaccgaatccgtcagcaaacaagaccttgatgctctgttcgagtgggcaaaagcaagttacggtgcagaaagttgctggaaaacgctgtatctgaacggtcyscctttgggcaacctgtcgccggaatgggtggaacgcgtsmmaaaagactgggaggcaggctgcycggagtcttcagacggcatttttctgaatgcggacggctggcctgatatgggcggacgcttacagcacctcgccctcggttggcactgtgcggggctgttggacggstggcgcaacgagtgtttcgacctgaccgacggcggcggcaaccccttgttcacgctcgaacgcgccgytttmcgtcctktcggactgctcagccgcgccgtccatctcaacggtctgaccgaatcggacggccgatggcatttctggataggcaggcgcagtccgcacaaagcagtcgatcccaacaaactcgacaatactrccgccggcggtgtttccggcggcgaaatgccgtctgaagccgtgtgtcgcgaaagcagcgaagaagccggtttggataaaacgctgcttccgctcatccgcccggtatcgcagctgcacagcctgcgctccgtcagccggggtgtacacaatgaaatcctgtatgtattcgatgccgtcctgccg

SEQ ID NO: 410 - protein, 312 aa, Neisseria meningitidis
  misc_feature (17)..(17): Xaa= any amino acid
  misc_feature (21)..(21): Xaa= any amino acid
  misc_feature (31)..(31): Xaa= any amino acid
  misc_feature (34)..(34): Xaa= any amino acid
  misc_feature (126)..(126): Xaa= any amino acid
  misc_feature (140)..(140): Xaa= any amino acid
  misc_feature (148)..(148): Xaa= any amino acid
  misc_feature (206)..(207): Xaa= any amino acid
  misc_feature (210)..(210): Xaa= any amino acid
  misc_feature (251)..(251): Xaa= any amino acid
MVARRAHNPKVVGSNPXPATXFQTPRFNAEXVLXLPVSCFLFPAASVFCRIFLPAAISERQTAVCLRLQIQAVWLQSSALSSRKPTMPTVRFTESVSKQDLDALFEWAKASYGAESCWKTLYLNGXPLGNLSPEWVERVXKDWEAGCXESSDGIFLNADGWPDMGGRLQHLALGWHCAGLLDGWRNECFDLTDGGGNPLFTLERAXXRPXGLLSRAVHLNGLTESDGRWHFWIGRRSPHKAVDPNKLDNTXAGGVSGGEMPSEAVCRESSEEAGLDKTLLPLIRPVSQLHSLRSVSRGVHNEILYVFDAVLP

SEQ ID NO: 411 - DNA, 876 bp, Neisseria meningitidis
atgccgaccgtccgttttaccgaatccgtcagcaaacaagaccttgatgctctgttcgagtgggcaaaagcaagttacggtgcagaaagttgctggaaaacgctgtatctgaacggtctgcctttgggcaacctgtcgccggaatgggtggaacgcgtcaaaaaagactgggaggcaggctgctcggagtcttcagacggcatttttctgaatgcggacggctggcctgatatgggcggacgcttacagcacctcgccctcggttggcactgtgcggggctgttggacggctggcgcaacgagtgtttcgacctgaccgacggcggcggcaaccccttgttcacgctcgaacgcgccgctttccgtcctttcggactgctcagccgcgccgtccatctcaacggtctgaccgaatcggacggccgatggcatttctggataggcaggcgcagtccgcacaaagcagtcgatcccaacaaactcgacaatactgccgccggcggtgtttccggcggcgaaatgccgtctgaagccgtgtgtcgcgaaagcagcgaagaagccggtttggataaaacgctgcttccgctcatccgcccggtatcgcagctgcacagcctgcgctccgtcagccggggtgtacacaatgaaatcctgtatgtattcgatgccgtcctgcccgaaaccttcctgcctgaaaatcaggatggcgaagtggcgggttttgagaaaatggacatcggcggtctgttggatgccatgttgtcgggaaacatgatgcacgacgcgcaactggttacgctggacgcgttttgccgttacggtctgattgatgccgcccatccgctgtccgagtggctggacggcatacgtttatag

SEQ ID NO: 412 - protein, 291 aa, Neisseria meningitidis
MPTVRFTESVSKQDLDALFEWAKASYGAESCWKTLYLNGLPLGNLSPEWVERVKKDWEAGCSESSDGIFLNADGWPDMGGRLQHLALGWHCAGLLDGWRNECFDLTDGGGNPLFTLERAAFRPFGLLSRAVHLNGLTESDGRWHFWIGRRSPHKAVDPNKLDNTAAGGVSGGEMPSEAVCRESSEEAGLDKTLLPLIRPVSQLHSLRSVSRGVHNEILYVFDAVLPETFLPENQDGEVAGFEKMDIGGLLDAMLSGNMMHDAQLVTLDAFCRYGLIDAAHPLSEWLDGIRL

SEQ ID NO: 413 - DNA, 876 bp, Neisseria meningitidis
atgccgaccgtccgttttaccgaatccgtcagcaaacacgaccttgatgccctattcgagtgggcaaaggcaagttacggtgcggaaagttgctggaaaacgctgtatctgaacggtctgcctttgggcaatctgtcgccggaatgggcggagcgcgtcaaaaaagactgggaggcaggctgctcggagtcttcagacggcattttcctgaatgcggacggctggccagatatgggcagacgcttgcagcacctcgcccgaatatggaaagaagcgggactgcttcacggctggcgcgacgagtgtttcgacctgaccgacggcggcagcaatcccttgttcgcgctcgaacgcgccgctttccgtccgttcggactgctcagccgcgccgtccatctcaacggtttggtcgaatcggacggccgatggcatttctggataggcaggcgcagtccgcacaaagcagtcgatcccgacaaactcgacaatactgccgccggcggtgtttccagcggtgaattgccgtctgaaaccgtgtgtcgcgaaagcagcgaagaagccggtttggataaaacgctgcttccgctcatccgcccggtatcgcagctgcacagcctgcgccccgtcagccggggtgtgcacaatgaaatcctgtatgtattcgatgccgtcctgcccgaaaccttcctgcctgaaaatcaggatggcgaagtggcgggttttgagaaaatggacatcggcggtctgttggctgccatgttgtcgggaaacatgatgcacgacgcgcaactggttacgctggacgcgttttgccgttacggtctgattgatgccgcccatccgctgtccgagtggctggacggcatacgtttatag

SEQ ID NO: 414 - protein, 291 aa, Neisseria meningitidis
MPTVRFTESVSKHDLDALFEWAKASYGAESCWKTLYLNGLPLGNLSPEWAERVKKDWEAGCSESSDGIFLNADGWPDMGRRLQHLARIWKEAGLLHGWRDECFDLTDGGSNPLFALERAAFRPFGLLSRAVHLNGLVESDGRWHFWIGRRSPHKAVDPDKLDNTAAGGVSSGELPSETVCRESSEEAGLDKTLLPLIRPVSQLHSLRPVSRGVHNEILYVFDAVLPETFLPENQDGEVAGFEKMDIGGLLAAMLSGNMMHDAQLVTLDAFCRYGLIDAAHPLSEWLDGIRL

SEQ ID NO: 415 - DNA, 8 bp, Neillia sinensis
  misc_feature (1)..(8): N= Unknown
nnnnnnnn

SEQ ID NO: 416 - protein, 372 aa, Neisseria gonorrhoeae
MVARRAHNPKVVGSNPAPATKYQTPRFNAEGVLFFLFPAASVFCRIFLPAAISERQAAVCLRLQIQAVWLQSSALCSRKPAMPTVRFTESVSKQDLDALFERAKASYGAESCWKTLYLNRLPLGNLSPEWAERIKKDWEAGCSESSNGIFLNADGWPDMGGRLQHLARTWNKAGLLHGWRNECFDLTDGGGNPLFTLERAAFRPFGLLIRAVHLNGLVESNGRWHFWIGRRSPHKAVDPGKLDNIAGGGVSGGEMPSEAVCRESSEEAGLDKTLFPLIRPVSRLHSLRPVSRGVHNEILYVFDAVLPETFLPENQDGEVAGFEKMDIGGLLDAMLSKNMMHDAQLVTLDAFYRYGLIDAAHPLSEWLDGIRL

SEQ ID NO: 417 - DNA, 876 bp, Neisseria gonorrhoeae
atgccgaccgtccgttttaccgaatccgtcagcaaacaagaccttgatgccctgttcgagcgggcaaaagcaagttacggtgccgaaagttgctggaaaacgctgtatctgaaccgtcttcctttgggcaatctgtcgccggaatgggctgagcgcatcaaaaaagactgggaggcaggctgctccgagtcttcagacggcatttttctgaatgcggacggctggccggatatgggcggacgcttgcagcacctcgcccgcacatggaacaaggcggggctgcttcacggatggcgcaacgagtgtttcgacctgaccgacggcggcggcaaccccttgttcacgctcgaacgcgccgctttccgtccgttcggactactcagccgcgccgtccatctcaacggtttggtcgaatcgaacggcagatggcatttttggataggcaggcgcagtccgcacaaagcagtcgatcccggcaagctcgacaatattgccggcggcggtgtttccggcggcgaaatgccgtctgaagccgtgtgccgcgaaagcagcgaagaagccggtttggataaaacgctgtttccgctcatccgcccagtatcgcggctgcacagccttcgccccgtcagccgaggtgtgcacaatgaaatcctgtatgtgttcgatgccgtcctgcccgaaaccttcctgcctgaaaatcaggatggcgaggtagcgggttttgaaaagatggacattggcggcctattggatgccatgttgtcgaaaaacatgatgcacgacgcgcaactggttacgctggacgcgttttaccgttacggtctgattgatgccgcccatccgctgtccgagtggctggacggcatacgtttatag

SEQ ID NO: 418 - protein, 291 aa, Neisseria gonorrhoeae
MPTVRFTESVSKQDLDALFERAKASYGAESCWKTLYLNRLPLGNLSPEWAERIKKDWEAGCSESSDGIFLNADGWPDMGGRLQHLARTWNKAGLLHGWRNECFDLTDGGGNPLFTLERAAFRPFGLLSRAVHLNGLVESNGRWHFWIGRRSPHKAVDPGKLDNIAGGGVSGGEMPSEAVCRESSEEAGLDKTLFPLIRPVSRLHSLRPVSRGVHNEILYVFDAVLPETFLPENQDGEVAGFEKMDIGGLLDAMLSKNMMHDAQLVTLDAFYRYGLIDAAHPLSEWLDGIRL

SEQ ID NO: 419 - DNA, 566 bp, Neisseria meningitidis
atgaatagacccaagcaacccttcttccgtcccgaagtcgccgttgcccgccaaaccagcctgacgggtaaagtgattctgacacgaccgttgtcattttccctatggacgacatttgcatcgatatctgcgttattgattatcctgtttttgatatttggtaactatacgcgaaagacaacagtggagggacaaattttacctgcatcgggcgtaatcagggtgtatgcaccggatacgrgkacaattacagcgaaattcgtggaagatggmsaaaaggttaaggctggcgacaagctatttgcgctttcgacctcacgtttcggcgcaggaggtagcgtgcagcagcagttgaaaacggaggcagttttgaagaaaacgttggcagaacaggaactgggtcgtctgaagctgatacacgggaatgaaacgcgcagccttaaagcaactgtcgaacgtttggaaaaccaggaactccatatttcgcaacagatagacggtcagaaaaggcgcattagacttgcggaagaaatgttgcagaaatatcgtttcctatccgccaatga

SEQ ID NO: 420 - protein, 188 aa, Neisseria meningitidis
  misc_feature (81)..(81): Xaa= any amino acid
  misc_feature (92)..(92): Xaa= any amino acid
  misc_feature (187)..(187): Xaa= any amino acid
MNRPKQPFFRPEVAVARQTSLTGKVILTRPLSFSLWTTFASISALLIILFLIFGNYTRKTTVEGQILPASGVIRVYAPDTXTITAKFVEDGXKVKAGDKLFALSTSRFGAGGSVQQQLKTEAVLKKTLAEQELGRLKLIHGNETRSLKATVERLENQELHISQQIDGQKRRIRLAEEMLQKYRFLSXQ

SEQ ID NO: 421 - DNA, 717 bp, Neisseria meningitidis
  misc_feature (21)..(21): N= Unknown
  misc_feature (252)..(252): N= Unknown
  misc_feature (262)..(262): N= Unknown
  misc_feature (695)..(696): N= Unknown
atgaatagacccaagcaaccnttcttccgtcccgaagtcgccgttgcccgccaaaccagcctgacgggtaaagtgattctgacacgaccgttgtcattttccctatggacgacatttgcatcgatatctgcgttattgattatcctgtttttgatatttggtaactatacgcgaaagacaacagtggagggacaaattttacctgcatcgggcgtaatcagggtgtatgcaccggatacggggacaattacngcgaaattcntggaagatggagaaaaggttaaggctggcgacaagctatttgcgctttcgacctcacgtttcggcgcaggagatagcgtgcagcagcagttgaaaacggaggcagttttgaagaaaacgttggcagaacaggaactgggtcgtctgaagctgatacacgggaatgaaacgcgcagccttaaagcaactgtcgaacgtttggaaaaccaggaactccatatttcgcaacagatagacggtcagaaaaggcgcattagacttgcggaagaaatgttgcagaaatatcgtttcctatccgccaatgatgcagtgccaaaacaagaaatgatgaatgtcaaggcagagcttttagagcagaaagccaaacttgatgcctaccgccgagaagaagtcgggctgcttcaggaaatccgcacgcagaatctgacattggnnagcctcccccaagcggcatga

SEQ ID NO: 422 - protein, 238 aa, Neisseria meningitidis
  misc_feature (88)..(88): Xaa= any amino acid
  misc_feature (232)..(232): Xaa= any amino acid
MNRPKQPFFRPEVAVARQTSLTGKVILTRPLSFSLWTTFASISALLIILFLIFGNYTRKTTVEGQILPASGVIRVYAPDTGTITAKFXEDGEKVKAGDKLFALSTSRFGAGDSVQQQLKTEAVLKKTLAEQELGRLKLIHGNETRSLKATVERLENQELHISQQIDGQKRRIRLAEEMLQKYRFLSANDAVPKQEMMNVKAELLEQKAKLDAYRREEVGLLQEIRTQNLTLXSLPQAA

SEQ ID NO: 423 - DNA, 8 bp, Neisseria gonorrhoeae
  misc_feature (1)..(8): N= Unknown
nnnnnnnn

SEQ ID NO: 424 - protein, 188 aa, Neisseria gonorrhoeae
MNRPKQPFFRPEVAIARQTSLTGKVILTRPLSFSLWTTFASISALLIILFLIFGNYTRKTTMEGQILPASGVIRVYAPDTGTITAKFVEDGEKVKAGDKLFALSTSRFGAGGSVQQQLKTEAVLKKTLAEQELGRLKLIHENETRSLKATVERLENQKLHISQQIDGQKRRIRLAEEMLRKYRFLSAQ

SEQ ID NO: 425 - DNA, 545 bp, Neisseria meningitidis
atgctgaatactttttttgccgtattgggcggctgcctgctgctttgccgtgcggcaaatccgtaaatacggcggtacagccgcaaaacgcggtacaaagcgcgccgaaaccggttttcaaagtcatatatatcgacaatacggcgattgccggtttggatttgggacaaagcagcgaaggcaaaaccaacgacggcaaaaaacaaatcagttatccgattaaaggcttgccggaacaaaatgttatccgactgatcggcaagcatcccggcgacttggaagccgtcagcggcaaatgtatggaaaccgatgataaggacagtccggcaggttgggcagaaaacggcgtgtgccataccttgtttgccaaactggtgggcaatatcgccgaagacggcggcaaactgacggattacctagtttcgcatgccgccctgcaaccctatcaggcaggcaaaagcggctatgccgccgtgcagaacggacgctatgtgctggaaatcgacagcgaaggggcgttttatttccgccgccgccattattga

SEQ ID NO: 426 - protein, 181 aa, Neisseria meningitidis
  misc_feature (15)..(15): Xaa= any amino acid
MLNTFFAVLGGCLLXLPCGKSVNTAVQPQNAVQSAPKPVFKVIYIDNTAIAGLDLGQSSEGKTNDGKKQISYPIKGLPEQNVIRLIGKHPGDLEAVSGKCMETDDKDSPAGWAENGVCHTLFAKLVGNIAEDGGKLTDYLVSHAALQPYQAGKSGYAAVQNGRYVLEIDSEGAFYFRRRHY

SEQ ID NO: 427 - DNA, 546 bp, Neisseria meningitidis
atgctgaaaacatcttttgccgtattgggcggctgcctgctgcttgccgcctgcggcaaatccgaaaatacggcggaacagccgcaaaacgcggtacaaagcgcgccgaaaccggttttcaaagtcaaatatatcgacaatacggcgattgccggtttggatttgggacaaagcagcgaaggcaaaaccaacgacggcaaaaaacaaatcagttatccgattaaaggcttgccggaacaaaatgttatccgactgatcggcaagcatcccggcgacttggaagccgtcagcggcaaatgtatggaaaccgatgataaggacagtccggcaggttgggcagaaaacggcgtgtgccataccttgtttgccaaactggtgggcaatatcgccgaagacggcggcaaactgacggattacctagtttcgcatgccgccctgcaaccctatcaggcaggcaaaagcggctatgccgccgtgcagaacggacgctatgtgctggaaatcgacagcgaaggggcgttttatttccgccgccgccattattga

SEQ ID NO: 428 - protein, 181 aa, Neisseria meningitidis
MLKTSFAVLGGCLLLAACGKSENTAEQPQNAVQSAPKPVFKVKYIDNTAIAGLDLGQSSEGKTNDGKKQISYPIKGLPEQNVIRLIGKHPGDLEAVSGKCMETDDKDSPAGWAENGVCHTLFAKLVGNIAEDGGKLTDYLVSHAALQPYQAGKSGYAAVQNGRYVLEIDSEGAFYFRRRHY

SEQ ID NO: 429 - DNA, 546 bp, Neisseria gonorrhoeae
atgctgaaaataccttttgccgtgttgggcggctgcctgctgcttgccgcctgcggcaaatccgaaaatacggcggaacagccgcaaaatgcggcacaaagcgcgccgaaaccggttttcaaagtcaaatacatcgacaatacggcgattgccggtttggctttgggacaaagtagcgaaggcaaaaccaacgacggcaaaaaacaaatcagttatccgattaaaggcttgccggaacaaaacgccgtccggctgaccggaaagcatcccaacgacttggaagccgtcgtcggcaaatgtatggaaaccgacggaaaggacgcgccttcgggctgggcggaaaacggcgtgtgccataccttgtttgccaaactggtgggcaatatcgccgaagacggcggcaaactgactgattacctgatttcgcattccgccctgcaaccctatcaggcaggcaaaagcggctatgccgccgtgcagaacggacgctatgtgctggaaatcgacagcgagggggcgttttatttccgccgccgccattattga

SEQ ID NO: 430 - protein, 181 aa, Neisseria gonorrhoeae
MLKIPFAVLGGCLLLAACGKSENTAEQPQNAAQSAPKPVFKVKYIDNTAIAGLALGQSSEGKTNDGKKQISYPIKGLPEQNAVRLTGKHPNDLEAVVGKCMETDGKDAPSGWAENGVCHTLFAKLVGNIAEDGGKLTDYLISHSALQPYQAGKSGYAAVQNGRYVLEIDSEGAFYFRRRHY

SEQ ID NO: 431 - DNA, 695 bp, Neisseria meningitidis
atggaagatttatatataatactcgctttgggtttggttgcgatgattgccggatttatcgatgcgattgcgggcgggggtggtttgattacgctgcccgcactcttgttggcaggtattcctcccgtgtcggcaattgccaccaacaagctgcaagcagccgctgctacgttttcagctacggtttcttttgcacgcaaaggtttgattgattggaagaaaggtctcccgattgccgcagcatcgtttgtaggcggcgtggccggtgcattatcggtcagcttggtttccaaagatattctgctggcggtcgtgccggttttgttgatatttgtcgcactgtattttgtgttttcgcccaagctcgacggcagtaaggaaggcaaagccagaatgtctttttttctgttcgggctgacggtcgcaccgcttttgggtttttacgacggtgtgttcggaccgggtgtcggctcgttttttctgattgcctttattgttttgctcggctgcaagctgttgaacgcgatgtcttacaccaaattggcgaacgttgcctgcaatcttggttcgctatcggtattcctgctgcacggttcgattattttcccgattgcggcaacgatggcggtcggtgcgtttgtcggtgcgaatttaggtgcgagatttgccgtacgcttcggttcgaagctgattaa

SEQ ID NO: 432 - protein, 231 aa, Neisseria meningitidis
  misc_feature (142)..(142): Xaa= any amino acid
MEDLYIILALGLVAMIAGFIDAIAGGGGLITLPALLLAGIPPVSAIATNKLQAAAATFSATVSFARKGLIDWKKGLPIAAASFVGGVAGALSVSLVSKDILLAVVPVLLIFVALYFVFSPKLDGSKEGKARMSFFLFGLTVXTAFGFLRRCVRTGCRLVFSDCLYCFARLQAVERDVLHQIGERCLQSWFAIGIPAARFDYFPDCGNDGGRCVCRCEFRCEICRTLRFEAD

SEQ ID NO: 433 - DNA, 789 bp, Neisseria meningitidis
atggaagatttatatataatactcgctttgggtttggttgcgatgattgccggatttatcgatgcgattgcgggcgggggtggtttgattacgctgcccgcactcttgttggcaggtattcctcccgtgtcggcaattgccaccaacaagctgcaagcagccgctgctacgttttcagctacggtttcttttgcacgcaaaggtttgattgattggaagaaaggtctcccgattgccgcagcatcgtttgtaggcggcgtggccggtgcattatcggtcagcttggtttccaaagatattctgctggcggtcgtgccggttttgttgatatttgtcgcactgtattttgtgttttcgcccaagctcgacggcagtaaggaaggcaaagccagaatgtctttttttctgttcgggctgacggtcgcaccgcttttgggtttttacgacggtgtgttcggaccgggtgtcggctcgttttttctgattgcctttattgttttgctcggctgcaagctgttgaacgcgatgtcttacaccaaattggcgaacgttgcctgcaatcttggttcgctatcggtattcctgctgcacggttcgattattttcccgattgcggcaacgatggcggtcggtgcgtttgtcggtgcgaatttaggtgcgagatttgccgtccgcttcggttcgaagctgattaagccgctgctgattgtcatcagcatttcgatggctgtgaaattgttgatagacgagagaaatccgctgtatcagatgattgtttcgatgttttaa

SEQ ID NO: 434 - protein, 262 aa, Neisseria meningitidis
MEDLYIILALGLVAMIAGFIDAIAGGGGLITLPALLLAGIPPVSAIATNKLQAAAATFSATVSFARKGLIDWKKGLPIAAASFVGGVAGALSVSLVSKDILLAVVPVLLIFVALYFVFSPKLDGSKEGKARMSFFLFGLTVAPLLGFYDGVFGPGVGSFFLIAFIVLLGCKLLNAMSYTKLANVACNLGSLSVFLLHGSIIFPIAATMAVGAFVGANLGARFAVRFGSKLIKPLLIVISISMAVKLLIDERNPLYQMIVSMF

SEQ ID NO: 435 - DNA, 789 bp, Neisseria meningitidis
atggaagatttatacataatactcgctttgggtttggttgcgatgattgccggatttatcgatgcgattgcgggtgggggtggtttgattacgctgcctgcactcttgttggcaggtattcctcccgtgtcggcaattgccaccaacaagctgcaagcagccgctgctacgttttcggctacggtttcttttgcacgcaaaggtttgattgattggaagaaaggtctcccgattgcggcagcatcgtttgcaggcggcgtggtcggtgcattatcggtcagcttggtttccaaagatattctgctggcggtcgtgccggttttgttgatatttgtcgcgctgtattttgtgttttcgcccaagctcgacggcagtaaggaaggcaaagccagaatgtctttttttctgttcggtctgacggttgcaccacttttgggtttttacgacggtgtgttcggaccgggtgtcggctcgttttttctgattgcctttattgttttgctcggctgcaagctgttgaacgcgatgtcttacaccaaattggcgaacgttgcctgcaatcttggttcgctatcggtattcctgctgcacggttcgattattttcccgattgcggcaacgatggcggtcggtgcgtttgtcggtgcgaatttaggtgcgagatttgccgtccgcttcggttcgaagctgattaagccgctgctgattgtcatcagcatttcgatggctgtgaaattgttgatagacgagagaaatccgctgtatcagatgattgtttcgatgttttaa

SEQ ID NO: 436 - protein, 262 aa, Neisseria meningitidis
MEDLYIILALGLVAMIAGFIDAIAGGGGLITLPALLLAGIPPVSAIATNKLQAAAATFSATVSFARKGLIDWKKGLPIAAASFAGGVVGALSVSLVSKDILLAVVPVLLIFVALYFVFSPKLDGSKEGKARMSFFLFGLTVAPLLGFYDGVFGPGVGSFFLIAFIVLLGCKLLNAMSYTKLANVACNLGSLSVFLLHGSIIFPIAATMAVGAFVGANLGARFAVRFGSKLIKPLLIVISISMAVKLLIDERNPLYQMIVSMF

SEQ ID NO: 437 - DNA, 8 bp, Neisseria gonorrhoeae
  misc_feature (1)..(8): N= Unknown
nnnnnnnn

SEQ ID NO: 438 - protein, 231 aa, Neisseria gonorrhoeae
MEDLYIILALGLVAMIAGFIDAIAGGGGLITLPALLLAGIPPVSAIATNKLQAAAATFSATVSFARKGLIDWKKGLPIAAASFAGGVVGALSVSLVSKDILLAVVPVLLIFVALYFVFSPKLDGSKEGKARMSFFLFGLTVATAFGFLRRCVRTGCRLVFSDCLYCFARLQAVERDVLHQIGERCLQSWFAIGIPAARFDYFPDCGNDGGRCVCRCEFRCEICRPLRFEAD

SEQ ID NO: 439 - DNA, 789 bp, Neisseria gonorrhoeae
atggaagatttatacataatactcgctttgggtttggttgcgatgatcgccggatttatcgatgcgattgcgggcgggggtggtttgattacgctgcctgcactcttgttggcaggtattcctcccgtgtcggcaattgccaccaacaagctgcaagcagccgctgctacgttttcggctacggtttcttttgcacgcaaaggtttgattgattggaagaaaggtctcccgattgccgcagcatcgtttgcaggcggcgtggtcggtgcattatcggtcagcttggtttccaaagatattttgctggcggtcgtgccggttttgttgatatttgtcgcgctgtattttgtgttttcgcccaagctcgacggcagtaaggaaggcaaagccagaatgtctttttttctattcgggctgacggttgcaccgcttttgggtttttacgacggtgtgttcggaccgggtgtcggctcgttttttctgattgcctttattgttttgctcggctgcaagctgttgaacgcgatgtcttacaccaaattggcgaacgttgcttgcaatcttggttcgctatcggtattcctgctgcacggttcgattattttcccgattgtggcaacgatggcggtcggtgcgtttgtcggtgcgaatttaggtgcgagatttgccgtccgcttcggttcgaagctgattaagccgctgctgattgtcatcagcatttcgatggctgtgaaattgttgatagacgagagaaatccgctgtatcagatgattgtttcgatgttttaa

SEQ ID NO: 440 - protein, 262 aa, Neisseria gonorrhoeae
MEDLYIILALGLVAMIAGFIDAIAGGGGLITLPALLLAGIPPVSAIATNKLQAAAATFSATVSFARKGLIDWKKGLPIAAASFAGGVVGALSVSLVSKDILLAVVPVLLIFVALYFVFSPKLDGSKEGKARMSFFLFGLTVAPLLGFYDGVFGPGVGSFFLIAFIVLLGCKLLNAMSYTKLANVACNLGSLSVFLLHGSIIFPIVATMAVGAFVGANLGARFAVRFGSKLIKPLLIVISISMAVKLLIDERNPLYQMIVSMF

SEQ ID NO: 441 - DNA, 635 bp, Neisseria meningitidis
ctgctagggtattgcatcggttatcggtacggctgttgcagcaaaaccagccgcagacggattatttggtcaaattcggatcgttttgggcgagatttttggttttctgggactgtatgacgtctatgcttcggcatggtttgtcgttatcatgatgtttttggtggtttctaccagtttgtgcctgattcgcaatgtgccgccgttctggcgcgaaatgaagtcttttcgggaaaaggttaaagaaaaatctctggcggcgatgcgccattcttcgctgttggatgtaaaaattgcgcccgaggttgccaaacgttatctggaagtacaaggttttcaggggaaaaccattaaccgtgaagacgggtcggttctgattgccgccaaaaaaggcacaatgaacaaatggggctatatctttgcccatgttgctttgattgtcatttgcctgggcgggttgatagacagtaacctgctgttgaaactgggtatgctgaccggtcggattgttccggacaatcaggcggtttatgccaaggatttcaagcccgaaagtattttgggtgcgtccaatctctcatttaggggcaacgtcaatatttccgaggggcagagtgcggatgtggttttcctga

SEQ ID NO: 442 - protein, 210 aa, Neisseria meningitidis
  misc_feature (31)..(31): Xaa= any amino acid
  misc_feature (181)..(181): Xaa= any amino acid
  misc_feature (186)..(186): Xaa= any amino acid
  misc_feature (201)..(201): Xaa= any amino acid
LLGIASVIGTLLQQNQPQTDYLVKFGSFWAXIFGFLGLYDVYASAWFVVIMMFLVVSTSLCLIRNVPPFWREMKSFREKVKEKSLAAMRHSSLLDVKIAPEVAKRYLEVQGFQGKTINREDGSVLIAAKKGTMNKWGYIFAHVALIVICLGGLIDSNLLLKLGMLTGRIFRTIRRFMPRIXKPESXFGCVQSLIGQRQYFXRGRVRMWFS

SEQ ID NO: 443 - DNA, 8 bp, Neisseria gonorrhoeae
  misc_feature (1)..(8): N= Unknown
nnnnnnnn

SEQ ID NO: 444 - protein, 241 aa, Neisseria meningitidis
  misc_feature (170)..(170): Xaa= any amino acid
  misc_feature (186)..(186): Xaa= any amino acid
MSKSRISPTLLSRPWFAFFSSMRFAVALLSLLGIASVIGTVLQQNQPQTDYLVKFGPFWTRIFDFLGLYDVYASAWFVVIMMFLVVSTSLCLIRNVPPFWREMKSFREKVKEKSLAAMRHSSLLDVKIAPEVAKRYLEVRGFQGKTVSREDGSVLIAAKKGTMNKWGYIXAHVALIVICLGRLINXNLLLKLGMLAGSIFRNNRRVMPRISKPESIWGGVQSLIKGQRQYFQRGKVRMWFS

SEQ ID NO: 445 - DNA, 1056 bp, Neisseria meningitidis
atgccgtctgaaacacgcctgccgaactttatccgcgtcttgatatttgccctgggtttcatcttcctgaacgcctgttcggaacaaaccgcgcaaaccgttaccctgcaaggcgaaacgatgggcacgacctataccgtcaaatacctttcaaataatcgggacaaactcccctcacctgccgaaatacaaaaacgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccgcctgaaccgcctgacacacggcgcgctggacgtaaccgtcggccccttggtcaacctttggggattcggccccgacaaatccgttacccgtgaaccgtcgccggaacaaatcaaacaggcggcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccgtggcgcatcggtatcgagcagcccaatatcgtccaaggcggcaatacgcagattatcgtcccgctgaacaaccgttcgcttgccacttccggcgattaccgtattttccacgtcgataaaaacggcaaacgcctctcccatatcatcaacccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 446 - protein, 351 aa, Neisseria meningitidis
MPSETRLPNFIRVLIFALGFIFLNACSEQTAQTVTLQGETMGTTYTVKYLSNNRDKLPSPAEIQKRIDDALKEVNRQMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 447 - DNA, 1056 bp, Neisseria meningitidis
  misc_feature (166)..(166): N= Unknown
  misc_feature (174)..(174): N= Unknown
  misc_feature (195)..(195): N= Unknown
  misc_feature (586)..(586): N= Unknown
  misc_feature (588)..(588): N= Unknown
  misc_feature (645)..(645): N= Unknown
  misc_feature (662)..(662): N= Unknown
  misc_feature (763)..(763): N= Unknown
  misc_feature (883)..(883): N= Unknown
  misc_feature (915)..(915): N= Unknown
atgccgtctgaaacacgcctgccgaactttatccgcaccttgatatttgccctgagttttatcttcctgaacgcctgttcggaacaaaccgcgcaaaccgttaccctgcaaggtgaaacgatgggcacgacctataccgtcaaatacctttcaaataatcgggacnaactcccntcacctgccgaaatacaaaancgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccacctgaaccgcctgacacacggcgcgctggacgtaaccgtcggccccttggtcaacctttggggattcggccccgacaaatccgttacccgtgaaccgtcgccggaacaaatcaaacaagcagcatcttatacgggcatagacaaaatcattttgaaacaaggcaaagattacgcttccttgagcaaaacccaccccaaggcctatttggatttatcttcgattgccaaaggcttcggcgttgatnangttgcgggcgaactggaaaaatacggcattcaaaattatctggtcgaaatcggcggngagttgcacggcaaagncaaaaacgcgcgcggcgaaccttggcgcatcggcatcgaacagcccaacatcgtccaaggcggcaatacgcagattatcgtcccgctgaacaaccgttcgnttgccacttccggcgattaccgtattttccacgtcgataaaagcggcaaacgcctctcccatatcattaatccgaacaacaaacgacccatcagccacaacctcgcctccatcagcgtgntcgcagacagtgcgatgacggcggacggcttntccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 448 - protein, 351 aa, Neisseria meningitidis
  misc_feature (56)..(56): Xaa= any amino acid
  misc_feature (65)..(65): Xaa= any amino acid
  misc_feature (196)..(196): Xaa= any amino acid
  misc_feature (221)..(221): Xaa= any amino acid
  misc_feature (255)..(255): Xaa= any amino acid
  misc_feature (295)..(295): Xaa= any amino acid
  misc_feature (305)..(305): Xaa= any amino acid
MPSETRLPNFIRTLIFALSFIFLNACSEQTAQTVTLQGETMGTTYTVKYLSNNRDXLPSPAEIQXRIDDALKEVNRQMSTYQPDSEISRFNQHTAGKPLRISSDFAHVTAEAVHLNRLTHGALDVTVGPLVNLWGFGPDKSVTREPSPEQIKQAASYTGIDKIILKQGKDYASLSKTHPKAYLDLSSIAKGFGVDXVAGELEKYGIQNYLVEIGGELHGKXKNARGEPWRIGIEQPNIVQGGNTQIIVPLNNRSXATSGDYRIFHVDKSGKRLSHIINPNNKRPISHNLASISVXADSAMTADGXSTGLFVLGETEALKLAEREKLAVFLIVRDKGGYRTAMSSEFEKLLR

SEQ ID NO: 449 - DNA, 1056 bp, Neisseria gonorrhoeae
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggttcaaccaacacacagccggcaagcccctccgcatttcaagcgatttcgcacacgttaccgccgaagccgtccgcctgaaccgcctgactcacggcgcactggacgtaaccgtcggccctttggtcaacctttgggggttcggccccgacaaatccgttacccgtgaaccgtcgccggaacaaatcaaacaggcggcatcttatacgggcatagacaaaatcattttgcaacaaggcaaagattacgcttccttgagcaaaacccaccccaaagcctatttggatttatcttcgattgccaaaggcttcggcgttgataaagttgcgggcgaactggaaaaatacggcattcaaaattatctggtcgaaatcggcggcgagttgcacggcaaaggcaaaaatgcgcacggcgaaccgtggcgcatcggtatagagcaacccaatatcatccaaggcggcaatacgcagattatcgtcccgctgaacaaccgttcgcttgccacttccggcgattaccgtattttccacgtcgataaaaacggcaaacgcctttcccacatcatcaatcccaacaacaaacgacccatcagccacaacctcgcctccatcagcgtggtctcagacagtgcaatgacggcggacggtttatccacaggattatttgttttaggcgaaaccgaagccttaaggctggcagaacaagaaaaactcgctgttttcctaattgtccgggataaggacggctaccgcaccgccatgtcttccgaatttgccaagctgctccgctaa

SEQ ID NO: 450 - protein, 351 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFNQHTAGKPLRISSDFAHVTAEAVRLNRLTHGALDVTVGPLVNLWGFGPDKSVTREPSPEQIKQAASYTGIDKIILQQGKDYASLSKTHPKAYLDLSSIAKGFGVDKVAGELEKYGIQNYLVEIGGELHGKGKNAHGEPWRIGIEQPNIIQGGNTQIIVPLNNRSLATSGDYRIFHVDKNGKRLSHIINPNNKRPISHNLASISVVSDSAMTADGLSTGLFVLGETEALRLAEQEKLAVFLIVRDKDGYRTAMSSEFAKLLR

SEQ ID NO: 451 - DNA, 789 bp, Neisseria meningitidis
ccgtgccgccgacagggcgacgacgtgtatgcggcgcacgcgtcccgtcaaaaattgtggctgcgcttcatcggcggccggtcgcatcaaaatatacggggcggcgcggctgcggacgggtggcgcaaaggcgtgcaaatcggcggcgaggtgtttgtacggcaaaatgaaggcagcckaytggcaatcggcgtgatgggcggcagggccggccagcacgcwtcagtcaacggcaaaggcggtgcggcaggcagtgatttgtatggttatggcgggggtgtttatgctgcgtggcatcagttgcgcgataaacaaacgggtgcgtatttggacggctggttgcaataccaacgtttcaaacaccgcatcaatgatgaaaaccgtgcggaacgctacaaaaccaaaggttggacggcttctgtcgaaggcggctacaacgcgcttgtggcggaaggcattgtcggaaaaggcaataatgtgcggttttacctacaaccgcaggcgcagtttacctacttgggcgtaaacggcggctttaccgacagcgaggggacggcggtcggactgctcggcagcggtcagtggcaaagccgcgccggcattcgggcaaaaacccgttttgctttgcgtaacggtgtcaatcttcagccttttgccgcttttaatgttttgcacaggtcaaaatctttcggcgtggaaatggacggcgaaaaacagacgctggcaggcaggacggcactcgaagggcggttcggtattgaagccggttggaaaggccatatgtccgca

SEQ ID NO: 452 - protein, 263 aa, Neisseria meningitidis
  misc_feature (60)..(60): Xaa= any amino acid
PCRRQGDDVYAAHASRQKLWLRFIGGRSHQNIRGGAAADGWRKGVQIGGEVFVRQNEGSXLAIGVMGGRAGQHASVNGKGGAAGSDLYGYGGGVYAAWHQLRDKQTGAYLDGWLQYQRFKHRINDENRAERYKTKGWTASVEGGYNALVAEGIVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSA

SEQ ID NO: 453 - DNA, 1860 bp, Neisseria meningitidis
atgttcagagctcagcttggttcaaatactcgttctaccaaaatcggcgacgatgccgatttttcattttcagacaagccgaaacccggcacttcccattatttttccagcggtaaaaccgatcaaaattcatccgaatatgggtatgacgaaatcaatatccaaggtaaaaactacaatagcggcatactcgccgtcgataatatgcccgttgttaagaaatatattacagatacttacggggataatttaaaggatgcggttaagaagcaattacaggatttatacaaaacaagacccgaagcttgggaagaaaataaaaaacggactgaggaggcgtatatagaacagcttggaccaaaatttagtatactcaaacagaaaaaccccgatttaattaataaattggtagaagattccgtactcactcctcatagtaatacatcacagactagtctcaacaacatcttcaataaaaaattacacgtcaaaatcgaaaacaaatcccacgtcgccggacaggtgttggaactgaccaagatgacgctgaaagattccctttgggaaccgcgccgccattccgacatccatatgctggaaacttccgataatgcccgcatccgcctgaacacgaaagatgaaaaactgaccgtccataaagcgtatcagggcggtgcggatttcctgttcggctacgacgtgcgggagtcggacaaacccgccctgacctttgaagaaaaagtcagcggacaatccggcgtggttttggaacgccggccggaaaatctgaaaacgctcgacgggcgcaaactgattgcggcggaaaaggcagactctaattcgtttgcgtttaaacaaaattaccggcagggactgtacgaattattgctcaagcaatgcgaaggcggattttgcttgggcgtgcagcgtttggctatccccgaggcggaagcggttttatatgcccaacaggcttatgcggcaaatactttgttcgggctgcgtgccgccgacaggggcgacgacgtgtatgccgccgatccgtcccgtcaaaaattgtggctgcgcttcatcggcggccggtcgcatcaaaatatacggggcggcgcggctgcggacgggcggcgcaaaggcgtgcaaatcggcggcgaggtgtttgtacggcaaaatgaaggcagccggctggcaatcggcgtgatgggcggcagggctggccagcacgcatcagtcaacggcaaaggcggtgcggcaggcagttatttgcatggttatggcgggggtgtttatgctgcgtggcatcagttgcgcgataaacaaacgggtgcgtatttggacggctggttgcaataccaacgtttcaaacaccgcatcaatgatgaaaaccgtgcggaacgctacaaaaccaaaggttggacggcttctgtcgaaggcggctacaacgcgcttgtggcggaaggcgttgtcggaaaaggcaataatgtgcggttttacctgcaaccgcaggcgcagtttacctacttgggcgtaaacggcggctttaccgacagcgaggggacggcggtcggactgctcggcagcggtcagtggcaaagccgcgccggcattcgggcaaaaacccgttttgctttgcgtaacggtgtcaatcttcagccttttgccgcttttaatgttttgcacaggtcaaaatctttcggcgtggaaatggacggcgaaaaacagacgctggcaggcaggacggcgctcgaagggcggttcggcattgaagccggttggaaaggccatatgtccgcacgcatcggatacggcaaaaggacggacggcgacaaagaagccgcattgtcgctcaaatggctgttttga

SEQ ID NO: 454 - protein, 619 aa, Neisseria meningitidis
MFRAQLGSNTRSTKIGDDADFSFSDKPKPGTSHYFSSGKTDQNSSEYGYDEINIQGKNYNSGILAVDNMPVVKKYITDTYGDNLKDAVKKQLQDLYKTRPEAWEENKKRTEEAYIEQLGPKFSILKQKNPDLINKLVEDSVLTPHSNTSQTSLNNIFNKKLHVKIENKSHVAGQVLELTKMTLKDSLWEPRRHSDIHMLETSDNARIRLNTKDEKLTVHKAYQGGADFLFGYDVRESDKPALTFEEKVSGQSGVVLERRPENLKTLDGRKLIAAEKADSNSFAFKQNYRQGLYELLLKQCEGGFCLGVQRLAIPEAEAVLYAQQAYAANTLFGLRAADRGDDVYAADPSRQKLWLRFIGGRSHQNIRGGAAADGRRKGVQIGGEVFVRQNEGSRLAIGVMGGRAGQHASVNGKGGAAGSYLHGYGGGVYAAWHQLRDKQTGAYLDGWLQYQRFKHRINDENRAERYKTKGWTASVEGGYNALVAEGVVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSARIGYGKRTDGDKEAALSLKWLF

SEQ ID NO: 455 - DNA, 8 bp, Neisseria gonorrhoeae
  misc_feature (1)..(8): N= Unknown
nnnnnnnn

SEQ ID NO: 456 - protein, 627 aa, Neisseria gonorrhoeae
KKLRDRNSEYWKEETYHIKSNGRTYPNIPALFPKHPFDPFENINNSKKISFYDKEYTEDYLVGFARGFGVEKRNGEEEKPLRQYFKDCVNTENSNNDNCKISSFGNYGPILIKSDIFALASQIKNSHINSEILSVGNYIEWLRPTLNKLTGWQEHLYAGLDPFHYIEVTDNSHVIGQTIDLGALELTNSLWKPRWNSNIDYLITKNAEIRFNTKNESLLVKEDYAGGARFRFAYDLKDKVPEIPVLTFEKNITGTSDIIFEGKALDNLKHLDGHQIVKVNDTADKDAFRLSSKYRKGIYTLSLQQRPEGFFTKVQERDDIAIYAQQAQAANTLFALRLNDKNSDIFDRTLPRKGLWLRVIDGHSNQWVQGKTAPVEGYRKGVQLGGEVFTWQNESNQLSIGLMGGQAEQRSTFRNPDTDNLTTGNVKGFGAGVYATWHQLQDKQTGAYVDSWMQYQRFRHRINTEYATERFTSKGITASIEAGYNALLAEHFTKKGNSLRVYLQPQAQLTYLGVNGKFSDSENAQVNLLGSRQLQSRVGVQAKAQFAFTNGVTFQPFVAVNSIYQQKPFGVEIDGDRRVINNKTVIETQLGVAAKIKSHLTLQASFNRQTSKHHHAKQGALNLQWTF

SEQ ID NO: 457 - DNA, 380 bp, Neisseria meningitidis
  misc_feature (379)..(379): N= Unknown
gcggaatatgttcagttctctatagatttgttcagtgtgggtaaatcggggggcggtatacctaaggctaagcctgtgtttgatgcgaaaccgagatgggaggttgataggaagcttaataaattgacaactcgtgagcaggtggagaaaaatgttcaggaaacgagaagaaggagtcagagtagtcagtttaaagcccatgcgcaacgagaatgggaaaataaaacagggttagattttaatcattttataggtggtgatatcaataaaaaaggcacagtaacaggagggcatagtctaacccgtggtgatgtacgggtgatacaacaaacctcggcacctgataaacatggggtttatcaagcgacagtggaaattna

SEQ ID NO: 458 - protein, 127 aa, Neisseria meningitidis
  misc_feature (119)..(119): Xaa= any amino acid
  misc_feature (127)..(127): Xaa= any amino acid
AEYVQFSIDLFSVGKSGGGIPKAKPVFDAKPRWEVDRKLNKLTTREQVEKNVQETRRRSQSSQFKAHAQREWENKTGLDFNHFIGGDINKKGTVTGGHSLTRGDVRVIQQTSAPDKHGXLSSDSGNX

SEQ ID NO: 459 - DNA, 683 bp, Neisseria meningitidis
  misc_feature (12)..(12): N= Unknown
  misc_feature (34)..(34): N= Unknown
gcagtgtgcctnccgatgcatgcacacgcctcanatttggcaaacgattcttttatccggcaggttctcgaccgtcagcatttcgaacccgacgggaaataccacctattcggcagcaggggggaacttgccgagcgccagtctcatatcggattgggaaaaatacaaagccatcagttgggcaacctgatgattcaacaggcggccattaaaggaaatatcggctacattgtccgcttttccgatcacgggcacgaagtccattccccsttcgacaaccatgcctcacattccgattctgatgaagccggtagtcccgttgacggatttagcctttaccgcatccattgggacggatacgaacaccatcccgccgacggctatgacgggccacagggcggcggctatcccgctcccaaaggcgcgagggatatatacagttacgacataaaaggcgttgcccaaaatatccgcctcaacctgaccgacaaccgcagcaccggacaacggcttgccgaccgtttccacaatgccggtagtatgctgacgcaaggagtaggcgacggattcaaacgcgccacccgatacagccccgagctggacagatcgggcaatgccgccgaagccttcaacggcactgcagatatcgttaaaaacatcatcggcgctgcaggagaaattgt

SEQ ID NO: 460 - protein, 227 aa, Neisseria meningitidis
  misc_feature (12)..(12): Xaa= any amino acid
AVCLPMHAHASXLANDSFIRQVLDRQHFEPDGKYHLFGSRGELAERQSHIGLGKIQSHQLGNLMIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLADRFHNAGSMLTQGVGDGFKRATRYSPELDRSGNAAEAFNGTADIVKNIIGAAGEI

SEQ ID NO: 461 - DNA, 8 bp, Neisseria gonorrhoeae
  misc_feature (1)..(8): N= Unknown
nnnnnnnn

SEQ ID NO: 462 - protein, 298 aa, Neisseria meningitidis
  misc_feature (93)..(93): Xaa= any amino acid
  misc_feature (108)..(108): Xaa= any amino acid
RRLKHCCHARLGSAFHRKQDGAHQRFGRYGATQRLCRSSHPRLGSPKPQCRTRHRSRQQYLYGSHPHQRDWSCPGKIQLGRHHGTSCRAVADXRDRICEREIRRQRQXCRCRLGKIPSLSIPKYPLKLEQRYGKENITSSTVPPSNGKNVKLADQRHPKTGVPFDGKGFPNFEKHVKYDTKLDIQELSGGGIPKAKPVFDAKPRWEVDRKLNKLTTREQVEKNVQETRRRSQSSQFKAHAQREWENKTGLDFNHFIGGDINKKGAVTGGHSLTRGDVRVIQQTSAPDKHGVLSSDSGN

SEQ ID NO: 463 - DNA, 1887 bp, Neisseria gonorrhoeae
  misc_feature (175)..(175): N= Unknown
ttgggcatttcccgcaaaatatcccttattctgtccatactggcagtgtgcctgccgatgcatgcacacgcctcagatttggcaaacgatccctttatccggcaggttctcgaccgtcagcatttcgaacccgacgggaaataccacctattcggcagcaggggggagcttgccnagcgcaacggccatatcggattgggaaacatacaaagccatcagttgggccacctgatgattcaacaggcggccgttgaaggaaatatcggctacattgtccgcttttccgatcacgggcacaaattccattcgcccttcgacaaccatgcctcacattccgattctgacgaagccggtagtcccgttgacggattcagcctttaccgcatccattgggacggatacgaacaccatcccgccgacggctatgacgggccacagggcggcggctatcccgctcccaaaggcgcgagggatatatacagctacgacataaaaggcgttgcccaaaatatccgcctcaacctgaccgacaaccgcagcaccggacaacggcttgccgaccgtttccacaatgccggcgctatgctgacgcaaggagtaggcgacggattcaaacgcgccacccgatacagccccgagctggacagatcgggcaatgccgccgaagccttcaacggcactgcagatatcgtcaaaaacatcatcggcgcggcaggagaaattgtcggcgcaggcgatgccgtgcagggtataagcgaaggctcaaacattgctgtcatgcacggcttgggtctgctttccaccgaaaacaagatggcgcgcatcaacgatttggcagatatggcgcaactcaaagactatgccgcagcagccatccgcgattgggcagtccaaaaccccaatgccgcacaaggcatagaagccgtcagcaatatctttatggcagccatccccatcaaagggattggagctgtccggggaaaatacggcttgggcggcatcacggcacatcctgtcaagcggtcgcagatgggcgcgatcgcattgccgaaagggaaatccgccgtcagcgacaattttgccgatgcggcatacgccaaatacccgtccccttaccattcccgaaatatccgttcaaacttggagcagcgttacggcaaagaaaacatcacctcctcaaccgtgccgccgtcaaacggcaaaaatgtcaaactggcagaccaacgccacccgaagacaggcgtaccgtttgacggtaaagggtttccgaattttgagaagcacgtgaaatatgatacgaagctcgatattcaagaattatcggggggcggtatacctaaggctaagcctgtgtttgatgcgaaaccgagatgggaggttgataggaagcttaataaattgacaactcgtgagcaggtggagaaaaatgttcaggaaacgagaagaaggagtcagagtagtcagtttaaagcccatgcgcaacgagaatgggaaaataaaacagggttagattttaatcattttataggtggtgatatcaataagaaaggcacagtaacaggagggcatagtctaacccgtggtgatgtacgggtgatacaacaaacctcggcacctgataaacatggggtttatcaagcgacagtggaaattaaaaagcctgatggaagttgggaggtgaaaacgaaaaaaggtgggaaagtgatgaccaagcacaccatgttcccaaaagattgggatgaggctagaattagggctgaagttacttcggcttgggaaagtagaataatgcttaaggataataaatggcagggtacaagtaaatcgggtattaaaatagaaggatttaccgaacctaatagaacagcatatcccatttatgaatag

SEQ ID NO: 464 - protein, 628 aa, Neisseria gonorrhoeae
  misc_feature (59)..(59): Xaa= any amino acid
LGISRKISLILSILAVCLPMHAHASDLANDPFIRQVLDRQHFEPDGKYHLFGSRGELAXRNGHIGLGNIQSHQLGHLMIQQAAVEGNIGYIVRFSDHGHKFHSPFDNHASHSDSDEAGSPVDGFSLYRIHWDGYEHHPADGYDGPQGGGYPAPKGARDIYSYDIKGVAQNIRLNLTDNRSTGQRLADRFHNAGAMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFMAAIPIKGIGAVRGKYGLGGITAHPVKRSQMGAIALPKGKSAVSDNFADAAYAKYPSPYHSRNIRSNLEQRYGKENITSSTVPPSNGKNVKLADQRHPKTGVPFDGKGFPNFEKHVKYDTKLDIQELSGGGIPKAKPVFDAKPRWEVDRKLNKLTTREQVEKNVQETRRRSQSSQFKAHAQREWENKTGLDFNHFIGGDINKKGTVTGGHSLTRGDVRVIQQTSAPDKHGVYQATVEIKKPDGSWEVKTKKGGKVMTKHTMFPKDWDEARIRAEVTSAWESRIMLKDNKWQGTSKSGIKIEGFTEPNRTAYPIYE

SEQ ID NO: 465 - DNA, 1671 bp, Neisseria meningitidis
ttgggcatttcccgcaaaatatcccttattctgtccatactggcagtgtgcctgccgatgcatgcacacgcctcagatttggcaaacgattcttttatccggcaggttctcgaccgtcagcatttcgaacccgacgggaaataccacctattcggcagcaggggggaacttgccgagcgcagcggtcatatcggattgggaaacatacaaagccatcagttgggcaacctgttcatccagcaggcggccattaaaggaaatatcggctacattgtccgcttttccgatcacgggcacgaagtccattcccccttcgacaaccatgcctcacattccgattctgatgaagccggtagtcccgttgacggattcagcctttaccgcatccattgggacggatacgaacaccatcccgccgacggctatgacgggccacagggcggcggctatcccgctcccaaaggcgcgagggatatatacagctacgacataaaaggcgttgcccaaaatatccgcctcaacctgaccgacaaccgcagcaccggacaacggcttgtcgaccgtttccacaataccggtagtatgctgacgcaaggagtaggcgacggattcaaacgcgccacccgatacagccccgagctggacagatcgggcaatgccgccgaagctttcaacggcactgcagatatcgtcaaaaacatcatcggcgcggcaggagaaattgtcggcgcaggcgatgccgtgcagggtataagcgaaggctcaaacattgctgttatgcacggcttgggtctgctttccaccgaaaacaagatggcgcgcatcaacgatttggcagatatggcgcaactcaaagactatgccgcagcagccatccgcgattgggcagtccaaaaccccaatgccgcacaaggcatagaagccgtcagcaatatctttacggcagtcatccccgtcaaagggattggagctgttcggggaaaatacggcttgggcggcatcacggcacatcctgtcaagcggtcgcagatgggcgagatcgcattgccgaaagggaaatccgccgtcagcgacaattttgccgatgcggcatacgccaaatacccgtccccttaccattcccgaaatatccgttcaaacttggagcagcgttacggcaaagaaaacatcacctcctcaaccgtgccgccgtcaaacggaaagaatgtgaaactggcaaacaaacgccacccgaagaccaaagtgccgtttgacggtaaagggtttccgaattttgaaaaagacgtaaaatacgatacgagaattaataccgctgtaccacaagtgaatcctatagatgaacccgtctttaatcctaaaggttctgtcggatcggctcattcttggtctataactgccagaattcaatacgcaaaattaccaaggcaaggtagaatcagatatatcccacctaaaaattactctccttcagcaccgctaccaaaaggacctaataatggatatttggataaatttggtaatgaatggactaaaggtccatcaagaactaaaggtcaagaatttgaatgggatgttcaattgtctaaaacaggaagagagcaacttggatgggctagtagggatggtaagcatttaaatatatcaattgatggaaagattacacacaaatga

SEQ ID NO: 466 - protein, 556 aa, Neisseria meningitidis
LGISRKISLILSILAVCLPMHAHASDLANDSFIRQVLDRQHFEPDGKYHLFGSRGELAERSGHIGLGNIQSHQLGNLFIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLVDRFHNTGSMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFTAVIPVKGIGAVRGKYGLGGITAHPVKRSQMGEIALPKGKSAVSDNFADAAYAKYPSPYHSRNIRSNLEQRYGKENITSSTVPPSNGKNVKLANKRHPKTKVPFDGKGFPNFEKDVKYDTRINTAVPQVNPIDEPVFNPKGSVGSAHSWSITARIQYAKLPRQGRIRYIPPKNYSPSAPLPKGPNNGYLDKFGNEWTKGPSRTKGQEFEWDVQLSKTGREQLGWASRDGKHLNISIDGKITHK

SEQ ID NO: 467 - DNA, 357 bp, Neisseria meningitidis
atgaatattcacaccctgctctccaaacaatggacgctgccgccattcctgccgaaacggctgctgctgtccctgctgatactgcttgcccccaatgcggtgttttgggttttggcactgctgaccgccaccgcccgcccgattgtcaatttggactatcttcccgccgcgctgctgatcgccctgccttggcgtttcgtcaaaattgccggcgtattggcgttttggctggcggttttgtttgacgggctgatgatggtgatccaactcttcccttttatggatctcatcggcgccatcaacctcgtccccttcatcctgaccgcccccgccccttatcagataatgaccgggctg

SEQ ID NO: 468 - protein, 119 aa, Neisseria meningitidis
MNIHTLLSKQWTLPPFLPKRLLLSLLILLAPNAVFWVLALLTATARPIVNLDYLPAALLIALPWRFVKIAGVLAFWLAVLFDGLMMVIQLFPFMDLIGAINLVPFILTAPAPYQIMTGL

SEQ ID NO: 469 - DNA, 1419 bp, Neisseria meningitidis
atgaatattcacaccctgctctccaaacaatggacgctgccgccattcctgccgaaacggctgctgctgtccctgctgatactgcttgcccccaatgcggtgttttgggttttggcactgctgaccgccaccgcccgcccgattgtcaatttggactatcttcccgccgcgctgctgatcgccctgccttggcgtttcgtcaaaattgccggcgtattggcgttttggctggcggttttgtttgacgggctgatgatggtgatccaactcttcccttttatggatctcatcggcgccatcaacctcgtccccttcatcctgaccgcccccgccccttatcagataatgaccgggctgttgctgctgtatatgctggcgatgccgtttgtgttgcagaaagccgccgccaaaaccgacttccggcacattgccgtctgcgccgccgttgtggcggcagccggctatttcaccggccatttgagttactacgaccggggtcggatggccaatatcttcggcgcaaacaacttctactacgccaaaagtcaggcgatgctctacaccgtcagccagaatgccgactttattaccgccggcctggtcgatcccgtcttcctccccttgggcaatcaacagcgtgccgccacgcatctgaacgagccgaaatctcaaaaaatcctctttatcgtcgccgaatcttgggggctgccggccaatcccgaacttcaaaacgccacttttgccaaactgctggcgcaaaaagaccgtttttcggtttgggaaagcggcagttttcccttcatcggcgcgacggtcgaaggcgaaatgcgcgaactgtgtgcctacggcggtttgcgcgggttcgcactgcgccgcgcgcccgacgaaaaatttgcccgctgcctccccaaccgtttgaaacaagaaggttacgccacctttgcgatgcacggcgcgggcagttcgctttacgaccgcttcagctggtatccgagggcgggctttcaagaaatcaaaaccgccgaaaacctgatcggtaaaaaaacctgcgccattttcggcggcgtgtgcgacagcgagctgttcggcgaagtgtcggcatttttcaaaaaacacgacaagggactgttttactggatgacgctgaccagccacgccgactatcccgaatccgacattttcaaccacaggctcaaatgcaccgaatatggcctgcccgccgaaaccgacctctgccgcaatttcagcctgcacacccaattcttcgaccaactggcggatttgatccaacgccccgaaatgaaaggcacggaagtcatcatcgtcggcgaccatccgccgcccgtcggcaacctcaatgaaaccttccgctacctcaaacaggggcacgtcgcctggctgaacttcaaaatcaaataa

SEQ ID NO: 470 - protein, 472 aa, Neisseria meningitidis
MNIHTLLSKQWTLPPFLPKRLLLSLLILLAPNAVFWVLALLTATARPIVNLDYLPAALLIALPWRFVKIAGVLAFWLAVLFDGLMMVIQLFPFMDLIGAINLVPFILTAPAPYQIMTGLLLLYMLAMPFVLQKAAAKTDFRHIAVCAAVVAAAGYFTGHLSYYDRGRMANIFGANNFYYAKSQAMLYTVSQNADFITAGLVDPVFLPLGNQQRAATHLNEPKSQKILFIVAESWGLPANPELQNATFAKLLAQKDRFSVWESGSFPFIGATVEGEMRELCAYGGLRGFALRRAPDEKFARCLPNRLKQEGYATFAMHGAGSSLYDRFSWYPRAGFQEIKTAENLIGKKTCAIFGGVCDSELFGEVSAFFKKHDKGLFYWMTLTSHADYPESDIFNHRLKCTEYGLPAETDLCRNFSLHTQFFDQLADLIQRPEMKGTEVIIVGDHPPPVGNLNETFRYLKQGHVAWLNFKIK

SEQ ID NO: 471 - DNA, 1419 bp, Neisseria meningitidis
  misc_feature (87)..(88): N= Unknown
  misc_feature (156)..(156): N= Unknown
  misc_feature (196)..(196): N= Unknown
  misc_feature (209)..(209): N= Unknown
  misc_feature (224)..(224): N= Unknown
  misc_feature (319)..(319): N= Unknown
  misc_feature (486)..(486): N= Unknown
  misc_feature (765)..(765): N= Unknown
  misc_feature (1102)..(1102): N= Unknown
  misc_feature (1173)..(1173): N= Unknown
  misc_feature (1231)..(1231): N= Unknown
  misc_feature (1394)..(1394): N= Unknown
  misc_feature (30)..(30): N= Unknown
atgaatattcacaccctgctctccaaacaatggacgctgccgccattcctgccgaaacggctgctgctgtccctgctgatactgctnncccccaatgcggtgttttgggttttggcactgctgaccgccaccgcccgcccgattgtcaatttggantaccttcccgccgcgctgctgatcgccctgccttggcgtntcgtcaaaattgncggcgtattggcgtnttggctggcggttttgtttgacgggctgatgatggtgatccaactcttcccttttatggatctcatcggcgccatcaacctcgtccccttcatcntgaccgcccccgccctttatcagataatgaccgggctgttactgctgtatatgctggcgatgccgtttgtgttgcagaaagccgccgccaaaaccgacttccgacacattgccgcctgtgccgccgttgtggtggcagccggctattttaccggccatttgagttantacgaccgggggcggatggccaatatcttcggcgcaaacaacttctattacgccaaaagtcaggcgatgctctacaccgtcagccagaatgccgactttattaccgccggcctggtcgatcccgtcttcctccccttgggcaatcaacagcgtgccgccacgcatctgaacgagccgaaatctcaaaaaatcctctttatcgtcgccgaatcttgggggctgccggccaatcccgaacttcaaaacgccacttttgccaaactgctggcgcaaaaagancgtttttcggtttgggaaagcggcagttttcccttcatcggcgcgacgatcgaaggcgaaatgcgcgaactgtgtgcctacggcggtttgcgcgggttcgcactgcgccgcgcgcccgacgaaaaatttgcccgctgcctccccaaccgtttgaaacaagaaggttacgccacctttgcgatgcacggcgcgggcagttcgctttacgaccgcttcagctggtatccgagggcgggctttcaagaaatcaaaaccgccgaaaacctgatcggtaaaaaaacctgcgccattttcggcggcgtgtgcgacagcgagctgttcggcgaagtgtcggcanttttcaaaaaacacgacaagggactgttttactggatgacgctgaccagccacgccgactatcccgaatcngacattttcaaccacaggctcaaatgcaccgaatatggcctgcccgccgaaaccgacntctgccgcaatttcagcctgcacacccaattcttcgaccaactggcggatttgatccaacgccccgaaatgaaaggcacggaagtcatcatcgtcggcgaccatccgccgcccgtcggcaacctcaatgaaaccttccgctacctcaaacaggggcacgtcgnctggctgaacttcaaaatcaaataa

SEQ ID NO: 472 - protein, 472 aa, Neisseria meningitidis
  misc_feature (30)..(30): Xaa= any amino acid
  misc_feature (52)..(52): Xaa= any amino acid
  misc_feature (66)..(66): Xaa= any amino acid
  misc_feature (70)..(70): Xaa= any amino acid
  misc_feature (75)..(75): Xaa= any amino acid
  misc_feature (107)..(107): Xaa= any amino acid
  misc_feature (162)..(162): Xaa= any amino acid
  misc_feature (255)..(255): Xaa= any amino acid
  misc_feature (368)..(368): Xaa= any amino acid
  misc_feature (411)..(411): Xaa= any amino acid
  misc_feature (465)..(465): Xaa= any amino acid
MNIHTLLSKQWTLPPFLPKRLLLSLLILLXPNAVFWVLALLTATARPIVNLXYLPAALLIALPWRXVKIXGVLAXWLAVLFDGLMMVIQLFPFMDLIGAINLVPFIXTAPALYQIMTGLLLLYMLAMPFVLQKAAAKTDFRHIAACAAVVVAAGYFTGHLSXYDRGRMANIFGANNFYYAKSQAMLYTVSQNADFITAGLVDPVFLPLGNQQRAATHLNEPKSQKILFIVAESWGLPANPELQNATFAKLLAQKXRFSVWESGSFPFIGATIEGEMRELCAYGGLRGFALRRAPDEKFARCLPNRLKQEGYATFAMHGAGSSLYDRFSWYPRAGFQEIKTAENLIGKKTCAIFGGVCDSELFGEVSAXFKKHDKGLFYWMTLTSHADYPESDIFNHRLKCTEYGLPAETDXCRNFSLHTQFFDQLADLIQRPEMKGTEVIIVGDHPPPVGNLNETFRYLKQGHVXWLNFKIK

SEQ ID NO: 473 - DNA, 8 bp, Neisseria gonorrhoeae
  misc_feature (1)..(8): N= Unknown
nnnnnnnn

SEQ ID NO: 474 - protein, 209 aa, Neisseria gonorrhoeae
MNIHALLSEQWTLPPFLPKRLLLSLLILLAPNAVFWVLALLTATARPIVNLDYLPAALLIALPWRFVKIAGVLAFWPAVLFDGLMMVIQLFPFMDLIGAINLVPFILTAPAPYQIMTGLLLLYMLAMPFVLQKAAVKTDFRHIAVCAAVVAAARYFTGPFELLRTGGRWQYVQHRRLLLSGSRASFRRRQKADVLRRLGNPYASMGNGG

SEQ ID NO: 475 - DNA, 1419 bp, Neisseria gonorrhoeae
atgaatattcacgccctgctctccgaacaatggacgctgccgccattcctgccgaaacggctgctgctgtccctgctgatactgctggcccccaatgcggtgttttgggttttggcactgctgaccgccaccgcccgcccgattgtcaatttggactaccttcccgccgcgctgctgatcgccctgccttggcgtttcgtcaaaattgccggcgtattggcgttttggccggcggttttgtttgacgggctgatgatggtgatccaactcttcccttttatggacctcatcggcgccatcaacctcgtccccttcatcctgaccgcccccgccccttatcagataatgaccgggctgttgctgctgtatatgctggcgatgccgtttgtgttgcaaaaagccgccgtcaaaaccgacttccgacacattgccgtctgtgccgccgttgtggcggcagccggctatttcaccggccatttgagttactacgaccgggggcggatggccaatatcttcggcgcaaacaacttctattacgccaaaagtcaggcgatgctctacaccgtcagccagaatgccgactttattaccgccggcctggtcgaccccgtcttcctccccttgggcaatcagcagcgtgccgccacgcggctgagtgagccgaaatctcaaaaaatcctctttatcgtcgccgaatcttgggggctgccgggcaatcccgagcttcaaaacgccacttttgccaaactgctggcgcaaaaagaccgtttttcggtttgggaaagcggcagttttcccttcatcggcgcgacggtcgaaggcgaaatgcgcgaattgtgcgcctacggcggtttgcgcgggttcgcactgcgccgcgcgcccgacgaaaaatttgcccgctgcctccccaaccgtttgaaacaagaaggttacgccacctttgcgatgcacggcgcgggtagttcgctttacgaccgcttcagctggtatccgagggcgggctttcaaaaaatcaaaaccgccgaaaacctgatcggtaaaaaaacctgcgccattttcggcggcgtgtgcgacagcgagctgttcggcgaagtgtcggcatttttcaaaaaacacgacaagggactgttttactggatgacgctgaccagccacgccgactatcccgaatccgacattttcaaccacaggctcaaatgcaccgaatacggcctgcccgccgaaaccgacctctgccgcaatttcagcctgcacacccaattcttcgaccaactggcggatttgatccgacgccccgaaatgaaaggcacggaagtcatcatcgtcggcgaccatccgccgcccgtcggcaacctcaatgaaaccttccgctacctcaaacagggacacgtcgcctggctgcacttcaaaatcaaataa

SEQ ID NO: 476 - protein, 472 aa, Neisseria gonorrhoeae
MNIHALLSEQWTLPPFLPKRLLLSLLILLAPNAVFWVLALLTATARPIVNLDYLPAALLIALPWRFVKIAGVLAFWPAVLFDGLMMVIQLFPFMDLIGAINLVPFILTAPAPYQIMTGLLLLYMLAMPFVLQKAAVKTDFRHIAVCAAVVAAAGYFTGHLSYYDRGRMANIFGANNFYYAKSQAMLYTVSQNADFITAGLVDPVFLPLGNQQRAATRLSEPKSQKILFIVAESWGLPGNPELQNATFAKLLAQKDRFSVWESGSFPFIGATVEGEMRELCAYGGLRGFALRRAPDEKFARCLPNRLKQEGYATFAMHGAGSSLYDRFSWYPRAGFQKIKTAENLIGKKTCAIFGGVCDSELFGEVSAFFKKHDKGLFYWMTLTSHADYPESDIFNHRLKCTEYGLPAETDLCRNFSLHTQFFDQLADLIRRPEMKGTEVIIVGDHPPPVGNLNETFRYLKQGHVAWLHFKIK

SEQ ID NO: 477 - DNA, 415 bp, Neisseria meningitidis
gtgagcggacgttaccgcgctttggatcgcgtttccaaaatcatcatcgttactttgagtatcgccacgcttgccgccgccggcatcgctatgtcgcgcggtatgcagatgcagtccgattttatcgagccgacaccgtggacgcttgccggtttgggcttcctgatcgcgctgatgggctggatgcccgcgccgattgaaatttccgccatcaattctttgtgggtaaccgaaaaacaacgcatcaatccttccgaataccgcgacgggatttttgaattcaacgtcggttatatcgccagtgcggttttggctttggttttccttgcactgggcgcgtagcgccgaacggcaacggcgaacagtgcagatggcgggcggcaaatataacgggcaattgatcaatatgtacgcc

SEQ ID NO: 478 - protein, 139 aa, Neisseria meningitidis
  misc_feature (113)..(113): Xaa= any amino acid
  misc_feature (121)..(121): Xaa= any amino acid
VSGRYRALDRVSKIIIVTLSIATLAAAGIAMSRGMQMQSDFIEPTPWTLAGLGFLIALMGWMPAPIEISAINSLWVTEKQRINPSEYRDGIFEFNVGYIASAVLALVFLALGXVAPNGNGXTVQMAGGKYNGQLINMYA

SEQ ID NO: 479 - DNA, 1254 bp, Neisseria meningitidis
atgtccgaacaacatatttcgacttggaaaagtaaaatcaacgcattgggtccggggatcatgatggcttcggcggcggtcggcggttcgcacctgattgcctcgacgcaggcgggcgcgctttacggctggcagatcgcgctcatcatcatcctgaccaacctcttcaaatacccgtttttccgcttcagcgcgcattacacgctggacacgggcaagagcctgattgaaggttatgccgagaaaagccgcgtttatttgtgggtattcctgattttgtgcatcctctccgccacgattaacgcgggcgcggtcgccattgtaaccgccgccatcgtcaaaatggcgattccctcgctgatgtttgatgccggcacggttgccgccttgattatggcatcctgcctgattattttggtgagcggacgttaccgcgctttggatcgcgtttccaaaatcatcatcgttactttgagtatcgccacgcttgccgccgccggcatcgctatgtcgcgcggtatgcagatgcagtccgattttatcgagccgacaccgtggacgcttgccggtttgggcttcctgatcgcgctgatgggctggatgcccgcgccgattgaaatttccgccatcaattctttgtgggtaaccgaaaaacaacgcatcaatccttccgaataccgcgacgggatttttgatttcaacgtcggttatatcgccagtgcggttttggctttggttttccttgcactgggcgcgtttgtgcaatacggcaacggcgaagcagtgcagatggcgggcggcaaatatatcgggcaattgatcaatatgtacgccgttaccatcggcggctggtcgcgcccgctggtggcgtttatcgcgtttgcctgtatgtacggcacgacgattaccgtcgtggacggctatgcccgtgccattgccgaacccgtgcgcctgctgcgcggaaaagacaaaacgggcaacgccgaattctttgcctggaatatttgggtggcgggcagcggtttggcggtgattttctggtttgacggcgtaatggcgaatctgctcaaatttgcgatgattgccgcttttgtgtccgcccctgtgtttgcctggctgaattaccgtttggttaaaggtgatgaaaaacacaaactcacatcaggtatgaatgcccttgcattggcaggcttgatttatctgaccggttttaccgttttgttcttattgaatttggcgggaatgttcaaatga

SEQ ID NO: 480 - protein, 417 aa, Neisseria meningitidis
MSEQHISTWKSKINALGPGIMMASAAVGGSHLIASTQAGALYGWQIALIIILTNLFKYPFFRFSAHYTLDTGKSLIEGYAEKSRVYLWVFLILCILSATINAGAVAIVTAAIVKMAIPSLMFDAGTVAALIMASCLIILVSGRYRALDRVSKIIIVTLSIATLAAAGIAMSRGMQMQSDFIEPTPWTLAGLGFLIALMGWMPAPIEISAINSLWVTEKQRINPSEYRDGIFDFNVGYIASAVLALVFLALGAFVQYGNGEAVQMAGGKYIGQLINMYAVTIGGWSRPLVAFIAFACMYGTTITVVDGYARAIAEPVRLLRGKDKTGNAEFFAWNIWVAGSGLAVIFWFDGVMANLLKFAMIAAFVSAPVFAWLNYRLVKGDEKHKLTSGMNALALAGLIYLTGFTVLFLLNLAGMFK

SEQ ID NO: 481 - DNA, 1254 bp, Neisseria meningitidis
atgtccgaacaacatatttcgacttggaaaagtaaaatcaacgcattgggaccggggattatgatggcttcggcggcggtcggcggttcgcacctgattgcctcgacgcaggcgggcgcgctttacggctggcagatcgcgctcatcatcatcctgaccaacctcttcaaatacccgtttttccgcttcagcgcgcattacacgctggacacgggcaagagcctgattgaaggttatgccgagaaaagccgcgtttatttgtgggtattcctgattttgtgcatcctctccgccacgattaacgcgggcgcggtcgccattgtaaccgccgccatcgtcaaaatggcgattccctcgctgatgtttgatgccggcacggttgccgccttgattatggcatcctgcctgattattttggtgagcggacgttaccgcgctttggatcgcgtttccaaaatcatcatcgttactttgagtatcgccacgcttgccgccgccggcatcgctatgtcgcgcggtatgcagatgcagtccgattttatcgagccgacaccgtggacgcttgccggtttgggcttcctgatcgcgctgatgggctggatgcccgcgccgattgaaatttccgccatcaattctttgtgggtaaccgaaaaacaacgcatcaatccttccgaataccgcgacgggatttttgatttcaacgtcggttatatcgccagtgcggttttggctttggttttccttgcactgggcgcgtttgtgcaatacggcaacggcgaagcagtgcagatggcgggcggcaaatatatcgggcaattgatcaatatgtacgccgttaccatcggcggctggtcgcgcccgctggtggcgtttatcgcgtttgcctgtatgtacggcacgacgattaccgttgtggacggctatgcccgtgccattgccgaacccgtgcgcctgctgcgcggaaaagacaaaacgggcaacgccgaattctttgcctggaatatttgggtggcgggcagcggtttggcggtgattttctggtttgacggcgtaatggcgaatctgctcaaatttgcgatgattgccgcttttgtgtccgcccctgtgtttgcctggctgaattaccgtttggtcaaaggtgatgaaaaacacaaactcacatcaggtatgaatgcccttgcattggcaggcttgatttatctgaccggttttaccgttttgttcttattgaatttggcgggaatgttcaaatga

SEQ ID NO: 482 - protein, 417 aa, Neisseria meningitidis; identical to SEQ ID NO: 480

SEQ ID NO: 483 - DNA, 8 bp, Neisseria gonorrhoeae
  misc_feature (1)..(8): N= Unknown
nnnnnnnn

SEQ ID NO: 484 - protein, 269 aa, Neisseria gonorrhoeae
MPKKSCVYLWVFLILCIASATINAGAVAIVTAAIVKMAIPSLMFDAGTVAALIMASCLIILVSGRYRALDRVSKIIIVTLSIATLAAAGIAMSRGMQMQPDFIEPTPWTLAGLGFLIALMGWMPAPIEISAINSLWVTEKQRINPSEYRDGIFDFNVGYIASAVLALVFLALGAFVQYGNGEAVQMGGGKYIGQLINMYAVTIGGGSRPLVAFIAFACMYGAASTVVDGYARAIAEPVRLLRGKDKTARPIVLLEKLGGRHRFGRDFLV

SEQ ID NO: 485 - DNA, 1014 bp, Neisseria gonorrhoeae
aagaaaagctgcgtttatttgtgggtttttttgattttgtgtatcgcctccgccacgattaacgcgggcgcggtcgccattgtaaccgccgccatcgtcaaaatggcgattccctcgctgatgtttgatgccggcacggttgccgccttgattatggcatcctgcctgattattttggtgagcggacgttaccgcgctttggatcgtgtttccaaaatcatcattgttactttgagcatcgccacgcttgccgccgccggcatcgctatgtcgcgcggtatgcagatgcagcccgattttatcgagccgacaccgtggacgcttgccggtttgggcttcctgatcgcgctgatgggctggatgcccgcgccgatcgaaatttccgccatcaattctttgtgggtaaccgaaaaacaacgcatcaatccttctgaataccgcgacgggattttcgatttcaacgtcggttatatcgccagtgcggttttggctttggttttccttgcactgggcgcgtttgtgcaatacggcaacggcgaagcagtgcagatggcgggcggcaaatatatcgggcaattgattaatatgtatgccgtaaccatcggcggctggtctcgtccgctggtggcgtttatcgcgtttgcctgtatgtacggcacgacgattaccgttgtggacggttatgcgcgtgccattgccgaacccgtgcgcctgctgcgcggcagggataaaaccggcaacgccgagttgtttgcctggaatatttgggtggcgggcagcggtttggcggtgattttctggtttgacggcgcaatggcggaactgctcaaatttgcgatgattgccgcctttgtgtccgcccctgtgttcgcctggctcaactaccgcctcgtcaaaggggacaaacgccacaggcttaccgccggtatgaacgcccttgccattgtcggcctgctctacctggccgggtttgccgttttgttcctgttgaaccttaccggacttttggcatag

SEQ ID NO: 486 - protein, 337 aa, Neisseria gonorrhoeae
KKSCVYLWVFLILCIASATINAGAVAIVTAAIVKMAIPSLMFDAGTVAALIMASCLIILVSGRYRALDRVSKIIIVTLSIATLAAAGIAMSRGMQMQPDFIEPTPWTLAGLGFLIALMGWMPAPIEISAINSLWVTEKQRINPSEYRDGIFDFNVGYIASAVLALVFLALGAFVQYGNGEAVQMAGGKYIGQLINMYAVTIGGWSRPLVAFIAFACMYGTTITVVDGYARAIAEPVRLLRGRDKTGNAELFAWNIWVAGSGLAVIFWFDGAMAELLKFAMIAAFVSAPVFAWLNYRLVKGDKRHRLTAGMNALAIVGLLYLAGFAVLFLLNLTGLLA

SEQ ID NO: 487 - DNA, 309 bp, Neisseria meningitidis
ttgcgggaaacggcatatgttttggatagttttgatcgttattttgttgttgcgcttgccggcttgttttttgtccgcgcacaatccgaacgcgagtggatgcgcgaggtttctgcgtggcaggaaaagaaaggggaaaaacaggcggagctgcctgaaatcaaagacggtatgcccgattttcccgaacttgccctgatgcttttccacgccgtcaaaacggcagtgtattggctgtttgtcggtgtcgtccgtttctgccgaaactatctggcgcacgaatccgaaccggacaggcccgttccgcct

SEQ ID NO: 488 - protein, 103 aa, Neisseria meningitidis
LRETAYVLDSFDRYFVVALAGLFFVRAQSEREWMREVSAWQEKKGEKQAELPEIKDGMPDFPELALMLFHAVKTAVYWLFVGVVRFCRNYLAHESEPDRPVPP

SEQ ID NO: 489 - DNA, 3045 bp, Neisseria meningitidis
atgttttggatagttttgatcgttattttgttgcttgcgcttgccggcttgttttttgtccgcgcacaatccgaacgcgagtggatgcgcgaggtttctgcgtggcaggaaaagaaaggggaaaaacaggcggagctgcctgaaatcaaagacggtatgcccgattttcccgaacttgccctgatgcttttccatgccgtcaaaacggcagtgtattggctgtttgtcggtgtcgtccgtttctgccgaaactatctggcgcacgaatccgaaccggacaggcccgttccgcctgcttctgcaaaccgtgcggatgttccgaccgcatccgacggatattcagacagtggaaacgggacggaagaagcggaaacggaagaagcagaagctgcggaggaagaggctgccgatacggaagacattgcaactgccgtaatcgacaaccgccgcatcccattcgaccggagtattgctgaagggttgatgccgtctgaaagcgaaatttcgcccgtccgtccggtttttaaagaaatcactttggaagaagcaacgcgtgctttaaacagcgcggctttaagggaaacgaaaaaacgctatatcgatgcatttgagaaaaacgaaacagcggtccccaaagtccgcgtgtccgataccccgatggaagggctgcagattatcggtttggacgaccctgtgcttcaacgcacgtattcccatatgttcgatgcggacaaagaagcgttttccgagtctgcggattacggatttgagccgtattttgagaagcagcatccgtctgccttttctgcagtcaaagccgaaaatgcacggaatgcgccgttccaccgtcatgcagggcaggggaaagggcaggcggaggcaaaatccccggatgtttcccaagggcagtccgtttcagacggcacggccgtccgcgatgcccgccgccgcgtttccgtcaatttgaaagaaccgaacaaggcaacggtttctgcggaggcgcgaatttctcgcctgattccggaaagtcagacggttgtcgggaaacgggatgtcgaaatgccgtctgaaaccgaaaatgttttcacggaaaccgtttcgtctgtgggatacggcggtccggtttatgatgaaactgccgatatccatattgaagaacctgccgcgcccgatgcttgggtggtcgaaccacccgaagtgccgaaagttcccatgaccgcaatcgatattcagccgccgcctcccgtatcggaaatctacaaccgtacctatgaaccgccgtcaggattcgagcaggtgcaacgcagccgcattgccgagaccgaccatcttgccgatgatgttttgaatggaggttggcaggaggaaaccgccgctattgcggatgacggcagtgaaggtgcggcagagcggtcaagcgggcaatatctgtcggaaaccgaagcgttcgggcatgacagtcaggcggtttgtccgtttgaaaatgtgccgtctgaacgcccgtcctgccgggtatcggatacggaagcggatgaaggggcgttcccatctgaagaaaccggtgcggtatccgaacacctgccgacaaccgacctgcttctgcctccgctgttcaatcccgaggcgacgcaaaccgaagaagaactgttggaaaacagcatcaccatcgaagaaaaattggcggagttcaaagtcaaggtcaaggttgtcgattcttattccggccccgtaattacgcgttatgaaatcgaacccgatgtcggcgtgcgcggcaattccgttctgaatctggaaaaagatttggcgcgttcgctcggcgtggcttccatccgcgttgtcgaaaccatccccggcaaaacctgcatgggtttggaacttccgaacccgaaacgccaaatgatacgcctgagcgaaatcttcaattcgcccgagtttgccgaatccaaatccaagctgacgctcgcgctcggtcaggacatcaccggacagcccgtcgtaaccgacttgggaaaagcaccgcatttgttggttgccggcacgaccggttcgggcaaatcggtgggtgtcaacgcgatgattctgtctatgcttttcaaagccgcgccggaagacgtgcgtatgattatgatcgatccgaaaatgctggaattgagcatttacgaaggcatcccgcacctgctcgcccctgtcgttaccgatatgaagctggcggcaaacgcgctgaactggtgtgttaacgaaatggaaaaacgctaccgcctgatgagctttatgggcgtgcgtaatcttgcgggcttcaatcaaaaaatcgccgaagccgcagcaaggggagaaaaaatcggcaatccgttcagcctcacgcccgacgatcccgaacctttggaaaaactgccgtttatcgtggtcgtggtcgatgagtttgccgacctgatgatgacggcaggcaagaaaatcgaagaactgattgcccgcctcgcccaaaaagcccgcgcggcaggcatccatttgattcttgccacacaacgccccagcgtcgatgtcatcacgggtctgattaaggcgaacatcccgacgcgtatcgcgttccaagtgtccagcaaaatcgacagccgcacgattctcgaccaaatgggcgcggaaaacctgctcggtcagggcgatatgctgttcctgctgccgggtactgcctatccgcagcgcgttcacggcgcgtttgcctcggatgaagaggtgcaccgcgtggtcgaatatttgaaacagtttggcgaaccggactatgttgacgatattttgagcggcggcggcagcgaagagctgcccggcatcgggcgcagcggcgacgacgaaaccgatccgatgtacgacgaggccgtatccgttgtcctgaaaacgcgcaaagccagcatttcgggcgtacagcgcgccttgcgtatcggctacaaccgcgccgcgcgtctgattgaccagatggaggcggaaggcattgtgtccgcaccggaacacaacggcaaccgtacgattctcgtccccttggacaatgcttga

SEQ ID NO: 490 - protein, 1014 aa, Neisseria meningitidis
MFWIVLIVILLLALAGLFFVRAQSEREWMREVSAWQEKKGEKQAELPEIKDGMPDFPELALMLFHAVKTAVYWLFVGVVRFCRNYLAHESEPDRPVPPASANRADVPTASDGYSDSGNGTEEAETEEAEAAEEEAADTEDIATAVIDNRRIPFDRSIAEGLMPSESEISPVRPVFKEITLEEATRALNSAALRETKKRYIDAFEKNETAVPKVRVSDTPMEGLQIIGLDDPVLQRTYSHMFDADKEAFSESADYGFEPYFEKQHPSAFSAVKAENARNAPFHRHAGQGKGQAEAKSPDVSQGQSVSDGTAVRDARRRVSVNLKEPNKATVSAEARISRLIPESQTVVGKRDVEMPSETENVFTETVSSVGYGGPVYDETADIHIEEPAAPDAWVVEPPEVPKVPMTAIDIQPPPPVSEIYNRTYEPPSGFEQVQRSRIAETDHLADDVLNGGWQEETAAIADDGSEGAAERSSGQYLSETEAFGHDSQAVCPFENVPSERPSCRVSDTEADEGAFPSEETGAVSEHLPTTDLLLPPLFNPEATQTEEELLENSITIEEKLAEFKVKVKVVDSYSGPVITRYEIEPDVGVRGNSVLNLEKDLARSLGVASIRVVETIPGKTCMGLELPNPKRQMIRLSEIFNSPEFAESKSKLTLALGQDITGQPVVTDLGKAPHLLVAGTTGSGKSVGVNAMILSMLFKAAPEDVRMIMIDPKMLELSIYEGIPHLLAPVVTDMKLAANALNWCVNEMEKRYRLMSFMGVRNLAGFNQKIAEAAARGEKIGNPFSLTPDDPEPLEKLPFIVVVVDEFADLMMTAGKKIEELIARLAQKARAAGIHLILATQRPSVDVITGLIKANIPTRIAFQVSSKIDSRTILDQMGAENLLGQGDMLFLLPGTAYPQRVHGAFASDEEVHRVVEYLKQFGEPDYVDDILSGGGSEELPGIGRSGDDETDPMYDEAVSVVLKTRKASISGVQRALRIGYNRAARLIDQMEAEGIVSAPEHNGNRTILVPLDNA

SEQ ID NO: 491 - DNA, 3045 bp, Neisseria meningitidis
  misc_feature (864)..(864): N= Unknown
  misc_feature (882)..(882): N= Unknown
  misc_feature (943)..(943): N= Unknown
  misc_feature (1094)..(1094): N= Unknown
  misc_feature (1118)..(1118): N= Unknown
  misc_feature (1224)..(1224): N= Unknown
  misc_feature (1517)..(1517): N= Unknown
  misc_feature (1644)..(1644): N= Unknown
  misc_feature (1653)..(1653): N= Unknown
  misc_feature (1679)..(1679): N= Unknown
  misc_feature (1800)..(1800): N= Unknown
  misc_feature (2296)..(2296): N= Unknown
  misc_feature (2385)..(2385): N= Unknown
  misc_feature (2790)..(2790): N= Unknown
  misc_feature (2877)..(2877): N= Unknown
  misc_feature (3033)..(3033): N= Unknown
atgttttggatagttttgatcgttattttgttgcttgcgcttgccggcttgttttttgtccgcgcacaatccgaacgcgagtggatgcgcgaggtttctgcgtggcaggaaaagaaaggggaaaaacaggcggagctgcctgaaatcaaagacggtatgcccgattttcccgaacttgccctgatgcttttccatgccgtcaaaacggcagtgtattggctgtttgtcggtgtcgtccgtttctgccgaaactatctggcgcacgaatccgaaccggacaggcccgttccgcctgcttctgcaaatcgtgcggatgttccgaccgcatccgacggatattcagacagtggaaacgggacggaagaagcggaaacggaagaagcagaagctgcggaggaagaggctgccgatacggaagacattgcaactgccgtaatcgacaaccgccgcatcccattcgaccggagtattgctgaagggttgatgccgtctgaaagcgaaatttcgcccgtccgtccggtttttaaggaaatcactttggaagaagcaacgcgtgctttaaacagcgcggctttaagggaaacgaaaaaacgctatatcgatgcatttgagaaaaacgaaacagcggtccccaaagtccgcgtgtccgataccccgatggaagggctgcagattatcggtttggacgaccctgtgcttcaacgcacgtattcccgtatgttcgatgcggacaaagaagcgttttccgagtctgcggattacggatttgagccgtattttgagaagcagcatccgtctgccttttctgcagtcaaagccgaaaatgcacggaatgcgccgttccgccgtcatgcagggcagggnaaagggcaggcggaggcnaaatccccggatgtttcccaagggcagtccgtttcagacggcacagccgtccgcgatgccngccgccgcgtttccgtcaatttgaaagaaccgaacaaggcaacggtttctgcggaggcgcggatttcgcgcctgattccggaaagtcggacggttgtcgggaaacgggatgtcgaaatgccgtctgaaaccgaaaatgttttcacggaaantgtttcgtctgtgggatacggcgntccggtttatgatgaaactgccgatatccatattgaagaacctgccgcgcccgatgcttgggtggtcgaaccacccgaagtgccgaaagttcccatgcccgcaatngatattccgccgccgcctcccgtatcggaaatctacaaccgtacctatgaaccgccggcaggattcgagcaggtgcaacgcagccgcattgccgaaaccgatcatcttgccgatgatgttttgaatggaggttggcaggaggaaaccgccgctattgcgaatgacggcagtgagggtgtggcagagcggtcaagcgggcaatatttgtcggaaaccgaagcgttcgggcatgacagtcaggcggtttgtccgtttgaaaatgtgccgtctgaacgcccgtcccgccgggcatnggatacggaagcggatgaaggggcgttccaatctgaagaaaccggtgcggtatccgaacacctgccgacaaccgacctgcttctgccgccgctgttcaatcccggggcgacgcaaaccgaagaaganctgttgganaacagcatcaccatcgaagaaaaatnggcggagttcaaagtcaaggtcaaggttgtcgattcttattccggccccgtgattacgcgttatgaaatcgaacccgatgtcggcgtgcgcggcaattccgttctaaatctggaaaaaganttggcgcgttcgctcggcgtggcttccatccgcgttgtcgaaaccatcctcggcaaaacctgtatgggtttggaacttccgaacccgaaacgccaaatgatacgcctgagcgaaatcttcaattcgcccgagtttgccgaatccaaatccaagctgacgctcgcgctcggtcaggacatcaccggacagcccgtcgtaaccgacttgggcaaagcaccgcatttgttggttgccggcacgaccggttcgggcaaatcggtgggtgtcaacgcgatgattctgtctatgcttttcaaagccgcgccggaagacgtgcgtatgattatgatcgatccgaaaatgctggaattgagcatttacgaaggcatcccgcacctgctcgcccctgtcgttaccgatatgaagctggcggcaaacgcgctgaactggtgtgttaacgaaatggaaaaacgctaccgcctgatgagctttatgggcgtgcgcaatcttgcgggtntcaatcaaaaaatcgccgaagccgcagcaaggggggagaaaatcggcaacccgttcagcctcacgcccgacaatcccgaacctttgganaaattgccgtttatcgtggtcgtggttgatgagtttgccgacctgatgatgacggcaggcaagaaaatcgaagaactgattgcccgcctcgcccaaaaagcccgcgcggcaggcatccatcttatccttgccacacaacgccccagtgtcgatgtcatcacgggtctgattaaggcgaacatcccgacgcgtatcgcgttccaagtgtccagcaaaatcgacagccgcacgattcttgaccaaatgggtgcggaaaacctgctcgggcagggcgatatgctgttcctgccgccgggtacggcctatccgcagcgcgttcacggcgcgtttgcctcggatgaagaggtgcaccgcgtggtcgaatatctgaaacagtttggcgaaccggactatgttgacgatatnttgagcggcggtatgtccgacgatttgctgggaatcagccggagcggcgacggcgaaaccgatccgatgtacgacgaggccgtgtcngttgttttgaaaacgcgcaaagccagcatttctggcgtgcagcgcgcattgcgtatcggctataatcgcgccgcgcgtctgattgaccagatggaggcggaaggcattgtgtccgcaccggaacacaacggcaaccgtacgattctcgtccccttngacaatgcttga

SEQ ID NO: 492 - protein, 1015 aa, Neisseria meningitidis
  misc_feature (315)..(315): Xaa= any amino acid
  misc_feature (365)..(365): Xaa= any amino acid
  misc_feature (373)..(373): Xaa= any amino acid
  misc_feature (409)..(409): Xaa= any amino acid
  misc_feature (507)..(507): Xaa= any amino acid
  misc_feature (549)..(549): Xaa= any amino acid
  misc_feature (552)..(552): Xaa= any amino acid
  misc_feature (561)..(561): Xaa= any amino acid
  misc_feature (601)..(601): Xaa= any amino acid
  misc_feature (767)..(767): Xaa= any amino acid
  misc_feature (796)..(796): Xaa= any amino acid
  misc_feature (931)..(931): Xaa= any amino acid
  misc_feature (1012)..(1012): Xaa= any amino acid
MFWIVLIVILLLALAGLFFVRAQSEREWMREVSAWQEKKGEKQAELPEIKDGMPDFPELALMLFHAVKTAVYWLFVGVVRFCRNYLAHESEPDRPVPPASANRADVPTASDGYSDSGNGTEEAETEEAEAAEEEAADTEDIATAVIDNRRIPFDRSIAEGLMPSESEISPVRPVFKEITLEEATRALNSAALRETKKRYIDAFEKNETAVPKVRVSDTPMEGLQIIGLDDPVLQRTYSRMFDADKEAFSESADYGFEPYFEKQHPSAFSAVKAENARNAPFRRHAGQGKGQAEAKSPDVSQGQSVSDGTAVRDAXRRVSVNLKEPNKATVSAEARISRLIPESRTVVGKRDVEMPSETENVFTEXVSSVGYGXPVYDETADIHIEEPAAPWDAWVVEPPEVPKVPMPAXDIPPPPPVSEIYNRTYEPPAGFEQVQRSRIAETDHLADDVLNGGWQEETAAIANDGSEGVAERSSGQYLSETEAFGHDSQAVCPFENVPSERPSRRAXDTEADEGAFQSEETGAVSEHLPTTDLLLPPLFNPGATQTEEXLLXNSITIEEKXAEFKVKVKVVDSYSGPVITRYEIEPDVGVRGNSVLNLEKXLARSLGVASIRVVETILGKTCMGLELPNPKRQMIRLSEIFNSPEFAESKSKLTLALGQDITGQPVVTDLGKAPHLLVAGTTGSGKSVGVNAMILSMLFKAAPEDVRMIMIDPKMLELSIYEGIPHLLAPVVTDMKLAANALNWCVNEMEKRYRLMSFMGVRNLAGXNQKIAEAAARGEKIGNPFSLTPDNPEPLXKLPFIVVVVDEFADLMMTAGKKIEELIARLAQKARAAGIHLILATQRPSVDVITGLIKANIPTRIAFQVSSKIDSRTILDQMGAENLLGQGDMLFLPPGTAYPQRVHGAFASDEEVHRVVEYLKQFGEPDYVDDXLSGGMSDDLLGISRSGDGETDPMYDEAVSVVLKTRKASISGVQRALRIGYNRAARLIDQMEAEGIVSAPEHNGNRTILVPXDNA

SEQ ID NO: 493 - DNA, 8 bp, Neisseria gonorrhoeae
  misc_feature (1)..(8): N= Unknown
nnnnnnnn

SEQ ID NO: 494 - protein, 925 aa, Neisseria gonorrhoeae
SEPDRPVPPASANRADVPTASDGYSDSGNGTEEAETEAAEAAEEEAADTEDIATAVIDNRRIPFDRSIAEGLMQSESKTSPVRPVFKEITLEEATRALSSAALRETKKRYIDAFEKNGTAVPKVRVSDTPMEGLQIIGLDDPVLQRTYSRMFDADKEAFSESADYGFEPYFEKQHPSAFSAVKAENARNAPFRRHAGQEKGQAEAKSPDVSQGQSVSDGTAVRDARRRVSVNLKEPNKATVSAEARISRLIPESRTVVGKRDVEMPSETENVFTETVSSVGYGGPVYDEAADIHIEEPAAPDAWVVEPPEVPEVAVPEIDILPPPPVSEIYNRTYEPPAGFEQAQRSRIAETDHLAADVLNGGWQEETAAIADDGSEGAAERSSGQYLSETEAFGHDSQAVCPFEDVPSERPSCRVSDTEADEGAFQSEETGAVSEHLPTTDLLLPPLFNPEATQTEEELLENSITIEEKLAEFKVKVKVVDSYSGPVITRYEIEPDVGVRGNSVLNLEKDLARSLGVASIRVVETIPGKTCMGLELPNPKRQMIRLSEIFNSPEFAESKSKLTLALGQDITGQPVVTDLGKAPHLLVAGTTGSGKSVGVNAMILSMLFKAAPEDVRMIMIDPKMLELSIYEGITHLLAPVVTDMKLAANALNWCVNEMEKRYRLMSFMGVRNLAGFNQKIAEAAARGEKIGNPFSLTPDDPEPLEKLPFIVVVVDEFADLMMTAGKKIEELIARLAQKARAAGIHLILATQRPSVDVITGLIKANIPTRIAFQVSSKIDSRTILDQMGAENLLGQGDMLFLPPGTAYPQRVHGAFASDEEVHRVVEYLKQFGEPDYVDDILSGGGSEELPGIGRSGDGETDPMYDEAVSVVLKTRKASISGVQRALRIGYNRAARLIDQMEAEGIVSAPEHNGNRTILVPLDNA

SEQ ID NO: 495 - DNA, 3045 bp, Neisseria gonorrhoeae
atgttttggatagttttgatcgttattgtgttgcttgcgcttgccggcctgttttttgtccgcgcacaatccgaacgcgagtggatgcgcgaggtttctgcgtggcaggaaaagaaaggggaaaaacaggcggagctgcctgaaatcaaagacggtatgcccgattttcccgagttttccctgatgcttttccatgccgtcaaaacggcagtgtattggctgtttgtcggtgtcgtccgtttctgccgaaactatctggcgcacgaatccgaaccggacaggcccgttccgcctgcttctgcaaaccgtgcggatgttccgaccgcatccgacgggtattcagacagtggaaacgggacggaagaagcggaaacggaagcagcagaagctgcggaggaagaggctgccgatacggaagacattgcaactgccgtaatcgacaaccgccgcatcccattcgaccggagtattgctgaagggttgatgcagtctgaaagcaaaacttcgcccgtccgtccggtttttaaggaaatcactttggaagaagcaacgcgtgctttaagcagcgcggctttaagggaaacgaaaaaacgctatatcgatgcatttgagaaaaacggaacagccgtccccaaagtacgcgtgtccgataccccgatggaagggctgcagattatcggtttggacgaccctgtgcttcaacgcacgtattcccgtatgtttgatgcggacaaagaagcgttttccgagtctgcggattacggatttgagccgtattttgagaagcagcatccgtctgccttttctgcagtcaaagccgaaaatgcacggaatgcgccgttccgccgtcatgcagggcaggagaaagggcaggcggaggcaaaatccccggatgtttcccaagggcagtccgtttcagacggcacagccgtccgcgatgcccgccgccgcgtttccgtcaatttgaaagaaccgaacaaggcaacggtttctgcggaggcgcggatttcgcgcctgattccggaaagtcggacggttgtcgggaaacgggatgtcgaaatgccgtctgaaaccgaaaatgttttcacggaaaccgtttcgtctgtgggatacggcggtccggtttatgatgaagctgccgatatccatattgaagagcctgccgcgcccgatgcttgggtggtcgaaccacccgaagtgccggaggtagccgtacccgaaatcgatattctgccgccgcctcccgtatcggaaatctacaaccgtacctatgagccgccggcaggattcgagcaggcgcaacgcagccgcattgccgaaaccgaccatcttgccgctgatgttttgaatggaggttggcaggaggaaaccgccgctattgcagatgacggcagtgagggtgcggcagagcggtcaagcgggcaatatctgtcggaaaccgaagcgttcgggcatgacagtcaggcggtttgtccgtttgaagatgtgccgtctgaacgcccgtcctgccgggtatcggatacggaagcggatgaaggggcgttccaatcggaagagaccggtgcggtatccgaacacctgccgacaaccgacctgcttctgcctccgctgttcaatcccgaggcgacgcaaaccgaagaagaactgttggaaaacagcatcaccatcgaagaaaaattggcggagttcaaagtcaaggtcaaggttgtcgattcttattccggccccgtgattacgcgttatgaaatcgaacccgatgtcggcgtgcgcggcaattccgttctgaatttggaaaaagacttggcgcgttcgctcggcgtggcttccatccgcgttgtcgaaaccatccccggcaaaacctgcatgggtttggaacttccgaacccgaaacgccaaatgatacgcctgagcgaaattttcaattcgcccgagtttgccgaatccaaatccaagctgacgctcgcgctcggtcaggacattaccggacagcccgtcgtaaccgacttgggcaaagcaccgcatttgctggttgccggcacgaccggttcgggcaaatcggtgggtgtcaacgcgatgattctgtctatgcttttcaaagccgcgccggaagacgtgcgtatgattatgatcgatccgaaaatgctggaattgagcatttacgaaggcatcacgcacctgctcgcccctgtcgttaccgatatgaagctggcggcaaacgcgctgaactggtgtgttaacgaaatggaaaaacgctaccgcctgatgagctttatgggcgtgcgcaatcttgcgggcttcaaccaaaaaatcgccgaagccgcagcaaggggagaaaaaatcggcaatccgttcagcctcacgcccgacgatcccgaacctttggaaaaactgccgtttatcgtggtcgtggtcgatgagtttgccgatttgatgatgacggcaggcaagaaaatcgaagaactgattgcgcgcctcgcccaaaaagcccgcgcggcaggcatccaccttatccttgccacacaacgccccagcgtcgatgtcatcacgggtctgattaaggcgaacatcccgacgcgtatcgcgttccaagtgtccagcaaaatcgacagccgcacgattctcgaccaaatgggcgcggaaaacctgctcggtcagggcgatatgctgttcctgccgccgggtactgcctatccgcagcgcgttcacggcgcgtttgcctcggatgaagaggtgcaccgcgtggtcgaatatctgaagcagtttggcgagccggactatgttgacgatattttgagcggcggcggcagcgaagagctgcccggcatcgggcgcagcggcgacggcgaaaccgatccgatgtacgacgaggccgtatccgttgtcctgaaaacgcgcaaagccagcatttcgggcgtacagcgcgccttgcgcatcggctacaaccgcgccgcgcgtctgattgaccaaatggaagcggaaggcattgtgtccgcaccggaacacaacggcaaccgtacgattctcgtccccttggacaatgcttga

SEQ ID NO: 496 - protein, 1014 aa, Neisseria gonorrhoeae
MFWIVLIVIVLLALAGLFFVRAQSEREWMREVSAWQEKKGEKQAELPEIKDGMPDFPEFSLMLFHAVKTAVYWLFVGVVRFCRNYLAHESEPDRPVPPASANRADVPTASDGYSDSGNGTEEAETEAAEAAEEEAADTEDIATAVIDNRRIPFDRSIAEGLMQSESKTSPVRPVFKEITLEEATRALSSAALRETKKRYIDAFEKNGTAVPKVRVSDTPMEGLQIIGLDDPVLQRTYSRMFDADKEAFSESADYGFEPYFEKQHPSAFSAVKAENARNAPFRRHAGQEKGQAEAKSPDVSQGQSVSDGTAVRDARRRVSVNLKEPNKATVSAEARISRLIPESRTVVGKRDVEMPSETENVFTETVSSVGYGGPVYDEAADIHIEEPAAPDAWVVEPPEVPEVAVPEIDILPPPPVSEIYNRTYEPPAGFEQAQRSRIAETDHLAADVLNGGWQEETAAIADDGSEGAAERSSGQYLSETEAFGHDSQAVCPFEDVPSERPSCRVSDTEADEGAFQSEETGAVSEHLPTTDLLLPPLFNPEATQTEEELLENSITIEEKLAEFKVKVKVVDSYSGPVITRYEIEPDVGVRGNSVLNLEKDLARSLGVASIRVVETIPGKTCMGLELPNPKRQMIRLSEIFNSPEFAESKSKLTLALGQDITGQPVVTDLGKAPHLLVAGTTGSGKSVGVNAMILSMLFKAAPEDVRMIMIDPKMLELSIYEGITHLLAPVVTDMKLAANALNWCVNEMEKRYRLMSFMGVRNLAGFNQKIAEAAARGEKIGNPFSLTPDDPEPLEKLPFIVVVVDEFADLMMTAGKKIEELIARLAQKARAAGIHLILATQRPSVDVITGLIKANIPTRIAFQVSSKIDSRTILDQMGAENLLGQGDMLFLPPGTAYPQRVHGAFASDEEVHRVVEYLKQFGEPDYVDDILSGGGSEELPGIGRSGDGETDPMYDEAVSVVLKTRKASISGVQRALRIGYNRAARLIDQMEAEGIVSAPEHNGNRTILVPLDNA

SEQ ID NO: 497 - DNA, 382 bp, Neisseria meningitidis
atgatttatcaaagaaacctcatcaaagaactctcttttaccgccgtcggcattttcgtcgtcctcttggcggtattggtctccacgcaggcaatcaacctgctcggccgtgccgccgacgggcgtgatcgccatcgatgccgtgttggcattggtcggcttctgggtcattgccatcggtttgtttttaatttaccaaaacgggctgaccctgctttttgaagccgtggaagacggcaaaatccatttttggctcggactgctgcctatgcacattatcatgtttgtccttgcactcatcctgttgcgcgtccgcagtatgcccagccagcccttctggcaggcggttggcaaaagtctgacattgaaaggcggaaaatga

SEQ ID NO: 498 - protein, 127 aa, Neisseria meningitidis
  misc_feature (42)..(42): Xaa= any amino acid
MIYQRNLIKELSFTAVGIFVVLLAVLVSTQAINLLGRAADGXVIAIDAVLALVGFWVIAIGLFLIYQNGLTLLFEAVEDGKIHFWLGLLPMHIIMFVLALILLRVRSMPSQPFWQAVGKSLTLKGGK

SEQ ID NO: 499 - DNA, 1116 bp, Neisseria meningitidis
atgatttatcaaagaaacctcatcaaagaactctcttttaccgccgtcggcattttcgtcgtcctcttggcggtattggtctccacgcaggcaatcaacctgctcggccgtgccgccgacgggcgtgtcgccatcgatgccgtgttggcattggtcggcttctgggtcatcggtatgacgccgcttttgctggtgttgaccgcatttatcagtacgttgaccgtgttgacccgctactggcgcgacagcgaaatgtcggtctggctatcctgcggattggcattgaaacaatggatacgcccggtgatgcagtttgccgtgccgtttgccgttttggttgccgtcatgcagctttgggtgataccgtgggcagagctacgcagccgcgaatacgctgaaatcctgaagcagaagcaggaattgtctttggtggaggcaggcgagttcaacagtttgggcaagcgcaacggcagggtttattttgtcgaaaccttcgataccgaatccggcatcatgaaaaacctgttcctgcgcgaacaggacaaaaacggcggcgacaacatcatcttcgccaaagaaggtaacttctcgctgaacgacaacaaacgcacgctcgaattgcgccacggctaccgttacagcggcacgcccggacgcgccgactacaatcaggtttccttccaaaaactcaacctgattatcagcaccacgcccaaactcatcgaccccgtttcccaccgccgtaccattccgaccgcccaactgattggcagcagcaacccgcaacatcaggcggaattgatgtggcgcatctcgctgaccgtcagcgtcctcctactctgcctgcttgccgtgccgctttcctatttcaacccgcgcagcggacatacctacaatatcttgattgccatcggtttgtttttaatttaccaaaacgggctgaccctgctttttgaagccgtggaagacggcaaaatccatttttggctcggactgctgcctatgcacattatcatgtttgccgttgcactcatcctgttgcgcgtccgcagtatgcccagccagcccttctggcaggcggttggcaaaagtctgacattgaaaggcggaaaatga

SEQ ID NO: 500 - protein, 371 aa, Neisseria meningitidis
MIYQRNLIKELSFTAVGIFVVLLAVLVSTQAINLLGRAADGRVAIDAVLALVGFWVIGMTPLLLVLTAFISTLTVLTRYWRDSEMSVWLSCGLALKQWIRPVMQFAVPFAVLVAVMQLWVIPWAELRSREYAEILKQKQELSLVEAGEFNSLGKRNGRVYFVETFDTESGIMKNLFLREQDKNGGDNIIFAKEGNFSLNDNKRTLELRHGYRYSGTPGRADYNQVSFQKLNLIISTTPKLIDPVSHRRTIPTAQLIGSSNPQHQAELMWRISLTVSVLLLCLLAVPLSYFNPRSGHTYNILIAIGLFLIYQNGLTLLFEAVEDGKIHFWLGLLPMHIIMFAVALILLRVRSMPSQPFWQAVGKSLTLKGGK

SEQ ID NO: 501 - DNA, 1116 bp, Neisseria meningitidis
  misc_feature (110)..(110): N= Unknown
  misc_feature (121)..(121): N= Unknown
  misc_feature (127)..(127): N= Unknown
  misc_feature (169)..(174): N= Unknown
  misc_feature (192)..(192): N= Unknown
  misc_feature (243)..(243): N= Unknown
  misc_feature (265)..(265): N= Unknown
  misc_feature (571)..(571): N= Unknown
  misc_feature (683)..(683): N= Unknown
  misc_feature (747)..(747): N= Unknown
  misc_feature (750)..(750): N= Unknown
  misc_feature (753)..(753): N= Unknown
  misc_feature (756)..(756): N= Unknown
  misc_feature (792)..(792): N= Unknown
  misc_feature (905)..(905): N= Unknown
atgatttatcaaagaaacctcatcaaagaactctcttttaccgccgtcggcattttcgtcgtcctcttggcggtattggtctccacgcaggcaatcaacctgctcggccntgccgccgacnggcgtntcgccatcgatgccgtgttggcattggtcggcttctgggtcnnnngnatgacgccgcttttgctngtgttgaccgcatttatcagtacgttgaccgtgttgacccgctactggcgngacagcgaaatgtcggtctggntatcctgcggattggcattgaaacaatggatacgcccggtgatgcagtttgccgtgccgtttgccgttttggttgccgtcatgcagctttgggtgataccgtgggcagagctacgcagccgcgaatacgctgaaatcctgaagcagaagcaggaattgtctttggtggaggcaggcgggttcaacagtttgggcaagcgcaacggcagggtttattttgtcgaaaccttcgataccgaatccggcatcatgaaaaacctgttcctgcgcgaacaggacaaaaacggcggcgacaacatcatcttcnccaaagaaagtaacttctcgctgaacgacaacaaacgcacgctcgaattgcgccacggctaccgttacagcggcacgcccggacgcgccgactacaatcaggtttccttccnaaaactcaacctgattatcagcaccacgcccaaactcatcgaccccgtttcccaccgccgtacnatnccnacngcccaactgattggcagcagcaacccgcaacatcangcggaattgatgtggcgcatctcgctgaccgtcagcgtcctcctactctgcctgcttgccgtgccgctttcctatttcaacccgcgcagcggacatacctacaatatcttgantgccatcggtttgtttttaatttaccaaaacgggctgaccctgctttttgaagccgtggaagacggcaaaatccatttttggctcggactgctgcctatgcacatcatcatgttcgtcatcgcaatcgtacttctgcgcgtccgcagcatgcccagccagcccttctggcaggcggttggcaaaagtctgacattgaaaggcggaaaatga

SEQ ID NO: 502 - protein, 371 aa, Neisseria meningitidis
  misc_feature (37)..(37): Xaa= any amino acid
  misc_feature (41)..(41): Xaa= any amino acid
  misc_feature (43)..(43): Xaa= any amino acid
  misc_feature (57)..(58): Xaa= any amino acid
  misc_feature (89)..(89): Xaa= any amino acid
  misc_feature (191)..(191): Xaa= any amino acid
  misc_feature (228)..(228): Xaa= any amino acid
  misc_feature (250)..(250): Xaa= any amino acid
  misc_feature (264)..(264): Xaa= any amino acid
  misc_feature (302)..(302): Xaa= any amino acid
MIYQRNLIKELSFTAVGIFVVLLAVLVSTQAINLLGXAADXRXAIDAVLALVGFWVXXMTPLLLVLTAFISTLTVLTRYWRDSEMSVWXSCGLALKQWIRPVMQFAVPFAVLVAVMQLWVIPWAELRSREYAEILKQKQELSLVEAGGFNSLGKRNGRVYFVETFDTESGIMKNLFLREQDKNGGDNIIFXKESNFSLNDNKRTLELRHGYRYSGTPGRADYNQVSFXKLNLIISTTPKLIDPVSHRRTXPTAQLIGSSNPQHXAELMWRISLTVSVLLLCLLAVPLSYFNPRSGHTYNILXAIGLFLIYQNGLTLLFEAVEDGKIHFWLGLLPMHIIMFVIAIVLLRVRSMPSQPFWQAVGKSLTLKGGK

SEQ ID NO: 503 - protein, 8 aa, Neisseria meningitidis
NNNNNNNN

SEQ ID NO: 504 - protein, 362 aa, Neisseria gonorrhoeae
MIYQRNLIKELSFTAVGIFVVLLAVLVSTQAINLLGRAADGRVAIDAVLALVGFWVIGMTPLLLVLTAFISTLTVLTRYWRDSEMSVWLSCGLALKQWIRPVMQFAVPFAILIAVMQLWVIPWAELRSREYAEILKQKQELSLVEAGEFNNLGKRNGRVYFVETFDTESGIMKNLFLREQDKNGGDNIIFAKEGNFSLKDNKRTLELRHGYRYSGTPGRADYNQVSFQKLNLIISTTPKLIDPVSHRRTISTAQLIGSSNPQHQAELMWRISLTVSVLLLCLLAVPLSYFNPRSGHTYNILIAIGLFLIYQNGLTLLFEAVEDGKIHFWLGLLPMHIIMFVIAIVLLRVRSMPSQPFWQAVG

SEQ ID NO: 505 - DNA, 1116 bp, Neisseria gonorrhoeae
atgatttatcaaagaaacctcatcaaagaactctcttttaccgccgtcggcattttcgtcgtcctcttggcggtgttggtgtccacgcaggcgatcaacctgcttggccgcgcagctgacgggcgtgtcgccatcgatgccgtgttggccttagtcggcttctgggtcatcggtatgaccccgcttttgctggtgttgaccgcattcatcagcacgctgaccgtattgacccgctactggcgcgacagcgaaatgtcggtctggctatcctgcggattggcgttgaaacagtggatacgccccgtcatgcagtttgccgtgccgtttgccatcctgattgccgtcatgcagctttgggtgataccgtgggcagagctgcgcagccgcgaatatgccgaaattttgaagcagaagcaggaattgtctttggtggaagccggcgagttcaataacttgggcaagcgcaacggcagggtttatttcgtcgaaacctttgacaccgaatccggcatcatgaaaaacctgttcctgcgcgaacaggacaaaaacggcggcgacaacatcatcttcgccaaagaaggtaacttctcgctgaaggacaacaaacgcacgctcgaattgcgccacggctaccgttacagcggcacgcccggacgcgccgactacaatcaggtttccttccaaaaactcaacctgattatcagcaccacgcccaaacttatcgaccccgtttcccaccgccgcaccatttcgaccgcccaactgattggcagcagcaatccgcaacatcaggcagaattgatgtggcgcatctcgctgaccgtcagcgtcctcctgctctgcctactcgccgtgccgctttcctatttcaacccgcgcagcggacatacctacaatatcttgattgccatcggtttgtttttaatttaccaaaacgggctgaccctgctttttgaagccgtggaagacggcaaaatccatttttggctcggactgctgcctatgcacatcatcatgttcgtcatcgcaatcgtacttctgcgcgtccgcagtatgcccagccagcccttctggcaggcggttggcaaaagtctgacattgaaaggcggaaaatga

SEQ ID NO: 506 - protein, 371 aa, Neisseria gonorrhoeae
MIYQRNLIKELSFTAVGIFVVLLAVLVSTQAINLLGRAADGRVAIDAVLALVGFWVIGMTPLLLVLTAFISTLTVLTRYWRDSEMSVWLSCGLALKQWIRPVMQFAVPFAILIAVMQLWVIPWAELRSREYAEILKQKQELSLVEAGEFNNLGKRNGRVYFVETFDTESGIMKNLFLREQDKNGGDNIIFAKEGNFSLKDNKRTLELRHGYRYSGTPGRADYNQVSFQKLNLIISTTPKLIDPVSHRRTISTAQLIGSSNPQHQAELMWRISLTVSVLLLCLLAVPLSYFNPRSGHTYNILIAIGLFLIYQNGLTLLFEAVEDGKIHFWLGLLPMHIIMFVIAIVLLRVRSMPSQPFWQAVGKSLTLKGGK

SEQ ID NO: 507 - DNA, 407 bp, Neisseria meningitidis
ggtggtggttttatcaatgcttcctgtgccactttgacgacagccaaaccgcaatatcaagcaggagaccttagcgcttttaagataaggcaaggcaatgttgtaatcgccggacacggtttggatgcacgtgataccgattacacacgtattctcagttatcattccaaaatcgatgcacccgtatggggacaagatgttcgtgtcgtcgcgggacaaaacgatgtggccgcaacaggtgatgcacattcgcctattctcaataatgctgctgccaatacgtcaaacaatacagccaacaacggcacacatatccctttatttgcgattgatacaggcaaattaggaggtatgtatgccaacaaaatcaccttgatcagtacggtcgagcaagcaggcattcgtaa

SEQ ID NO: 508 - protein, 135 aa, Neisseria meningitidis
  misc_feature (118)..(118): Xaa= any amino acid
GGGFINASCATLTTAKPQYQAGDLSAFKIRQGNVVIAGHGLDARDTDYTRILSYHSKIDAPVWGQDVRVVAGQNDVAATGDAHSPILNNAAANTSNNTANNGTHIPLFAIDTGKLGGXVCQQNHLDQYGRASRHS

SEQ ID NO: 509 - DNA, 8 bp, Neisseria gonorrhoeae
  misc_feature (1)..(8): N= Unknown
nnnnnnnn

SEQ ID NO: 510 - protein, 263 aa, Neisseria gonorrhoeae; identical to SEQ ID NO: 186

SEQ ID NO: 511 - DNA, 976 bp, Neisseria meningitidis
tcaacgggacatagcgaacaaaattacactttgccgcgagaaatcacacgcaacatttcactgggttcatttgcctatgaatcgcatcgcaaagcattaagccatcatgcgcccagccaaggcactgagttgccgcaaagcaacggtatttcgctaccctatacgtccaattcttttaccccattacccagcagcagcttatacattatcaatcctgtcaataaaggctatcttgttgaaaccgatccacgctttgccaactaccgtcaatggttgggtagtgactatatgctggacagcctcaaactagacccaaacaatttacataaacgtttgggtgatggttattacgagcaacgtttaatcaatgaacaaatcgcagagctgacagggcatcgtcgtttagacggttatcaaaacgacgaagaacaatttaaagccttaatggataatggcgcgactgcggcacgttcgatgaatctcagcgttggcattgcattaagtgccgagcaagtagcgcaactgaccagcgatattgtttggttggtacaaaaagaagttaagcttcctgatggcggcacacaaaccgtattggtgccacaggtttatgtacgcgttaaaaatggcgacatagacggtaaaggtgcattgttgtcaggcagcaatacacaaatcaatgtttcaggcagcctgaaaaactcaggcacgattgcagggcgcaatgcgcttattatcaataccgatacgctagacaatatcggtgggcgtattcatgcgcaaaaatcagcggttacggccacacaagacatcaataatattggcggcatgctttctgccgaacagacattattgctcaacgcaggcaacaacatcaacagccaaagcaccaccgccagcagtcaaaatacacaaggcagcagcacctacctagaccgaatggcaggtatttatatcacaggcaaagaaaaaggtgttt

SEQ ID NO: 512 - protein, 325 aa, Neisseria meningitidis
STGHSEQNYTLPREITRNISLGSFAYESHRKALSHHAPSQGTELPQSNGISLPYTSNSFTPLPSSSLYIINPVNKGYLVETDPRFANYRQWLGSDYMLDSLKLDPNNLHKRLGDGYYEQRLINEQIAELTGHRRLDGYQNDEEQFKALMDNGATAARSMNLSVGIALSAEQVAQLTSDIVWLVQKEVKLPDGGTQTVLVPQVYVRVKNGDIDGKGALLSGSNTQINVSGSLKNSGTIAGRNALIINTDTLDNIGGRIHAQKSAVTATQDINNIGGMLSAEQTLLLNAGNNINSQSTTASSQNTQGSSTYLDRMAGIYITGKEKGV

SEQ ID NO: 513 - DNA, 8 bp, Neisseria gonorrhoeae
  misc_feature (1)..(8): N= Unknown
nnnnnnnn

SEQ ID NO: 514 - protein, 721 aa, Neisseria gonorrhoeae
MLVQTEKDGLHNEQTFGEKKVFSENGKLHNYWRARRKGHDETGHREQNYTLPEEITRDISLGSFAYESHSKALSRHAPSQGTELPQSNRDNIRTAKSNGISLPYTPNSFTPLPGSSLYIINPANKGYLVETDPRFANYRQWLGSDYMLGSLKLDPNNLHKRLGDGYYEQRLINEQIAELTGHRRLDGYQNDEEQFKALMDNGATAARSMNLSVGIALSAEQAAQLTSDIVWLVQKEVKLPDGGTQTVLMPQVYVRVKNGGIDGKGALLSGSNTQINVSGSLKNSGTIAGRNALIINTDTLDNIGGRIHAQKSAVTATQDINNIGGILSAEQTLLLNAGNNINNQSTAKSSQNAQGSSTYLDRMAGIYITGKEKGVLAAQAGKDINIIAGQISNQSDQGQTRLQAGRDINLDTVQTGKYQEIHFDADNHTIRGSTNEVGSSIQTKGDVTLLSGNNLNAKAAEVGSAKGTLAVYAKNDITISSGIHAGQVDDASKHTGRSGGGNKLVITDKAQSHHETAQSSTFEGKQVVLQAGNDANILGSNVISDNGTRIQAGNHVRIGTTQTQSQSETYHQTQKSGLMSAGIGFTIGSKTNTQENQSQSNEHTGSTVGSLKGDTTIVASKHYEQTGSNVSSPEGNNLISTQSMDIGAAQNQLNSKTTQTYEQKGLTVAFSSPVTDLAQQAIAVAHKAAKQFDKAKTTALMPWRLPMQVGRLFKQAKAPKK

SEQ ID NO: 515 - DNA, 2166 bp, Neisseria gonorrhoeae
ttgcttgtgcaaacagaaaaagacggtttgcataacgagcaaacctttggcgagaagaaagtcttcagcgaaaatggtaagttgcacaactactggcgtgcgcgtcgtaaaggacatgatgaaacagggcatcgtgaacaaaattatactttgccggaggaaatcacacgcgacatttcactgggttcatttgcctatgaatcgcatagcaaagcattaagccgtcatgcgcccagccaaggcactgagttgccacaaagtaaccgggataatatccgtactgcgaaaagcaacggtatttcgctaccctatacgcccaattcttttaccccattacccggcagcagcttatacattatcaatcctgccaataaaggctatcttgttgaaaccgatccacgctttgccaactaccgtcaatggttgggtagtgactatatgctgggcagcctcaaactagacccaaacaatttacataaacgtttgggtgatggttattacgagcaacgtttaatcaatgaacaaatcgcagagctgacagggcatcgtcgtttagacggttatcaaaacgacgaagaacaatttaaagccttaatggataatggcgcgactgcggcacgttcgatgaatctcagcgttggcattgcattaagtgccgagcaagcagcgcaactgaccagcgatattgtttggttggtacaaaaagaagttaaacttcctgatggcggcacacaaaccgtattgatgccacaggtttatgtacgcgttaaaaatggcggcatagacggtaaaggtgcattgttgtcaggcagcaatacacaaatcaatgtttcaggcagcctgaaaaactcaggcacgattgcagggcgcaatgcgcttattatcaataccgatacgctagacaatatcggtgggcgtattcatgcgcaaaaatcagcggttacggccacacaagacatcaataatattggcggcattctttctgccgaacagacattattgctcaatgcgggtaacaacatcaacaaccaaagcacggccaagagcagtcaaaatgcacaaggtagcagcacctacctagaccgaatggcaggtatttatatcacaggcaaagaaaaaggtgttttagcagcgcaggcaggcaaagacatcaacatcattgccggtcaaatcagcaatcaatcagatcaagggcaaacccggctgcaggcaggacgcgacattaacctggatacggtacaaaccggcaaatatcaagaaatccattttgatgccgataaccataccatccgaggttcaacgaacgaagtcggcagcagcattcaaacaaaaggcgatgttaccctattgtcagggaataatctcaatgccaaagctgccgaagtcggcagcgcaaaaggcacacttgccgtgtatgctaaaaatgacattactatcagctcaggcatccatgccggccaagttgatgatgcgtccaaacatacaggcagaagcggcggcggtaataaattagtcattaccgataaagcccaaagtcatcacgaaactgctcaaagcagcacctttgaaggcaagcaagttgtattgcaggcaggaaacgatgccaacatccttggcagtaatgttatttccgataatggcacccggattcaagcaggcaatcatgttcgcattggtacaacccaaactcaaagccaaagcgaaacctatcatcaaacccaaaaatcaggattgatgagtgcaggtatcggcttcactattggcagcaagacaaacacacaagaaaaccaatcccaaagcaacgaacatacaggcagtaccgtaggcagcctgaaaggcgataccaccattgttgcaagcaaacactacgaacaaaccggcagcaacgtttccagccctgagggcaacaaccttatcagcacgcaaagtatggatattggcgcagcacaaaaccaattaaacagcaaaaccacccaaacctacgaacaaaaaggcttaacggtggcattcagttcgcccgttaccgatttggcacaacaagcgattgccgtagcacacaaagcagcaaacaagtcggacaaagcaaaaacgaccgcgttaatgccatggcggctgccaatgcaggttggcaggcctatcaaacaggcaaaggcgcacaaaacttag

SEQ ID NO: 516 - protein, 721 aa, Neisseria gonorrhoeae
LLVQTEKDGLHNEQTFGEKKVFSENGKLHNYWRARRKGHDETGHREQNYTLPEEITRDISLGSFAYESHSKALSRHAPSQGTELPQSNRDNIRTAKSNGISLPYTPNSFTPLPGSSLYIINPANKGYLVETDPRFANYRQWLGSDYMLGSLKLDPNNLHKRLGDGYYEQRLINEQIAELTGHRRLDGYQNDEEQFKALMDNGATAARSMNLSVGIALSAEQAAQLTSDIVWLVQKEVKLPDGGTQTVLMPQVYVRVKNGGIDGKGALLSGSNTQINVSGSLKNSGTIAGRNALIINTDTLDNIGGRIHAQKSAVTATQDINNIGGILSAEQTLLLNAGNNINNQSTAKSSQNAQGSSTYLDRMAGIYITGKEKGVLAAQAGKDINIIAGQISNQSDQGQTRLQAGRDINLDTVQTGKYQEIHFDADNHTIRGSTNEVGSSIQTKGDVTLLSGNNLNAKAAEVGSAKGTLAVYAKNDITISSGIHAGQVDDASKHTGRSGGGNKLVITDKAQSHHETAQSSTFEGKQVVLQAGNDANILGSNVISDNGTRIQAGNHVRIGTTQTQSQSETYHQTQKSGLMSAGIGFTIGSKTNTQENQSQSNEHTGSTVGSLKGDTTIVASKHYEQTGSNVSSPEGNNLISTQSMDIGAAQNQLNSKTTQTYEQKGLTVAFSSPVTDLAQQAIAVAHKAANKSDKAKTTALMPWRLPMQVGRPIKQAKAHKT

SEQ ID NO: 517 - DNA, 689 bp, Neisseria meningitidis
tcagggaataacctcaatgccaaagctgccgaagtcagcagcgcaaacggtacactcgctgtgtctgccaataatgacatcaacatcagcgcaggcatcaacacgacccatgttgatgatgcgtccaaacacacaggcagaagcggtggtggcaataaattagtcattaccgataaagcccaaagtcatcacgaaaccgcccaaagcagcacctttgaaggcaagcaagttgtattgcaggcaggaaacgatgccaacatccttggcagcaatgttatttccgataatggcacccagattcaagcaggcaatcatgttcgcattggtacaacccaaactcaaagccaaagcgaaacctatcatcaaacccagaaatcaggattgatgagtgcaggtatcggcttcactattggcagcaagacaaacacacaagaaaaccaatcccaaagcaacgaacatacaggcagtaccgtaggcagcttgaaaggcgataccaccattgttgcaggcaaacactacgaacaaatcggcagtaccgtttccagcccggaaggcaacaataccatctatgcccaaagcatagacattcaagcggcacacaacaaattaaacagtaataccacccaaacctatgaacaaaaaggctaacggtggcattcagttcgcccgttaccgatttggcacaacaa

SEQ ID NO: 518 - protein, 230 aa, Neisseria meningitidis
  misc_feature (215)..(215): Xaa= any amino acid
SGNNLNAKAAEVSSANGTLAVSANNDINISAGINTTHVDDASKHTGRSGGGNKLVITDKAQSHHETAQSSTFEGKQVVLQAGNDANILGSNVISDNGTQIQAGNHVRIGTTQTQSQSETYHQTQKSGLMSAGIGFTIGSKTNTQENQSQSNEHTGSTVGSLKGDTTIVAGKHYEQIGSTVSSPEGNNTIYAQSIDIQAAHNKLNSNTTQTYEQKXLTVAFSSPVTDLAQQ

SEQ ID NO: 519 - DNA, 8 bp, Neisseria gonorrhoeae
  misc_feature (1)..(8): N= Unknown
nnnnnnnn

SEQ ID NO: 520 - protein, 721 aa, Neisseria gonorrhoeae
LLVQTEKDGLHNEQTFGEKKVFSENGKLHNYWRARRKGHDETGHREQNYTLPEEITRDISLGSFAYESHSKALSRHAPSQGTELPQSNRDNIRTAKSNGISLPYTPNSFTPLPGSSLYIINPANKGYLVETDPRFANYRQWLGSDYMLGSLKLDPNNLHKRLGDGYYEQRLINEQIAELTGHRRLDGYQNDEEQFKALMDNGATAARSMNLSVGIALSAEQAAQLTSDIVWLVQKEVKLPDGGTQTVLMPQVYVRVKNGGIDGKGALLSGSNTQINVSGSLKNSGTIAGRNALIINTDTLDNIGGRIHAQKSAVTATQDINNIGGILSAEQTLLLNAGNNINNQSTAKSSQNAQGSSTYLDRMAGIYITGKEKGVLAAQAGKDINIIAGQISNQSDQGQTRLQAGRDINLDTVQTGKYQEIHFDADNHTIRGSTNEVGSSIQTKGDVTLLSGNNLNAKAAEVGSAKGTLAVYAKNDITISSGIHAGQVDDASKHTGRSGGGNKLVITDKAQSHHETAQSSTFEGKQVVLQAGNDANILGSNVISDNGTRIQAGNHVRIGTTQTQSQSETYHQTQKSGLMSAGIGFTIGSKTNTQENQSQSNEHTGSTVGSLKGDTTIVASKHYEQTGSNVSSPEGNNLISTQSMDIGAAQNQLNSKTTQTYEQKGLTVAFSSPVTDLAQQAIAVAHKAAKQFDKAKTTALMPWRLPMQVGRLFKQAKAPKK

SEQ ID NO: 521 - DNA, 2166 bp, Neisseria gonorrhoeae; identical to SEQ ID NO: 515

SEQ ID NO: 522 - protein, 721 aa, Neisseria gonorrhoeae; identical to SEQ ID NO: 516

SEQ ID NO: 523 - DNA, 525 bp, Neisseria meningitidis
atgatttacatcgtactgtttctagctgtcgtcctcgccgttgtcgcctacaacatgtatcaggaaaaccaataccgcaaaaaagtgcgcgaccagttcggacactccgacaaagatgccctgctcaacagcawaaccagccatgtccgcgacggcaaaccgtccggcgggtcagtcatgatgccgaaaccccaaccggcggtcaaaaaaacggcaaaaccccaagaccccgycatgcgcaacctgcaagaacaggatgccgtctacatcgccaagcagaaacaggcaaaagcctccccgttcaaaaccgaaatcgaaaccgccttggaagaaagcggcattatcggcaactccgcccacaccgtttccgaaccccaaaccggacattccgcaacgaaacctgccgacgcgtcggcaaaacctgcacccgttccgcaaacacctgcaaaaccgctgattacgctcaaagaactgtcaaaagtcgaattatcctggtttgacgtgcgcatcgacttcatctcctat

SEQ ID NO: 524 - protein, 175 aa, Neisseria meningitidis
  misc_feature (45)..(45): Xaa= any amino acid
  misc_feature (78)..(78): Xaa= any amino acid
MIYIVLFLAVVLAVVAYNMYQENQYRKKVRDQFGHSDKDALLNSXTSHVRDGKPSGGSVMMPKPQPAVKKTAKPQDPXMRNLQEQDAVYIAKQKQAKASPFKTEIETALEESGIIGNSAHTVSEPQTGHSATKPADASAKPAPVPQTPAKPLITLKELSKVELSWFDVRIDFISY

SEQ ID NO: 525 - DNA, 1287 bp, Neisseria meningitidis
atgatttacatcgtactgtttctagctgtcgtcctcgccgttgtcgcctacaacatgtatcaggaaaaccaataccgcaaaaaagtgcgcgaccagttcggacactccgacaaagatgccctgctcaacagcaaaaccagccatgtccgcgacggcaaaccgtccggcgggtcagtcatgatgccgaaaccccaaccggcggtcaaaaaaacggcaaaaccccaagaccccgccatgcgcaacctgcaagaacaggatgccgtctacatcgccaagcagaaacaggcaaaagcctccccgttcaaaaccgaaatcgaaaccgccttggaagaaagcggcattatcggcaactccgcccacaccgtttccgaaccccaaaccggacattccgcaccgaaacctgccgacgcgccggcaaaacctgcacccgttccgcaaacacctgcaaaaccgctgattacgctcaaagaactgtcaaaagtcgaattaccctggtttgacgtgcgcttcgacttcatctcctatatcgcgctgaccgaagccaaagaactgcacgcactgccgcgcctttccaaccgctgccgctaccagattgtcggctgcaccatggacgaccatttccagattgccgaacccatcccgggcatccgctatcaggcatttatcgtgggtattcaggcagtcagccgcaacggacttgcctcgcaggaagaactctccgcattcaaccgccaggtggacgcattcgcacaaagcatgggcggtcagacgctgcacaccgaccttgccgcctttatcgaagtggcttccgcactggacgcattctgcgcgcgcgtcgaccagaccatcgccatccatttggtttccccgaccagcatcagcggcgtagaactgcgttccgccgtaacgggcgtgggtttcgttttggaagacgacggcgcgttccactataccgacacgtcgggctcgaccatgttctccatctgctcgctcaacaacgagccgtttaccaacgcccttttggacaaccagtcctacaaaggcttcagtatgctgctcgacatcccgcactctccggcaggcgaaaaaaccttcgacgatttgtttatggatttggcggtacgcctgtccggccagttgaacctgaatctggtcaacgacaaaatggaagaagtttcgacccaatggctcaaagacgtgcgcacttatgtattggcgcgtcagtccgagatgctcaaagtcggtatcgaaccgggcggcaaaaccgcattgcgcctgttctcctaa

SEQ ID NO: 526 - protein, 428 aa, Neisseria meningitidis
MIYIVLFLAVVLAVVAYNMYQENQYRKKVRDQFGHSDKDALLNSKTSHVRDGKPSGGSVMMPKPQPAVKKTAKPQDPAMRNLQEQDAVYIAKQKQAKASPFKTEIETALEESGIIGNSAHTVSEPQTGHSAPKPADAPAKPAPVPQTPAKPLITLKELSKVELPWFDVRFDFISYIALTEAKELHALPRLSNRCRYQIVGCTMDDHFQIAEPIPGIRYQAFIVGIQAVSRNGLASQEELSAFNRQVDAFAQSMGGQTLHTDLAAFIEVASALDAFCARVDQTIAIHLVSPTSISGVELRSAVTGVGFVLEDDGAFHYTDTSGSTMFSICSLNNEPFTNALLDNQSYKGFSMLLDIPHSPAGEKTFDDLFMDLAVRLSGQLNLNLVNDKMEEVSTQWLKDVRTYVLARQSEMLKVGIEPGGKTALRLFS

SEQ ID NO: 527 - DNA, 1287 bp, Neisseria meningitidis
atgatttacatcgtactgttcctcgccgccgtcctcgccgttgtcgcctacaatatgtatcaggaaaaccaataccgcaaaaaagtgcgcgaccagttcgggcactccgacaaagatgccctgctcaacagcaaaaccagccatgtccgcgacggcaaaccgtccggcgggccagtcatgatgccgaaaccccaaccggcggtcaaaaaaacggcaaaatcccaagaccccgccatgcgcaacctgcaagagcaggatgccgtctacatcgccaagcagaaacaggcaaaagcctccccgttcaaaaccgaaatcgaaaccgccttggaagaaagcggcattatcggcaactccgcccacaccgttcccgaaccccaaaccggacattccgcaccaaaacctgccgacgcgccggcaaaacctgttcccgttccgcaaacgccggcaaaaccgctgattacgctcaaagagctgtcgaaggtcgagctgccctggtttgacgtgcgcttcgacttcatctcttatatcgcgctgaccgaagccaaagaactgcacgcactgccgcgcctttccaaccgctgccgctaccagattgtcggctgcaccatggacgaccatttccagattgccgaacccatcccgggcatccgctatcaggcatttatcgtgggtattcaggcagtcagccgcaacggacttgcctcgcaggaagaactctccgcattcaaccgccaggtggatgcattcgcacacagcatgggcggtcagacgctgcacaccgaccttgccgcctttatcgaagtggcttccgcactggacgcattctgcgcgcgcgtcgaccagactatcgccatccatttggtttccccgaccagcatcagcggcgtagaactgcgttccgccgtaacgggcgtgggtttcgttttggaagacgacggcgcgttccactataccgacacgtcgggctcgaccatgttctccatctgctcgctcaacaacgagccgtttaccaatgcccttttggacaaccagtcctataaaggcttcagtatgctgctcgacatcccgcactctccggcaggcgaaaaaaccttcgacgatttgtttatggatttggcggtacgcctgtccggccagttgaacctgaatctggtcaacgacaaaatggaagaagtttcgacccaatggctcaaagacgtgcgcacttatgtattggctcgtcagtccgagatgctcaaagtcggtatcgaaccgggcggcaaaaccgcattgcgcctgttctcctaa

SEQ ID NO: 528 - protein, 428 aa, Neisseria meningitidis
MIYIVLFLAAVLAVVAYNMYQENQYRKKVRDQFGHSDKDALLNSKTSHVRDGKPSGGPVMMPKPQPAVKKTAKSQDPAMRNLQEQDAVYIAKQKQAKASPFKTEIETALEESGIIGNSAHTVPEPQTGHSAPKPADAPAKPVPVPQTPAKPLITLKELSKVELPWFDVRFDFISYIALTEAKELHALPRLSNRCRYQIVGCTMDDHFQIAEPIPGIRYQAFIVGIQAVSRNGLASQEELSAFNRQVDAFAHSMGGQTLHTDLAAFIEVASALDAFCARVDQTIAIHLVSPTSISGVELRSAVTGVGFVLEDDGAFHYTDTSGSTMFSICSLNNEPFTNALLDNQSYKGFSMLLDIPHSPAGEKTFDDLFMDLAVRLSGQLNLNLVNDKMEEVSTQWLKDVRTYVLARQSEMLKVGIEPGGKTALRLFS

SEQ ID NO: 529 - DNA, 1287 bp, Neisseria gonorrhoeae
atgatttacatcgtactgttcctcgccgccgtcctcgccgttgtcgcctacaatatgtatcaggaaaaccaataccgcaaaaaagtgcgcgaccagttcggacactccgacaaagatgccctgctcaacagcaaaaccagccatgtccgcgacggcaaaccgtccggcgggccagtcatgatgccgaaaccccaaccggcggtcaaaaaaccggccaaaccccaagactccgccatgcgcaacctgcaagaacaggatgccgtctacatcgccaagcagaaacaggcaaaagcctccccgttcaaaaccgaaatcgaaaccgccttggaagaaatcggcattatcggcaactccgcccacaccgtttccgaaccccaaaccggacattccgcaccgaaacctgccgacgcgccggcaaaacccgttcccgttccgcaaacgccggcaaaaccgctgattacgctcaaagagctgtcgaaggtcgagctgccctggtttgacgtgcgcttcgacttcatctcctatatcgcgctgaccgaagccaaagaactgcacgcactgccgcgcctttccaaccgctgccgctaccagattgtcggctgcaccatggacgaccatttccagattgccgaacccatcccgggcatccgctatcaggcatttatcgtgggtatccaggcagtcagccgcaacggacttgcctcgcaggaagaactctccgcattcaaccgccaggcggacgcattcgcacaaagcatgggcggtcagacgctgcacaccgaccttgccgcctttatcgaagtggcttccgcactggacgcattctgcgcgcgcgtcgaccagaccatcgccatccatttggtttcgccgaccagcatcagcggcgtagaactgcgttccgccgtaacgggcgtgggtttcgttttggaagacgacggcgcgttccactataccgacacgtcgggctcgaccatgttctccatctgctcgctcaacaacgagccgtttaccaatgcccttttggacaaccagtcctacaaaggcttcagtatgctgctcgacatcccgcactctccggcaggcgaaaaaaccttcgacgatttgtttatggatttggcggtacgcctgtccggtcagttgaacctgaatctggtcaacgacaaaatggaagaagtttcgacccaatggctcaaagacgtacgcacttatgtattggcgcgtcagtccgagatgctcaaagtcggtatcgaaccgggcggcaaaaccgccctgcgcctgttttcataa

SEQ ID NO: 530 - protein, 428 aa, Neisseria gonorrhoeae
MIYIVLFLAAVLAVVAYNMYQENQYRKKVRDQFGHSDKDALLNSKTSHVRDGKPSGGPVMMPKPQPAVKKPAKPQDSAMRNLQEQDAVYIAKQKQAKASPFKTEIETALEEIGIIGNSAHTVSEPQTGHSAPKPADAPAKPVPVPQTPAKPLITLKELSKVELPWFDVRFDFISYIALTEAKELHALPRLSNRCRYQIVGCTMDDHFQIAEPIPGIRYQAFIVGIQAVSRNGLASQEELSAFNRQADAFAQSMGGQTLHTDLAAFIEVASALDAFCARVDQTIAIHLVSPTSISGVELRSAVTGVGFVLEDDGAFHYTDTSGSTMFSICSLNNEPFTNALLDNQSYKGFSMLLDIPHSPAGEKTFDDLFMDLAVRLSGQLNLNLVNDKMEEVSTQWLKDVRTYVLARQSEMLKVGIEPGGKTALRLFS

SEQ ID NO: 531 - DNA, 464 bp, Neisseria meningitidis
gcgcggcacggcacggaagatttcttcatgaacaacagcgacacatcaggcagatagtcgaaagcaccaccggtacgatgaagctgctgatttcctccatcgccctgatttcattggtagtcggcggcatcggcgtgatgaacatcatgctggtgtccgttaccgagcgcaccaaagaaatcggcatacggatggcaatcggcgcgcggcgcggcaatatttygcagcagtttttgattgaggcggtgttaatctgcgtcatcggcggtttggtcggcgtgggtttgtccgccgccgtcagcctcgtgttcaatcattttgtaaccgacttcccgatggacatttccgccatgtccgtcatcggcgcggtcgcctgttcgaccggaatcggcatcgcgttcggctttatgcctgccaataaagcagccaaactcaatccgatagacgcattggcacaggattga

SEQ ID NO: 532 - protein, 154 aa, Neisseria meningitidis
  misc_feature (15)..(15): Xaa= any amino acid
  misc_feature (75)..(75): Xaa= any amino acid
ARHGTEDFFMNNSDXIRQIVESTTGTMKLLISSIALISLVVGGIGVMNIMLVSVTERTKEIGIRMAIGARRGNIXQQFLIEAVLICVIGGLVGVGLSAAVSLVFNHFVTDFPMDISAMSVIGAVACSTGIGIAFGFMPANKAAKLNPIDALAQD

SEQ ID NO: 533 - DNA, 1167 bp, Neisseria meningitidis
atgtcggtgcaagcagtattggcgcacaaaatgcgttcgcttctgacgatgctcggcatcatcatcggtatcgcgtcggtggtttccgtcgtcgcattgggcaatggttcgcagaaaaaaatccttgaagacatcagttcgatagggacgaacaccatcagcatcttcccggggcgcggcttcggcgacaggcgcagcggcaggattaaaaccctgaccatagacgacgcaaaaatcatcgccaaacaaagctacgttgcttccgccacgcccatgacttcgagcggcggcacgctgacttaccgcaacaccgacctgaccgcctcgctttacggcgtgggcgaacaatatttcgacgtgcgcggactgaagctggaaacggggcggctgtttgacgaaaacgatgtgaaagaagacgcgcaggtcgtcgtcatcgaccaaaatgtcaaagacaaactctttgcggactcggatccgttgggtaaaaccattttgttcaggaaacgccccttgaccgtcatcggcgtgatgaaaaaagacgaaaacgctttcggcaattccgacgtgctgatgctttggtcgccctatacgacggtgatgcaccaaatcacaggcgagagccacaccaactccatcaccgtcaaaatcaaagacaatgccaatacccaggttgccgaaaaagggctgaccgatctgctcaaagcgcggcacggcacggaagatttcttcatgaacaacagcgacagcatcaggcagatagtcgaaagcaccaccggtacgatgaagctgctgatttcctccatcgccctgatttcattggtagtcggcggcatcggcgtgatgaacatcatgctggtgtccgttaccgagcgcaccaaagaaatcggcatacggatggcaatcggcgcgcggcgcggcaatattttgcagcagtttttgattgaggcggtgttaatctgcgtcatcggcggtttggtcggcgtgggtttgtccgccgccgtcagcctcgtgttcaatcattttgtaaccgacttcccgatggacatttccgccatgtccgtcatcggcgcggtcgcctgttcgaccggaatcggcatcgcgttcggctttatgcctgccaataaagcagccaaactcaatccgatagacgcattggcacaggattga

SEQ ID NO: 534 - protein, 388 aa, Neisseria meningitidis
MSVQAVLAHKMRSLLTMLGIIIGIASVVSVVALGNGSQKKILEDISSIGTNTISIFPGRGFGDRRSGRIKTLTIDDAKIIAKQSYVASATPMTSSGGTLTYRNTDLTASLYGVGEQYFDVRGLKLETGRLFDENDVKEDAQVVVIDQNVKDKLFADSDPLGKTILFRKRPLTVIGVMKKDENAFGNSDVLMLWSPYTTVMHQITGESHTNSITVKIKDNANTQVAEKGLTDLLKARHGTEDFFMNNSDSIRQIVESTTGTMKLLISSIALISLVVGGIGVMNIMLVSVTERTKEIGIRMAIGARRGNILQQFLIEAVLICVIGGLVGVGLSAAVSLVFNHFVTDFPMDISAMSVIGAVACSTGIGIAFGFMPANKAAKLNPIDALAQD

SEQ ID NO: 535 - DNA, 1167 bp, Neisseria meningitidis
atgtcggtgcaagcagtattggcgcacaaaatgcgttcgcttctgacgatgctcggcatcatcatcggtatcgcttcggttgtctccgtcgtcgcattgggcaacggttcgcagaaaaaaatccttgaagacatcagttcgatagggacgaacaccatcagcatcttcccagggcgcggcttcggcgacaggcgcagcggcaggattaaaaccctgaccatagacgacgcaaaaatcatcgccaaacaaagctacgttgcttccgccacgcccatgacttcgagcggcggcacgctgacttaccgcaataccgacctgaccgcttctttgtacggtgtgggcgaacaatatttcgacgtgcgcgggctgaagctggaaacggggcggctgtttgacgaaaacgatgtgaaagaagacgcgcaggtcgtcgtcatcgaccaaaatgtcaaagacaaactctttgcggactcggatccgttgggtaaaaccattttgttcaggaaacgccccttgaccgtcatcggcgtgatgaaaaaagacgaaaacgctttcggcaattccgacgtgctgatgctttggtcgccctatacgacggtgatgcaccaaatcacaggcgagagccacaccaactccatcaccgtcaaaatcaaagacaatgccaatacccaggttgccgaaaaagggctgaccgatctgctcaaagcgcggcacggcacggaagatttcttcatgaacaacagcgacagcatcaggcagatagtcgaaagcaccaccggtacgatgaagctgctgatttcctccatcgccctgatttcattggtagtcggcggcatcggcgtgatgaacatcatgctggtgtccgttaccgagcgcaccaaagaaatcggcatacggatggcaatcggcgcgcggcgcggcaatattttgcagcagtttttgattgaggcggtgttaatctgcgtcatcggcggtttggtcggcgtgggtttgtccgccgccgtcagcctcgtgttcaatcattttgtaaccgacttcccgatggacatttccgccatgtccgtcatcggcgcggtcgcctgttcgaccggaatcggcatcgcgttcggctttatgcctgccaataaagcagccaaactcaatccgatagatgcattggcgcaggattga

SEQ ID NO: 536 - protein, 388 aa, Neisseria meningitidis; identical to SEQ ID NO: 534

SEQ ID NO: 537 - DNA, 1167 bp, Neisseria gonorrhoeae
atgtcggtgcaagcagtattggcgcacaaaatgcgttcgcttctgaccatgctcggcatcatcatcggtatcgcttcggttgtctccgtcgtcgcgctgggcaacggttcgcagaaaaaaatcctcgaagacatcagttcgatggggacgaacaccatcagcatcttccccgggcgcggcttcggcgacaggcgcagcggcaaaatcaaaaccctgaccatagacgacgcaaaaatcatcgccaaacaaagctacgttgcctccgccacgcccatgacttcgagcggcggcacgctgacctaccgcaataccgacctgaccgcttctttgtacggtgtgggcgaacaatatttcgacgtgcgcgggctgaagctggaaacggggcggctgtttgatgagaacgatgtgaaagaagacgcgcaagtcgtcgtcatcgaccaaaatgtcaaagacaaactctttgcggactcggatccgttgggtaaaaccattttgttcaggaaacgccccttgaccgtcatcggcgtgatgaaaaaagacgaaaacgctttcggcaattccgacgtgctgatgctttggtcgccctatacgacggtgatgcaccaaatcacaggcgagagccacaccaactccatcaccgtcaaaatcaaagacaatgccaatacccgggttgccgaaaaagggctggccgagctgctcaaagcacggcacggcacggaagacttctttatgaacaacagcgacagcatcaggcagatggtcgaaagcaccaccggtacgatgaagctgctgatttcctccatcgccctgatttcattggtagtcggcggcatcggtgtgatgaacattatgctggtgtccgttaccgagcgcaccaaagaaatcggcatacggatggcaatcggcgcgcggcgcggcaatattttgcagcagtttttgattgaggcggtgttaatctgcatcatcggaggcttggtcggcgtaggtttgtccgccgccgtcagcctcgtgttcaatcattttgtaaccgatttcccgatggacatttcggcggcatccgttatcggggcggtcgcctgttcgaccggaatcggcatcgcgttcggctttatgcctgccaataaggcagccaaactcaatccgatagatgcattggcgcaggattga

SEQ ID NO: 538 - protein, 388 aa, Neisseria gonorrhoeae
MSVQAVLAHKMRSLLTMLGIIIGIASVVSVVALGNGSQKKILEDISSMGTNTISIFPGRGFGDRRSGKIKTLTIDDAKIIAKQSYVASATPMTSSGGTLTYRNTDLTASLYGVGEQYFDVRGLKLETGRLFDENDVKEDAQVVVIDQNVKDKLFADSDPLGKTILFRKRPLTVIGVMKKDENAFGNSDVLMLWSPYTTVMHQITGESHTNSITVKIKDNANTRVAEKGLAELLKARHGTEDFFMNNSDSIRQMVESTTGTMKLLISSIALISLVVGGIGVMNIMLVSVTERTKEIGIRMAIGARRGNILQQFLIEAVLICIIGGLVGVGLSAAVSLVFNHFVTDFPMDISAASVIGAVACSTGIGIAFGFMPANKAAKLNPIDALAQD

SEQ ID NO: 539 - DNA, 606 bp, Neisseria meningitidis
gggacgggagcgatgctgctgctgttttacgcggtaacgatctgcctttggccactggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcgtcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctgggcgaagagcttttctggcaggaaatactcggtatgtgcatcatcatcctcagcggtattttga

SEQ ID NO: 540 - protein, 201 aa, Neisseria meningitidis
GTGAMLLLFYAVTILPLATGVTLSYTSSIFLAVFSFLILKERISVYTQAVLLLGFAGVVLLLNPSFRSGQETAALAGLAGGAMSGWAYLKVRELSLAGEPGWRVVFYLSVTGVAMSSVWATLTGWHTLSFPSAVYLSCIGVSALIAQLSMTRAYKVGDKFTVASLSYMTVVFSALSAAFFLGEELFWQEILGMCIIISAVF

SEQ ID NO: 541 - DNA, 903 bp, Neisseria meningitidis
atggataccgcaaaaaaagacattttaggatcgggctggatgctggtggcggcggcctgctttaccattatgaacgtattgattaaagaggcatcggcaaaatttgccctcggcagcggcgaattggtcttttggcgcatgctgttttcaaccgttgcgctcggggctgccgccgtattgcgtcgggacamcttccgcacgccccattggaaaaaccacttaaaccgcagtatggtcgggacgggggcgatgctgctgctgttttacgcggtaacgcatctgcctttggccactggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcgtcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctgggcgaagagcttttctggcaggaaatactcggtatgtgcatcatcatcctcagcggtattttgagcagcatccgccccactgccttcaaacagcggctgcaatccctgttccgccaaagataa

SEQ ID NO: 542 - protein, 300 aa, Neisseria meningitidis
  misc_feature (64)..(64): Xaa= any amino acid
MDTAKKDILGSGWMLVAAACFTIMNVLIKEASAKFALGSGELVFWRMLFSTVALGAAAVLRRDXFRTPHWKNHLNRSMVGTGAMLLLFYAVTHLPLATGVTLSYTSSIFLAVFSFLILKERISVYTQAVLLLGFAGVVLLLNPSFRSGQETAALAGLAGGAMSGWAYLKVRELSLAGEPGWRVVFYLSVTGVAMSSVWATLTGWHTLSFPSAVYLSCIGVSALIAQLSMTRAYKVGDKFTVASLSYMTVVFSALSAAFFLGEELFWQEILGMCIIILSGILSSIRPTAFKQRLQSLFRQR

SEQ ID NO: 543 - DNA, 903 bp, Neisseria meningitidis
atggataccgcaaaaaaagacattttaggatcgggctggatgctggtggcggcggcctgctttaccattatgaacgtattgattaaagaggcatcggcaaaatttgccctcggcagcggcgaattggtcttttggcgcatgctgttttcaaccgttgcgctcggggctgccgccgtattgcgtcgggacaccttccgcacgccccattggaaaaaccacttaaaccgcagtatggtcgggacgggggcgatgctgctgctgttttacgcggtaacgcatctgcctttggccaccggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcatcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctggccgaagagcttttctggcaggaaatactcggtatgtgcatcatcatcctcagcggtattttgagcagcatccgccccactgccttcaaacagcggctgcaatccctgttccgccaaagataa

SEQ ID NO: 544 - protein, 300 aa, Neisseria meningitidis
MDTAKKDILGSGWMLVAAACFTIMNVLIKEASAKFALGSGELVFWRMLFSTVALGAAAVLRRDTFRTPHWKNHLNRSMVGTGAMLLLFYAVTHLPLATGVTLSYTSSIFLAVFSFLILKERISVYTQAVLLLGFAGVVLLLNPSFRSGQETAALAGLAGGAMSGWAYLKVRELSLAGEPGWRVVFYLSVTGVAMSSVWATLTGWHTLSFPSAVYLSCIGVSALIAQLSMTRAYKVGDKFTVASLSYMTVVFSALSAAFFLAEELFWQEILGMCIIILSGILSSIRPTAFKQRLQSLFRQR

SEQ ID NO: 545 - DNA, 8 bp, Neisseria gonorrhoeae
  misc_feature (1)..(8): N= Unknown
nnnnnnnn

SEQ ID NO: 546 - protein, 506 aa, Neisseria gonorrhoeae
MPSEKAFRRHLRTASFQGLHLHHFHQKVGKCGIIGFGIHIFPTLLPAAQGILDIQLGLFRIDFAALAVYRRTQVDFIHTVIDGIASDQAFSEVVQILRRLNLGHFTDTHLIAQARRFIADFGNIRPMRRGEAKTFCRCFRFDGIDGIHGDFRQCGHINRLAPGKDCRNGKRDKVFFHTRHYNQVCLEKTNCSARKIKFRHQKQAKTHSTSLAARFTIRPSLSQRPFMDTAKKDILGSGWMLVAAACFTVMNVLIKEASAKFALGSGELVFWRMLFSTVTLGAAAVLRRDTFRTPHWKNHLNRSMVGTGAMLLLFYAVTHLPLTTGVTLSYTSSIFLAVFSFLILKERISVYTQAVLLLGFAGVVLLLNPSFRSGQEPAALAGLAGGAMSGWAYLKVRELSLAGEPGWRVVFYLSATGVAMSSVWATLTGWHTLSFPSAVYLSGIGVSALIAQLSMTRAYKVGDKFTVASLSYMTVVFSALSAAFFLGEELFWQEILGMCIIISAAF

SEQ ID NO: 547 - DNA, 903 bp, Neisseria gonorrhoeae
atggataccgcaaaaaaagacattttaggatcgggctggatgctggtggcggcggcctgcttcaccgttatgaacgtattgattaaagaggcatcggcaaaatttgccctcggcagcggcgaattggtcttttggcgcatgctgttttcaaccgttacgctcggtgctgccgccgtattgcggcgcgacaccttccgcacgccccattggaaaaaccacttaaaccgcagtatggtcgggacgggggcgatgctgctgctgttttacgcggtaacgcatctgcctttgacaaccggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaccggcggcactcgccgggctggcgggcggcgcgatgtccggctgggcgtatttgaaagtgcgcgaactgtctttggcgggcgaacccggctggcgcgtcgtgttttacctttccgcaaccggcgtggcgatgtcgtcggtttgggcgacgctgaccggctggcacaccctgtcctttccatcggcagtttatctgtcgggcatcggcgtgtccgcgctgattgcccaactgtcgatgacgcgcgcctacaaagtcggcgacaaattcacggttgcctcgctttcctatatgaccgtcgtcttttccgccctgtctgccgcattttttctgggcgaagagcttttctggcaggaaatactcggtatgtgcatcattatcctcagcggcattttgagcagcatccgccccattgccttcaaacagcggctgcaagccctcttccgccaaagataa

SEQ ID NO: 548 - protein, 300 aa, Neisseria gonorrhoeae
MDTAKKDILGSGWMLVAAACFTVMNVLIKEASAKFALGSGELVFWRMLFSTVTLGAAAVLRRDTFRTPHWKNHLNRSMVGTGAMLLLFYAVTHLPLTTGVTLSYTSSIFLAVFSFLILKERISVYTQAVLLLGFAGVVLLLNPSFRSGQEPAALAGLAGGAMSGWAYLKVRELSLAGEPGWRVVFYLSATGVAMSSVWATLTGWHTLSFPSAVYLSGIGVSALIAQLSMTRAYKVGDKFTVASLSYMTVVFSALSAAFFLGEELFWQEILGMCIIILSGILSSIRPIAFKQRLQALFRQR

SEQ ID NO: 549 - DNA, 706 bp, Neisseria meningitidis
atgaagcggcgtatagccgtcttcgtcctgttcccgcagataatccgagttttgggacaactgttgccgaaaatcgtcaatacagttccggcacatcggatgctcttccagattttcgggatgttctttttcttcatacaccagcaatatctgcccgggatcgccgaaatcgattccccatgcggcatcgtgttcggtgcgctcctcttccgtcatctgcccgcgcattgcctgtatggtaaagccgccgtaggggatgccgttgcacacgaacatccagtcgctgatgtcgtcaaccggaacgcaaacgctttcgccttgttcgacattggtcagttcgccsggttcattgttcagcacaccgtaaatataaagaccgtcaaaataaatatcgtcgatccacatatgttcgcaaatttcgccgtcttcgccgtcttggaaaaaagggactttgaccatggcaaaatccaaggcggaaataatgcggcggcgttcccaaaaaagctcgcgccaaaaatatttgaatgttttacgggcgcgttcgtcggcacggtttaccggttcgtctgcctgttctacataataaatgacggaatcgcccatcatatctgctcctcaacgtgtacggtatctgtttgcaccttactgcggctttctgccktcggcatccgattcggatttgaaaagttcmmrwyattcggaatag

SEQ ID NO: 550 - protein, 234 aa, Neisseria meningitidis
  misc_feature (115)..(115): Xaa= any amino acid
  misc_feature (231)..(232): Xaa= any amino acid
MKRRIAVFVLFPQIIRVLGQLLPKIVNTVPAHRMLFQIFGMFFFFIHQQYLPGIAEIDSPCGIVFGALLFRHLPAHCLYGKAAVGDAVAHEHPVADVVNRNANAFALFDIGQFAXFIVQHTVNIKTVKINIVDPHMFANFAVFAVLEKRDFDHGKIQGGNNAAAFPKKLAPKIFECFTGAFVGTVYRFVCLFYIINDGIAHHSAPQRVRYLFAPYCGFLPSASDSDLKSSXXSE

SEQ ID NO: 551 - DNA, 708 bp, Neisseria meningitidis
atgatgaagcggcgtatagccgtcttcgtcctgttcccgcagataatccgagttttgggacaactgttgccgaaaatcgtcaatacagttccggcacatcggatgctcttccagattttcgggatgttctttttcttcatacaccagcaatatctgcccgggatcgccgaaatcgattccccatgcggcatcgtgttcggtgcgctcctcttccgtcatctgcccgcgcattgcctgtatggtaaagccgccgtaggggatgccgttgcacacgaacatccagtcgctgatgtcgtcaaccggaacgcaaacgctttcgccttgttcgacattggtcagttcgccgggttcattgttcagcacaccgtaaatataaagaccgtcaaaataaatatcgtcgatccacatatgttcgcaaatttcgccgtcttcgccgtcttggaaaaaagggactttgaccatggcaaaatccaaggcggaaataatgcggcggcgttcccaaaaaagctcgcgccaaaaatatttgaatgttttacgggcgcgttcgtcggcacggtttaccggttcgtctgcctgttctacataataaatgacggaatcgcccatcattctgctcctcaacgtgtacggtatctgtttgcaccttactgcggctttctgccttcggcatccgattcggatttgaaaagttccaaatattcggaatag

SEQ ID NO: 552 - protein, 235 aa, Neisseria meningitidis
MMKRRIAVFVLFPQIIRVLGQLLPKIVNTVPAHRMLFQIFGMFFFFIHQQYLPGIAEIDSPCGIVFGALLFRHLPAHCLYGKAAVGDAVAHEHPVADVVNRNANAFALFDIGQFAGFIVQHTVNIKTVKINIVDPHMFANFAVFAVLEKRDFDHGKIQGGNNAAAFPKKLAPKIFECFTGAFVGTVYRFVCLFYIINDGIAHHSAPQRVRYLFAPYCGFLPSASDSDLKSSKYSE

SEQ ID NO: 553 - DNA, 708 bp, Neisseria meningitidis
  misc_feature (117)..(117): N= Unknown
  misc_feature (221)..(221): N= Unknown
  misc_feature (427)..(427): N= Unknown
  misc_feature (476)..(476): N= Unknown
  misc_feature (478)..(479): N= Unknown
  misc_feature (481)..(482): N= Unknown
atgatgaagcggcgtatagccgtcttcgtcctgctcatgcagaaaatccggattttgggacaactgttgccgaaaatcgtcaatacagttccggcacatcggatgctcttccagatnttcgggatgttctttttcttcatacaccagcaatacctgcccgggatcgccgaaatcgattccccatgcggcatcgtgttcggtacgctcctcttccgtcatcngtccacgcattgcctgtatggtaaagccgccgtagggaatgccgttgcacacgaacatccagtcgctgatgtcgtcaaccggaacgcaaacgctttcgccttgttcgacattggtcagttcgccgggttcattgttcagcacgccataaatgtaaagaccgtcaaaataaatatcgtcgatccacatatgttcgcaaatttcgccntcttcgccgtcttggaaaaaagggctttgaccatggcaaaatctaaggngnnanngatgcggcggcgttcccaaaaaagctcgcgccaaaaatatttgaatgttttgcgggcgcgttcgccggcacggtttaccggtttgtctgcctgttctacataataaatgacggaatcgcccatcatatctgctcctcaacgtgtacggtatctgtttgcaccttactgcggctttctgccttcggcatccgattcggatttgaaaagttccaaatattcggaatag

SEQ ID NO: 554 - protein, 233 aa, Neisseria meningitidis
  misc_feature (39)..(39): Xaa= any amino acid
  misc_feature (74)..(74): Xaa= any amino acid
  misc_feature (143)..(143): Xaa= any amino acid
  misc_feature (159)..(161): Xaa= any amino acid
MMKRRIAVFVLLMQKIRILGQLLPKIVNTVPAHRMLFQXFGMFFFFIHQQYLPGIAEIDSPCGIVFGTLLFRHXSTHCLYGKAAVGNAVAHEHPVADVVNRNANAFALFDIGQFAGFIVQHAINVKTVKINIVDPHMFANFAXFAVLEKRALTMAKSKXXXMRRRSQKSSRQKYLNVLRARSPARFTGLSACSTMTESPIISAPQRVRYLFAPYCGFLPSASDSDLKSSKYSE

SEQ ID NO: 555 - DNA, 708 bp, Neisseria gonorrhoeae
atgatgaagcggcgtatagccgtcttcgtcctgctcatgcagaaaatccggattttgggacaactgttgccgaaaatcgtcaatacagttccggcacatcggatgctcttccaaattttcgggatgttctttttcttcatacaccggcaatacctgcccgggatcgccgaaatcgattccccaggcggtatcgtgttcggtacgctcctcttccgtcatctgtccgcgcattgcctgtacggtaaagccgccgtaggggatgccgttgcacacgaacatccagtcgctgatgtcgccaaccggaacgcaaacgctttcgccttgttcgacattggtcagtccgccgggttcattgttcagcacaccgtaaatataaagaccgtcaaaataaatatcgtcgatccacatatgttcgcaaatttcgccgtcttcgccgtcttggaaaaaagggactttgaccatggcaaaatccaaggcggaaataatgcggcggcgttcccaaaaaagctcgcgccaaaagtatttgaatgttttacgggcgcgttcgccggcacggtttaccggttcgtctgcctgttctacataataaatgacggaatcgcccatcatactgctcctcaacgtgtacggtatctgtttgcaccttaccgcggttttctacctccggcatccgattcggatttgaaaagttccaaatattcggaatag

SEQ ID NO: 556 - protein, 235 aa, Neisseria gonorrhoeae
MMKRRIAVFVLLMQKIRILGQLLPKIVNTVPAHRMLFQIFGMFFFFIHRQYLPGIAEIDSPGGIVFGTLLFRHLSAHCLYGKAAVGDAVAHEHPVADVANRNANAFALFDIGQSAGFIVQHTVNIKTVKINIVDPHMFANFAVFAVLEKRDFDHGKIQGGNNAAAFPKKLAPKVFECFTGAFAGTVYRFVCLFYIINDGIAHHTAPQRVRYLFAPYRGFLPPASDSDLKSSKYSE

SEQ ID NO: 557 - DNA, 446 bp, Neisseria meningitidis
atggaaaatatggtaacgttttcaaaaatcagaccgcttttggcaatcgccgccgccgcgttgcttgccgcctgcggacggcgggaaataatgctgtccgcaagccggtgcaaaccgccaaacccgccgcagtggtcggtttggcactcggtggcggcgcatctaaaggatttgcccatgtaggtattattaaggttttgaaagaaaacggtattcctgtgaaggtggttaccggcacctccgcaggttcgattgtcggcaacctttttgcatcgggtatgtcgcccgaccgcctcgaattggaagccgaaattttaggcaaaaccgatttggtcgatttaaccttgtccaccaatgggtttatcaaaggcgcaaagctgcaaaattacatcaaccgaaaactccgcggcatgcagattcagcagtttcccatcaaatttgccgcc

SEQ ID NO: 558 - protein, 149 aa, Neisseria meningitidis
  misc_feature (25)..(25): Xaa= any amino acid
MENMVTFSKIRPLLAIAAAALLAAXRTAGNNAVRKPVQTAKPAAVVGLALGGGASKGFAHVGIIKVLKENGIPVKVVTGTSAGSIVGNLFASGMSPDRLELEAEILGKTDLVDLTLSTNGFIKGAKLQNYINRKLRGMQIQQFPIKFAA

SEQ ID NO: 559 - DNA, 903 bp, Neisseria meningitidis
atggaaaatatggtaacgttttcaaaaatcagaccgcttttggcaatcgccgccgccgcgttgcttgccgcctgcggcacggcgggaaataatgctgtccgcaagccggtgcaaaccgccaaacccgccgcagtggtcggtttggcactcggtggcggcgcatctaaaggatttgcccatgtaggtattattaaggttttgaaagaaaacggtattcctgtgaaggtggttaccggcacatcggcaggttcgattgtcggcagcctttttgcatcgggtatgtcgcccgaccgcctcgaattggaagccgaaattttaggcaaaaccgatttggtcgatttaaccttgtccaccagtggttttatcaaaggcgaaaagctgcaaaattacatcaaccgaaaagtcggcggcaggcagattcagcagtttcccatcaaatttgccgccgttgctactgattttgaaaccggcaaggccgtcgctttcaatcaggggaatgccgggcaggctgtgcgcgcttccgccgccattcccaatgtgttccaacccgttatcatcggcaggcatacatatgttgacggcggtctgtcgcagcccgtgcccgtcagtgccgcccggcggcagggggcgaatttcgtgattgccgtcgatatttccgcccgtccgggcaaaaacatcagccaaggtttcttctcttatctcgatcagacgctgaacgtaatgagcgtttctgcgttgcaaaatgagttggggcaggcggatgtggttatcaaaccgcaggttttggatttgggtgcagtcggcggattcgatcagaaaaaacgcgccatccggttgggtgaggaggcagcacgtgccgcattgcctgaaatcaaacgcaaactggcggcataccgttattga

SEQ ID NO: 560 - protein, 300 aa, Neisseria meningitidis
MENMVTFSKIRPLLAIAAAALLAACGTAGNNAVRKPVQTAKPAAVVGLALGGGASKGFAHVGIIKVLKENGIPVKVVTGTSAGSIVGSLFASGMSPDRLELEAEILGKTDLVDLTLSTSGFIKGEKLQNYINRKVGGRQIQQFPIKFAAVATDFETGKAVAFNQGNAGQAVRASAAIPNVFQPVIIGRHTYVDGGLSQPVPVSAARRQGANFVIAVDISARPGKNISQGFFSYLDQTLNVMSVSALQNELGQADVVIKPQVLDLGAVGGFDQKKRAIRLGEEAARAALPEIKRKLAAYRY

SEQ ID NO: 561 - DNA, 903 bp, Neisseria meningitidis
  misc_feature (624)..(624): N= Unknown
  misc_feature (626)..(629): N= Unknown
  misc_feature (631)..(631): Xaa= any amino acid
  misc_feature (634)..(634): Xaa= any amino acid
atggaaaatatggtaacgttttcaaaaatcagaccgcttttggcaatcgccgccgccgcgttgcttgccgcctgcggcacggcgggaaataatgctgcccgcaagccggtgcaaaccgccaaacccgccgcagtggtcggtttggcactcggtggcggcgcatctaaaggatttgcccatgtaggtattattaaggttttgaaagaaaacggtattcctgtgaaggtggttaccggcacatcggcaggttcgatagtcggcagcctttttgcatcgggtatgtcgcccgaccgcctcgaattggaagccgaaattttaggtaaaaccgatttggtcgatttaaccttgtccaccagtggttttatcaaaggcgaaaagctgcaaaattacatcaaccgaaaagtcggcggcaggcggattcagcagtttcccatcaaatttgccgccgttgctactgattttgaaaccggcaaggccgtcgctttcaatcaagggaatgccgggcaggctgtgcgcgcttccgccgccattcccaatgtgttccaacccgttatcatcggcaggcatacatatgttgacggcggtctgtcgcagcccgtgcccgtcagtgccgcccggcggcangnnnngnatntcgtgattgccgtcgatatttccgcccgtccgagcaaaaacatcagccaaggcttcttctcttatctcgatcagacgctgaacgtaatgagcgtttccgcgttgcaaaatgagttggggcaggcggatgtggttatcaaaccgcaggttttggatttgggtgcagtcggcggattcgatcagaaaaaacgcgccatccggttgggtgaggaggcagcacgtgccgcattgcctgaaatcaaacgcaaactggcggcataccgttattga

SEQ ID NO: 562 - protein, 300 aa, Neisseria meningitidis
  misc_feature (208)..(212): Xaa= any amino acid
MENMVTFSKIRPLLAIAAAALLAACGTAGNNAARKPVQTAKPAAVVGLALGGGASKGFAHVGIIKVLKENGIPVKVVTGTSAGSIVGSLFASGMSPDRLELEAEILGKTDLVDLTLSTSGFIKGEKLQNYINRKVGGRRIQQFPIKFAAVATDFETGKAVAFNQGNAGQAVRASAAIPNVFQPVIIGRHTYVDGGLSQPVPVSAARRXXXXXVIAVDISARPSKNISQGFFSYLDQTLNVMSVSALQNELGQADVVIKPQVLDLGAVGGFDQKKRAIRLGEEAARAALPEIKRKLAAYRY

SEQ ID NO: 563 - DNA, 903 bp, Neisseria gonorrhoeae
atggaaaatatggtaacgttttcaaaaatcagatcatttttggcaatcgccgccgccgcgttgcttgccgcctgcggtacggcgggaaacaatgccgcccgcaagccggtgcaaaccgccaaacccgccgcagtggtcgctttggcactcggtggcggcgcatctaaaggatttgcccatataggaattgttaaggttttgaaagaaaacggtattcctgtgaaggtggttaccggcacatcggcaggttcgatagtcggcagccttttggcatcgggtatgtcgcccgaccgcctcgaattggaagccgagattttaggtaaaaccgatttagtcgatttaaccttgtccaccagtggttttatcaaaggcgaaaagctgcaaaattacatcaaccgaaaagtcggcggcaggcagattcagcagtttcccatcaaatttgccgccgttgccactgattttgaaaccggcaaggccgtcgctttcaatcaagggaatgccgggcaggcggttcgtgcttccgccgccattcccaatgtgttccagccagtcatcatcggcaggcacaaatatgttgacggcggtctgtcgcagcccgtgcccgtcagtgccgctcggcggcagggggcgaatttcgtgattgccgtcgatatttccgcacgtccgagcaaaaatgtcggtcaaggtttcttctcttatctcgatcagacgctgaacgtgatgagcgtttccgtgttgcaaaacgagttggggcaggcggatgtggttatcaaaccgcaggttttggatttgggtgcagtcggcggattcgatcagaaaaagcgcgccatccggttgggcgaggaggcagcacgtgccgcattgcctgaaatcaaacgcaaactggcggcataccgttattga

SEQ ID NO: 564 - protein, 300 aa, Neisseria gonorrhoeae
MENMVTFSKIRSFLAIAAAALLAACGTAGNNAARKPVQTAKPAAVVALALGGGASKGFAHIGIVKVLKENGIPVKVVTGTSAGSIVGSLLASGMSPDRLELEAEILGKTDLVDLTLSTSGFIKGEKLQNYINRKVGGRQIQQFPIKFAAVATDFETGKAVAFNQGNAGQAVRASAAIPNVFQPVIIGRHKYVDGGLSQPVPVSAARRQGANFVIAVDISARPSKNVGQGFFSYLDQTLNVMSVSVLQNELGQADVVIKPQVLDLGAVGGFDQKKRAIRLGEEAARAALPEIKRKLAAYRY

SEQ ID NO: 565 - DNA, 369 bp, Neisseria meningitidis
atgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccmatatgcggcaggcgggtttgaaccccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattc

SEQ ID NO: 566 - protein, 123 aa, Neisseria meningitidis
  misc_feature (60)..(60): Xaa= any amino acid
MFRLQFRLFPPLRTAMHILLTALLKCLSLLPLSCLHTLGNRLGHLAFYLLKEDRARIVAXMRQAGLNPDPKTVKAVFAETAKGGLELAPAFFRKPEDIETMFKAVHGWEHVQQALDKHEGLLF

SEQ ID NO: 567 - DNA, 897 bp, Neisseria meningitidis
atgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccaatatgcggcaggcgggtttgaaccccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattcatcacgccgcacatcggcagctacgatttgggcggacgctacatcagccagcagcttccgttcccgctgaccgccatgtacaaaccgccgaaaatcaaagcgatagacaaaatcatgcaggcgggcagggttcgcggcaaaggaaaaaccgcgcctaccagcatacaaggggtcaaacaaatcatcaaagccctgcgttcgggcgaagcaaccatcgtcctgcccgaccacgtcccctcccctcaagaaggcggggaaggcgtatgggtggatttcttcggcaaacctgcctataccatgacgctggcggcaaaattggcacacgtcaaaggcgtgaaaaccctgtttttctgctgcgaacgcctgcctggcggacaaggtttcgatttgcacatccgccccgtccaaggggaattgaacggcgacaaagcccatgatgccgccgtgttcaaccgcaatgccgaatattggatacgccgttttccgacgcagtatctgtttatgtacaaccgctacaaaatgccgtaa

SEQ ID NO: 568 - protein, 298 aa, Neisseria meningitidis
MFRLQFRLFPPLRTAMHILLTALLKCLSLLPLSCLHTLGNRLGHLAFYLLKEDRARIVANMRQAGLNPDPKTVKAVFAETAKGGLELAPAFFRKPEDIETMFKAVHGWEHVQQALDKHEGLLFITPHIGSYDLGGRYISQQLPFPLTAMYKPPKIKAIDKIMQAGRVRGKGKTAPTSIQGVKQIIKALRSGEATIVLPDHVPSPQEGGEGVWVDFFGKPAYTMTLAAKLAHVKGVKTLFFCCERLPGGQGFDLHIRPVQGELNGDKAHDAAVFNRNAEYWIRRFPTQYLFMYNRYKMP

SEQ ID NO: 569 - DNA, 897 bp, Neisseria meningitidis
atgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccaatatgcgtcaggcaggcatgaatcccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattcatcacgccgcacatcggcagctacgatttgggcggacgctacatcagccagcagcttccgttcccgctgaccgccatgtacaaaccgccgaaaatcaaagcgatagacaaaatcatgcaggcgggcagggttcgcggcaaaggaaaaaccgcgcctaccagcatacaaggggtcaaacaaatcatcaaagccctgcgttcgggcgaagcaaccatcgtcctgcccgaccacgtcccctcccctcaagaaggcggggaaggcgtatgggtggatttcttcggcaaacctgcctataccatgacgctggcggcaaaattggcacacgtcaaaggcgtgaaaaccctgtttttctgctgcgaacgcctgcctggcggacaaggtttcgatttgcacatccgccccgtccaaggggaattgaacggcgacaaagcccatgatgccgccgtgttcaaccgcaatgccgaatattggatacgccgttttccgacgcagtatctgtttatgtacaaccgctacaaaatgccgtaa

SEQ ID NO: 570 - protein, 298 aa, Neisseria meningitidis; identical to SEQ ID NO: 568

SEQ ID NO: 571 - DNA, 894 bp, Neisseria gonorrhoeae
atgtttcgtttacaattcaggctgtttccccctttgcgaaccgccatgcacatcctgttgaccgccctgctcaaatgcctctccctgctgtcgctttcctgtctgcacacgctgggaaaccggctcggacatctggcgttttaccttttaaaggaagaccgcgcgcgcatcgtcgccaatatgcggcaggcgggtttgaaccccgacacgcagacggtcaaagccgtttttgcggaaacggcaaaatgcggtttggaacttgcccccgcgtttttcaaaaaaccggaagacatcgaaacaatgttcaaagcggtacacggctgggaacacgtgcagcaggctttggacaagggcgaagggctgctgttcatcacgccgcacatcggcagctacgatttgggcggacgctacatcagccagcagcttccgttccacctgaccgccatgtacaagccgccgaaaatcaaagcgatagacaaaatcatgcaggcgggcagggtgcgcggcaaaggcaaaaccgcgcccaccggcatacaaggggtcaaacaaatcatcaaggccctgcgcgcgggcgaggcaaccatcatcctgcccgaccacgtcccttctccgcaggaaggcggcggcgtgtgggcggattttttcggcaaacctgcatacaccatgacactggcggcaaaattggcacacgtcaaaggcgtgaaaaccctgtttttctgctgcgaacgcctgcccgacggacaaggcttcgtgttgcacatccgccccgtccaaggggaattgaacggcaacaaagcccacgatgccgccgtgttcaaccgcaataccgaatattggatacgccgttttccgacgcagtatctgtttatgtacaaccgctataaaacgccgtaa

SEQ ID NO: 572 - protein, 297 aa, Neisseria gonorrhoeae
MFRLQFRLFPPLRTAMHILLTALLKCLSLLSLSCLHTLGNRLGHLAFYLLKEDRARIVANMRQAGLNPDTQTVKAVFAETAKCGLELAPAFFKKPEDIETMFKAVHGWEHVQQALDKGEGLLFITPHIGSYDLGGRYISQQLPFHLTAMYKPPKIKAIDKIMQAGRVRGKGKTAPTGIQGVKQIIKALRAGEATIILPDHVPSPQEGGGVWADFFGKPAYTMTLAAKLAHVKGVKTLFFCCERLPDGQGFVLHIRPVQGELNGNKAHDAAVFNRNTEYWIRRFPTQYLFMYNRYKTP

SEQ ID NO: 573 - DNA, 567 bp, Neisseria meningitidis
gcgtggtcggccggcgaatcgtggcgtgtgttaatggaaagtgaaacgtggcatgcggtgtggaatactttgcgcttctcggcggcggcggtgtatgcggcagcggttttgggtgtggtgtatgcggcgccggcgcggcggtcggcgtggatgcgcgggctgatgttttagccgtttatggtgtcgccggtttgtgtttcggcgggcgtgctgctgctttatccgcagtggacggcttcgttgccgttgctgctggcgatgtatgcgctgctggcgtatccgtttgtggcaaaagatgttttatcagcctgggatgcactgccgccggattacggcagggcggcggcgggtttgggtgcaaacggctttcagacggcatgccgcatcacgttccccctcttgaaaccggcgttgcggcgcggtctgactttggcggcggcaacctgcgtgggcgaatttgcggcgacattgtttctgtcgcgtccggaatggcagacgctgacgactttgatttatgcctatttgggacgcgcgggtgaggataattacgcgcgggcgatggtgctg

SEQ ID NO: 574 - protein, 189 aa, Neisseria meningitidis
  misc_feature (57)..(57): Xaa= any amino acid
AWSAGESWRVLMESETWHAVWNTLRFSAAAVYAAAVLGVVYAAPARRSAWMRGLMFXPFMVSPVCVSAGVLLLYPQWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVL

SEQ ID NO: 575 - DNA, 1542 bp, Neisseria meningitidis
atggatggacggcgttgggtggtatggggtgcttttgccctgctgccttcggcttttttggcggtaatggtcgttgcgcctttgtgggcggtggcggcgtatgacggtttggcgtggcgcgcggtgctgtcggatgcctatatgctcaaacgtttggcgtggacggtatttcaggcagcggcaacctgtgtgctggtgctgcctttgggcgtgcctgtcgcgtgggtgctggcgcggctggcgtttccggggcgggctttggtgctgcgcctgctgatgctgccttttgtgatgcccacgttggtggcgggcgtgggcgtgctggccctgttcggggcggacgggctgttgtggcgcggcaggcaggatacgccgtatctgttgttgtacggcaatgtgtttttcaaccttcctgtgttggtcagggcggcgtatcaggggtttgtgcaagtgcctgcggcacggcttcagacggcacggacgttgggcgcgggggcgtggcggcggttttgggacattgaaatgcccgttttgcgcccgtggcttgccggcggcgtgtgccttgtctttctgtattgtttttccgggttcgggctggcgctgctgctgggcggcagccgttatgccacggtcgaagtggaaatttaccagttggtcatgttcgaactcgatatggcggttgcttcggtgctggtgtggctggtgttgggggtaacggcggcggcagggttgctgtatgcgtggttcggcaggcgcgcggtttcggataaggcggtttcccctgtgatgccgtcgccgccgcagtcggtcggggaatatgtgctgctggcgtttgcggcggcggtgttgtctgtgtgctgcctgtttcctttgttggcaattgttgtgaaagcgtggtcggccggcgaatcgtggcgtgtgttaatggaaagtgaaacgtggcaggcggtgtggaatactttgcgcttctcggcggcggcggtgtatgcggcggcggttttgggtgtggtgtatgcggcggcggcgcggcggtcggcgtggatgcgcgggctgatgtttttgccgtttatggtgtcgccggtttgtgtttcggcgggcgtgctgctgctttatccgcagtggacggcttcgttgccgttgctgctggcgatgtatgcgctgctggcgtatccgtttgtggcaaaagatgttttatcagcctgggatgcactgccgccggattacggcagggcggcggcgggtttgggtgcaaacggctttcagacggcatgccgcatcacgttccccctcttgaaaccggcgttgcggcgcggtctgactttggcggcggcaacctgcgtgggcgaatttgcggcgacattgtttctgtcgcgtccggaatggcagacgctgacgactttgatttatgcctatttgggacgcgcgggtgaggataattacgcgcgggcgatggtgctgacattgctgttggcggcgttcgcgctgggtattttcctgctgttggacggcggcgaaggcggaaaacagacggaaacgttataa

SEQ ID NO: 576 - protein, 513 aa, Neisseria meningitidis
MDGRRWVVWGAFALLPSAFLAVMVVAPLWAVAAYDGLAWRAVLSDAYMLKRLAWTVFQAAATCVLVLPLGVPVAWVLARLAFPGRALVLRLLMLPFVMPTLVAGVGVLALFGADGLLWRGRQDTPYLLLYGNVFFNLPVLVRAAYQGFVQVPAARLQTARTLGAGAWRRFWDIEMPVLRPWLAGGVCLVFLYCFSGFGLALLLGGSRYATVEVEIYQLVMFELDMAVASVLVWLVLGVTAAAGLLYAWFGRRAVSDKAVSPVMPSPPQSVGEYVLLAFAAAVLSVCCLFPLLAIVVKAWSAGESWRVLMESETWQAVWNTLRFSAAAVYAAAVLGVVYAAAARRSAWMRGLMFLPFMVSPVCVSAGVLLLYPQWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVLTLLLAAFALGIFLLLDGGEGGKQTETL

SEQ ID NO: 577 - DNA, 1542 bp, Neisseria meningitidis
  misc_feature (350)..(350): N= Unknown
  misc_feature (406)..(406): N= Unknown
  misc_feature (479)..(479): N= Unknown
  misc_feature (693)..(693): N= Unknown
  misc_feature (707)..(707): N= Unknown
  misc_feature (717)..(717): N= Unknown
  misc_feature (774)..(774): N= Unknown
  misc_feature (825)..(825): N= Unknown
  misc_feature (848)..(848): N= Unknown
  misc_feature (869)..(869): N= Unknown
  misc_feature (961)..(961): N= Unknown
  misc_feature (1111)..(1111): N= Unknown
  misc_feature (1203)..(1203): N= Unknown
  misc_feature (1366)..(1366): N= Unknown
  misc_feature (1376)..(1376): N= Unknown
  misc_feature (1414)..(1414): N= Unknown
  misc_feature (1431)..(1431): N= Unknown
  misc_feature (1491)..(1491): N= Unknown
atggatggacggcgttgggcggtatggggtgcttttgccctgctgccttcggcttttttggcggcaatggtcgttgcgcctttgtgggcggtggcggcgtatgacggtttggcgtggcgcgcggtgctgtcggatgcctatatgctcaaacgtttggcgtggacggtatttcaggcagcggcaacctgtgtgctggtgctgcctttgggcgtgcctgtcgcgtgggtgctggcgcggctggcgtttccggggcgggctttggtgctgcgcctgctgatgctgccttttgtgatgcccacgttggtggcgggcgtgggcgtgctggctctgttcggggcggacggcctgtngtggcgcggctggcaggatacgccgtatctgttgttgtacggcaatgtgttttttnaccttcctgtgttggtcagggcggcatatcaggggtttgtgcaagtgcctgcggcacggcttcagacggcacngacattgggcgcgggggcgtggcggcggttttgggacattgaaatgcccgttttgcgcccgtggcttgccggcggcgtgtgccttgtcttcctgtattgtttttcggggttcgggctggcattgctgctgggcggcagccgttatgccacggtcgaagtggaaatttaccagttggtcatgttcgaactcgatatggcggttgcttcggtgctngtgtggctggtgtngggggtaacngcggcggcagggttgctgtatgcgtggttcggcaggcgcgcggtttcggataaggcngtttcccctgtgatgccgtcgccgccgcagtcggtcggggaatatgtgctnctggcgtttgcggcggcggtgtngtctgtgtgctgcctgtttcntttgttggcaattgttgtgaaagcgtggtcggccggcgaatcgtggcgtgtgttaatggaaagtgaaacgtggcaggcggtgtggaatactntgcgcttctcggcggcggcggtgtatgcggcggcggttttgggtgtggtgtatgcggcggcggcgcggcggtcggcgtggatgcgcgggctgatgtttttgccgtttatggtgtcgccggtttgtgtttcggcgggcgtgctgctgcttnatccgcagtggacggcttcgttgccgctgctgctggcgatgtatgcgctgctggcgtatccgtttgtggcaaaagatgttttatcagcctgngatgcactgccgccggattacggcagggcggcggcgggtttgggtgcaaacggctttcagacggcatgccgcatcacgttccccctcttgaaaccggcgttgcggcgcggtctgactttggcggcggcaacctgcgtgggcgaatttgcggcaaccttgttcntgtcgcgtcncgagtggcagacgctgacgactttgatttatgcctatntgggacgcgcgggtgangataattacgcgcgggcgatggtgctgacattgctgttggcggcgttcgcgctgggtatnttcctgctgttggacggcggcgaaggcggaaaacggacggaaacgttataa

SEQ ID NO: 578 - protein, 513 aa, Neisseria meningitidis
  misc_feature (117)..(117): Xaa= any amino acid
  misc_feature (136)..(136): Xaa= any amino acid
  misc_feature (160)..(160): Xaa= any amino acid
  misc_feature (236)..(236): Xaa= any amino acid
  misc_feature (283)..(283): Xaa= any amino acid
  misc_feature (290)..(290): Xaa= any amino acid
  misc_feature (321)..(321): Xaa= any amino acid
  misc_feature (371)..(371): Xaa= any amino acid
  misc_feature (401)..(401): Xaa= any amino acid
  misc_feature (456)..(456): Xaa= any amino acid
  misc_feature (459)..(459): Xaa= any amino acid
  misc_feature (472)..(472): Xaa= any amino acid
  misc_feature (477)..(477): Xaa= any amino acid
  misc_feature (497)..(497): Xaa= any amino acid
MDGRRWAVWGAFALLPSAFLAAMVVAPLWAVAAYDGLAWRAVLSDAYMLKRLAWTVFQAAATCVLVLPLGVPVAWVLARLAFPGRALVLRLLMLPFVMPTLVAGVGVLALFGADGLXWRGWQDTPYLLLYGNVFFXLPVLVRAAYQGFVQVPAARLQTAXTLGAGAWRRFWDIEMPVLRPWLAGGVCLVFLYCFSGFGLALLLGGSRYATVEVEIYQLVMFELDMAVASVLVWLVXGVTAAAGLLYAWFGRRAVSDKAVSPVMPSPPQSVGEYVLLAFAAAVXSVCCLFXLLAIVVKAWSAGESWRVLMESETWQAVWNTXRFSAAAVYAAAVLGVVYAAAARRSAWMRGLMFLPFMVSPVCVSAGVLLLXPQWTASLPLLLAMYALLAYPFVAKDVLSAXDALPPDYGRAAAGLGANGFQTACRITFPLLKPALRRGLTLAAATCVGEFAATLFXSRXEWQTLTTLIYAYXGRAGXDNYARAMVLTLLLAAFALGXFLLLDGGEGGKRTETL

SEQ ID NO: 579 - DNA, 8 bp, Neisseria gonorrhoeae
  misc_feature (1)..(8): N= Unknown
nnnnnnnn

SEQ ID NO: 580 - protein, 513 aa, Neisseria gonorrhoeae
MDGRCWAVRGAFSLLPSAFLAVMVVAPLWAVAAYDGLAWRAVLSDAYMLKRLAWTVFQAAATCVLVLPLGVPVAWVLARLAFPGRALVLRLLMLPFVMPTLVAGVGVLALFGADGLLWRGRQDTPYLLLYGNVFFNLPVLVRAAYQGFAQVPAARLQTARTLGAGAWRPFWDIEMPVLRPWLAGGVCLVFLYCFSGFGLALLLGGSRYATVEVEIYQLVMFELDMAGASALVWLVLGVTAAAGLLYAWFGRRAVSDKAVSPVMPSPPQSVGEYVLLAFSVAVLSVCCLFPLSAIVVKAWSAGESRRVLMESETWQAVWNTLRFSAAAVFAAAVLGVVYAAAARRLVWMRGLVFLPFMVSPVCVSAGVLLLYPGWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVLTLLLSAFAVCIFLLLDNGEGGKRTETL

SEQ ID NO: 581 - DNA, 1542 bp, Neisseria gonorrhoeae
atggatggacggtgttgggcggtacggggtgctttttccctgctgccttcggcttttttggcggtaatggtcgttgcgcctttgtgggcggtggcggcgtatgacggtttggcgtggcgcgcggtgctgtcggatgcctatatgctcaaacgtttggcgtggacggtgtttcaggcggcggcaacctgtgtgctggtgctgcctttgggcgtgcctgtcgcgtgggtgctggcgcggctggcgttcccggggcgggctttggtgctgcgcctgctgatgctgccgtttgtgatgcccacgctggtggcgggcgtgggcgtgctggctctgttcggggcggacgggctgttgtggcgcggccggcaggatacgccgtatctgttgttgtacggcaatgtgtttttcaacctgcccgtgttggtcagggcggcgtatcaggggtttgctcaagtgcctgcggcacggcttcagacggcacggacgttgggcgcgggggcgtggcggcggttttgggacattgaaatgcccgttttgcgcccgtggcttgccggcggcgtgtgccttgtcttcctgtattgtttttcggggttcgggctggcattgctgttgggcggcagccgttatgccacggtcgaagtggaaatttaccagttggttatgttcgaactcgatatggcgggggcttcggcgctggtgtggctggtgttgggggtaacggcggcggcagggttgctgtatgcgtggttcggcaggcgcgcggtttcggataaggcggtttcccccgtgatgccgtcgccgccgcaatcggtgggggaatatgtattgctggcattttcggtggcggtgttgtccgtgtgctgcctgtttcctttgtcggcaattgttgtgaaagcgtggtcggccggcgaatcgcggcgtgtgttaatggaaagtgaaacgtggcaggcagtgtggaatactttgcgcttttcggcggcggcggtgtttgcggcggcggttttgggtgtggtgtatgcggcggcggcgcggcggctggtgtggatgcgcggactggtgtttttaccgtttatggtgtcgccggtttgtgtttcggcgggcgtgctgctgctttatccggggtggacggcttcgttaccgctgctgctggcgatgtatgcgctgctggcgtatccgtttgtggcaaaagatgttttatcggcctgggatgcactgccgccggattacggcagggcggcggcaggtttgggcgcaaacggctttcagacggcatgccgtatcacgttccccctcttgaaaccggcgttgcggcgcggtctgactttggcggcggcgacgtgtgtgggcgaatttgcggcaaccttgttcctgtcgcgtccggaatggcagacgttgacgactttgatttatgcctatttggggcgtgcgggtgaggacaattatgcgcgggcaatggtgttgacattgctgttgtcggcatttgcggtgtgcattttcctgctgttggacaacggcgaaggcggaaaacggacggaaacgttataa

SEQ ID NO: 582 - protein, 513 aa, Neisseria gonorrhoeae
MDGRCWAVRGAFSLLPSAFLAVMVVAPLWAVAAYDGLAWRAVLSDAYMLKRLAWTVFQAAATCVLVLPLGVPVAWVLARLAFPGRALVLRLLMLPFVMPTLVAGVGVLALFGADGLLWRGRQDTPYLLLYGNVFFNLPVLVRAAYQGFAQVPAARLQTARTLGAGAWRRFWDIEMPVLRPWLAGGVCLVFLYCFSGFGLALLLGGSRYATVEVEIYQLVMFELDMAGASALVWLVLGVTAAAGLLYAWFGRRAVSDKAVSPVMPSPPQSVGEYVLLAFSVAVLSVCCLFPLSAIVVKAWSAGESRRVLMESETWQAVWNTLRFSAAAVFAAAVLGVVYAAAARRLVWMRGLVFLPFMVSPVCVSAGVLLLYPGWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVLTLLLSAFAVCIFLLLDNGEGGKRTETL

SEQ ID NO: 583 - DNA, 261 bp, Neisseria meningitidis
atggacggctggacacagacgctgtccgcgcaaaccctgttgggcatttcggcggcggcaatcatcctcattctgattttaatcgtcagattccgcatccacgcgctgctgacactggtcatcgtcagcctgctgacggctttggcaaccggtttgcccacaggcagcattgtcaaagacatactggtcaaaaacttcggcggcacgctcggcggcgtggcgcttctggtcggcctgggcgcgatgctcgaacgtttggtc

SEQ ID NO: 584 - protein, 87 aa, Neisseria meningitidis
MDGWTQTLSAQTLLGISAAAIILILILIVRFRIHALLTLVIVSLLTALATGLPTGSIVKDILVKNFGGTLGGVALLVGLGAMLERLV

SEQ ID NO: 585 - DNA, 1386 bp, Neisseria meningitidis
atggacggctggacacagacgctgtccgcgcaaaccctgttgggcatttcggcggcggcaatcatcctcattctgattttaatcgtcaaattccgcatccacgcgctgctgacactggtcatcgtcagcctgctgacggctttggcaaccggtttgcccacaggcagcattgtcaacgacatactggtcaaaaacttcggcggcacgctcggcggcgtggcgcttctggtcggcctgggcgcgatgctcggacgtttggtcgaaacatccggcggcgcacagtcgctggcggacgcgctgatccggatgttcggcgaaaaacgcgcaccgttcgcgctgggcgttgcctcgctgattttcggcttcccgattttcttcgatgccggactaatcgtcatgctgcccatcgtgttcgccaccgcacggcgcatgaaacaggacgtactgcccttcgcgcttgcctccatcggcgcattttccgtcatgcacgtcttcctgccgccccatccgggcccgattgccgcttccgaattttacggcgcgaacatcggccaagttttgattttgggtctgccgaccgccttcatcacatggtatttcagcggctatatgctcggcaaagtgttggggcgcaccatccatgttcccgttcccgaactgctcagcggcggcacgcaagacaacgacctgccgaaagaacctgccaaagcaggaacggtcgtcgccatcatgctgattcccatgctgctgattttcctgaataccggcgtatcggccctcatcagcgaaaaactcgtaagtgcggacgaaacctgggttcagacggcaaaaataatcggttcgacaccgatcgcccttctgatttccgtattggtcgcactgtttgtcttgggacgcaaacgcggcgaaagcggcagcgcgttggaaaaaaccgtggacggcgcactcgcccccgtctgttccgtgattctgattaccggcgcgggcggtatgttcggcggcgttttgcgcgcttccggcatcggcaaggcactcgccgacagcatggcggatttgggcattcccgtccttttgggctgtttccttgtcgccttggcactgcgtatcgcgcaaggttcggcaaccgtcgccctgaccaccgccgccgcgctgatggctcctgccgttgccgccgccggctttaccgactggcagctcgcctgtatcgtattggcaacggcggcaggttcggtcggttgcagccacttcaacgactccggcttctggctggtcggccgtctcttggacatggacgtaccgaccacgctgaaaacctggacggtcaaccaaaccctcatcgcactcatcggctttgccttgtccgcactgctgttcgccatcgtctga

SEQ ID NO: 586 - protein, 461 aa, Neisseria meningitidis
MDGWTQTLSAQTLLGISAAAIILILILIVKFRIHALLTLVIVSLLTALATGLPTGSIVNDILVKNFGGTLGGVALLVGLGAMLGRLVETSGGAQSLADALIRMFGEKRAPFALGVASLIFGFPIFFDAGLIVMLPIVFATARRMKQDVLPFALASIGAFSVMHVFLPPHPGPIAASEFYGANIGQVLILGLPTAFITWYFSGYMLGKVLGRTIHVPVPELLSGGTQDNDLPKEPAKAGTVVAIMLIPMLLIFLNTGVSALISEKLVSADETWVQTAKIIGSTPIALLISVLVALFVLGRKRGESGSALEKTVDGALAPVCSVILITGAGGMFGGVLRASGIGKALADSMADLGIPVLLGCFLVALALRIAQGSATVALTTAAALMAPAVAAAGFTDWQLACIVLATAAGSVGCSHFNDSGFWLVGRLLDMDVPTTLKTWTVNQTLIALIGFALSALLFAIV

SEQ ID NO: 587 - DNA, 1386 bp, Neisseria meningitidis
atggacggctggacacagacgctgtccgcgcaaaccctgttgggcatttcggcggcggcaatcatcctcattctgattttaatcgtcaaattccgcatccacgcgctgctgacactggtcatcgtcagcctgctgacggctttggcaaccggtttgcccacaggcagcattgtcaacgacgtactggtcaaaaacttcggcggcacgctcggcggcgtggcgcttctggtcggcctgggcgcgatgctcggacgtttggtcgaaacatccggcggcgcacagtcgctggcggacgcgctgatccggatgttcggcgaaaaacgcgcaccgttcgcgctgggcgttgcctcgctgattttcggcttcccgattttcttcgatgccggactaatcgtcatgctgcccatcgtgttcgccaccgcacggcgcatgaaacaggacgtactgcccttcgcgcttgcctccatcggcgcattttccgtcatgcacgtcttcctgccgccccatccgggcccgattgccgcttccgaattttacggcgcgaacatcggccaagttttgattttgggtctgccgaccgccttcatcacatggtatttcagcggctatatgctcggcaaagtgttggggcgcaccatccatgttcccgttcccgaactgctcagcggcggcacgcaagacaacgacctgccgaaagaacctgccaaagcaggaacggtcgtcgccatcatgctgattcccatgctgctgattttcctgaataccggcgtatcggccctcatcagcgaaaaactcgtaagtgcggacgaaacctgggttcagacggcaaaaataatcggttcgacaccgatcgcccttctgatttccgtattggtcgcactgtttgtcttgggacgcaaacgcggcgaaagcggcagcgcgttggaaaaaaccgtggacggcgcactcgcccccgtctgttccgtgattctgattaccggcgcgggcggtatgttcggcggcgttttgcgcgcttccggcatcggcaaggcactcgccgacagcatggcggatttgggcattcccgtccttttgggctgtttccttgtcgccttggcactgcgtatcgcgcaaggttcggcaaccgtcgccctgaccaccgccgccgcgctgatggctcctgccgttgccgccgccggctttaccgactggcagctcgcctgtatcgtattggcaacggcggcaggttcggtcggttgcagccacttcaacgactccggcttctggctggtcggccgcctcttggacatggacgtaccgaccacgctgaaaacctggacggtcaaccaaaccctcatcgcactcatcggctttgccttgtccgcactgctgttcgccatcgtctga

SEQ ID NO: 588 - protein, 461 aa, Neisseria meningitidis
MDGWTQTLSAQTLLGISAAAIILILILIVKFRIHALLTLVIVSLLTALATGLPTGSIVNDVLVKNFGGTLGGVALLVGLGAMLGRLVETSGGAQSLADALIRMFGEKRAPFALGVASLIFGFPIFFDAGLIVMLPIVFATARRMKQDVLPFALASIGAFSVMHVFLPPHPGPIAASEFYGANIGQVLILGLPTAFITWYFSGYMLGKVLGRTIHVPVPELLSGGTQDNDLPKEPAKAGTVVAIMLIPMLLIFLNTGVSALISEKLVSADETWVQTAKIIGSTPIALLISVLVALFVLGRKRGESGSALEKTVDGALAPVCSVILITGAGGMFGGVLRASGIGKALADSMADLGIPVLLGCFLVALALRIAQGSATVALTTAAALMAPAVAAAGFTDWQLACIVLATAAGSVGCSHFNDSGFWLVGRLLDMDVPTTLKTWTVNQTLIALIGFALSALLFAIV

SEQ ID NO: 589 - DNA, 8 bp, Neisseria gonorrhoeae
  misc_feature (1)..(8): N= Unknown
nnnnnnnn

SEQ ID NO: 590 - protein, 461 aa, Neisseria gonorrhoeae
MDGRTQTLSAQTLLGISAAAIILILILIVKFRIRALLTLVIASLLTALATGLPTGSIVNDVLVKNFGGTLGGVALLVGLGAMLGRLVETSGGAQSLADALIRMFGEKRAPFAPGVASLIFGFPIFFDAGLIVMLPIVFATARRMKQDVLPFALASVGAFSVMHVFLPPHPGPIAASEFYGANIGQVLILGLPTAFITWYFSGYMLGKVLGRAIHVPVPELLSGGTQDSDPPKEPAKAGTVVAVMLIPMLLIFLNTGVSALISEKLVSADETWVQTAKMIGSTPVALLISVLAALLVLGRKRGESGSTLEKTVDGALAPACSVILITGAGGMFGGVLRASGIGKALADSMADLGIPVLLGCFLVALALRIAQGSATVALTTAAALMAPAVAAAGFTDWQLACIVLATAAGSVGCSHFNDSGFWLVGRLSDMDVPTTLKTWTVNQTLIAFIGFALSALLFAIV

SEQ ID NO: 591 - DNA, 1386 bp, Neisseria gonorrhoeae
atggacggccggacacagacgctgtccgcgcaaaccttgttgggcatttcggcggcggcaatcatcctcattctgattttaatcgtcaaattccgcatccgcgcgctgctgacactggtcatcgccagcctgctgacggctttggcaaccggtttgcccacaggcagcatcgtcaacgacgtactggtcaaaaacttcggcggcacgctcggcggcgtggcgcttctggtcggtctgggcgcaatgctcggacgtttggtagaaacatccggcggcgcacagtcgctggcggacgcgctgatccggatgttcggcgaaaaacgcgcaccgttcgctccgggcgttgcctcgctgattttcggcttcccgattttcttcgatgccggactaatcgtcatgctgcccatcgtattcgccaccgcacggcgcatgaaacaggacgtactgcccttcgcgcttgcctccgtcggcgcattttccgtcatgcacgtcttcctgccgccccatccgggcccgattgccgcttccgaattttacggcgcgaacatcggccaggttttgattttgggtctgccgaccgccttcatcacatggtatttcagcggctatatgctcggcaaagtgttggggcgcgccatccatgttcccgttcccgaactgctcagcggcggcacgcaagacagcgacccgccgaaagaacctgccaaagcaggaacggtcgtcgccgtcatgctgattcccatgctgctgattttcctgaataccggcgtatcagccctcatcagcgaaaaactcgtaagtgcggacgaaacttgggttcagacggcaaaaatgatcggttcgacacctgtcgcccttctgatttccgtattggccgcactgttggtcttgggacgcaaacgcggcgaaagcggcagcacgttggaaaaaaccgtggacggcgcactcgcccccgcctgttccgtgattctgattaccggcgcgggcggtatgttcggcggcgttttgcgcgcttccggcatcggcaaggcactcgccgacagcatggcggatttgggcattcccgtccttttgggctgcttccttgtcgccttggcactgcgtatcgcgcaaggttcggcaaccgtcgccctgaccacagccgccgcgctgatggctcctgccgttgccgccgccggctttaccgactggcagctcgcctgtatcgtattggcaacggcggcaggttcggtcggttgcagccacttcaacgactccggcttctggctggtcggccgcctcttggatatggacgtaccgaccacgctgaaaacctggacggtcaaccaaaccctcatcgcattcatcggctttgccttgtccgcactgctgtttgccatcgtctga

SEQ ID NO: 592 - protein, 461 aa, Neisseria gonorrhoeae
MDGRTQTLSAQTLLGISAAAIILILILIVKFRIRALLTLVIASLLTALATGLPTGSIVNDVLVKNFGGTLGGVALLVGLGAMLGRLVETSGGAQSLADALIRMFGEKRAPFAPGVASLIFGFPIFFDAGLIVMLPIVFATARRMKQDVLPFALASVGAFSVMHVFLPPHPGPIAASEFYGANIGQVLILGLPTAFITWYFSGYMLGKVLGRAIHVPVPELLSGGTQDSDPPKEPAKAGTVVAVMLIPMLLIFLNTGVSALISEKLVSADETWVQTAKMIGSTPVALLISVLAALLVLGRKRGESGSTLEKTVDGALAPACSVILITGAGGMFGGVLRASGIGKALADSMADLGIPVLLGCFLVALALRIAQGSATVALTTAAALMAPAVAAAGFTDWQLACIVLATAAGSVGCSHFNDSGFWLVGRLLDMDVPTTLKTWTVNQTLIAFIGFALSALLFAIV

SEQ ID NO: 593 - DNA, 419 bp, Neisseria meningitidis
gatttcggcatatcgcccgtgtatctttgggttgccgccgcgttcaaacatttgctgtcgccgtgggctgccgactcatacgatgtcgcacgctttgcaggcgtattttttgccgttatcggactgacttcctgcggctttgccggtttcaactttttgggcagacaccacgggcgcacgtcgtcctgattctcatcggctgtatcgggctgattccagttgcccatttcctcaaccccgctgccgccgcctttgccgccgccggactggtgctgcacggttattctttggctcgccggcgcgtgattgccgcctcttttctgctcggtacgggctggacgctgatgtcgttggcagcagcttatccggcagcatttgccctgatgctgcccttgcccgtactgatgtttttccgtccg

SEQ ID NO: 594 - protein, 140 aa, Neisseria meningitidis
  misc_feature (60)..(60): Xaa= any amino acid
DFGISPVYLWVAAAFKHLLSPWAADSYDVARFAGVFFAVIGLTSCGFAGFNFLGRHHGRXVVLILIGCIGLIPVAHFLNPAAAAFAAAGLVLHGYSLARRRVIAASFLLGTGWTLMSLAAAYPAAFALMLPLPVLMFFRP

SEQ ID NO: 595 - DNA, 1662 bp, Neisseria meningitidis
atgctgacctataccccgcccgatgcccgcccgcccgccaaaacccacgaaaagccgtggctgctgctgttgatggcgtttgcctggttgtggcccggcgtgttttcccacgatttgtggaatcctgacgaacctgccgtctataccgccgtcgaagcactggcaggcagccccacccccttggttgcccatctgttcggtcaaaccgatttcggcataccgcccgtgtatctttgggttgccgccgcgttcaaacatttgctgtcgccgtgggctgccgactcatacgatgccgcacgctttgcaggcgtattttttgccgttatcggactgacttcctgcggctttgccggtttcaactttttgggcagacaccacgggcgcagcgtcgtcctgattctcatcggctgtatcgggctgattccagttgcccatttcctcaaccccgctgccgccgcctttgccgccgccggactggtgctgcacggttattctttggctcgccggcgcgtgattgccgcctcttttctgctcggtacgggctggacgctgatgtcgttggcagcagcttatccggcagcatttgccctgatgctgcccttgcccgtactgatgtttttccgtccgtggcaaagcaggcgtttgatgttgacggcagtcgcctcacttgcctttgccctgccgcttatgaccgtttacccgctgctcttggcaaaaacgcagcccgcgctgttcgcgcaatggctcgactatcacgttttcggtacgttcggcggcgtgcggcacgttcagacggcattcagtttgttttactatctgaaaaacctgctttggtttgcattgcccgcgctgccgctggcggtttggacggtttgccgcacgcgcctgttttcgaccgactgggggattttgggcgtcgtctggatgcttgccgttttggtgctgcttgccgtcaatccgcagcgttttcaggataacctcgtctggctgcttccgccgcttgccctgttcggcgcggcgcaactggacagcctgaggcgcggcgcggcggcgtttgtcaactggttcggcattatggcgttcggactgtttgccgtgttcctgtggacgggctttttcgccatgaattacggctggcccgccaagcttgccgaacgcgccgcctatttcagcccgtattatgttcctgatatcgatcccattccgatggcggttgccgtactgttcacacccttgtggctgtgggcgattacccggaaaaacatacgcggcaggcaggcggttaccaactgggcggcaggcgttaccctgacctgggctttgctgatgacgctgttcctgccgtggctggacgcggcgaaaagccacgcgccggtcgtccggagtatggaggcatcgctttccccggaattgaaacgggagctttcagacggcatcgagtgtatcggcataggcggcggcgacctgcacacgcggattgtttggacgcagtacggcacattgccgcaccgcgtcggcgatgtacaatgccgctaccgcatcgtcctcctgccccaaaatgcggatgcgccgcaaggctggcagacggtttggcagggtgcgcgtccgcgcaacaaagacagtaagttcgcactgatacggaaaatcggggaaaatatataa

SEQ ID NO: 596 - protein, 553 aa, Neisseria meningitidis
MLTYTPPDARPPAKTHEKPWLLLLMAFAWLWPGVFSHDLWNPDEPAVYTAVEALAGSPTPLVAHLFGQTDFGIPPVYLWVAAAFKHLLSPWAADSYDAARFAGVFFAVIGLTSCGFAGFNFLGRHHGRSVVLILIGCIGLIPVAHFLNPAAAAFAAAGLVLHGYSLARRRVIAASFLLGTGWTLMSLAAAYPAAFALMLPLPVLMFFRPWQSRRLMLTAVASLAFALPLMTVYPLLLAKTQPALFAQWLDYHVFGTFGGVRHVQTAFSLFYYLKNLLWFALPALPLAVWTVCRTRLFSTDWGILGVVWMLAVLVLLAVNPQRFQDNLVWLLPPLALFGAAQLDSLRRGAAAFVNWFGIMAFGLFAVFLWTGFFAMNYGWPAKLAERAAYFSPYYVPDIDPIPMAVAVLFTPLWLWAITRKNIRGRQAVTNWAAGVTLTWALLMTLFLPWLDAAKSHAPVVRSMEASLSPELKRELSDGIECIGIGGGDLHTRIVWTQYGTLPHRVGDVQCRYRIVLLPQNADAPQGWQTVWQGARPRNKDSKFALIRKIGENI

SEQ ID NO: 597 - DNA, 1677 bp, Neisseria meningitidis
atgctgacctataccccgcccgatgcccgcccgcccgccaaaacccacgaaaagccgtggctgttgctgttgatggcgtttgcctggttgtggcccggcgtgttttcccacgatttgtggaatcctgacgaacctgccgtctataccgccgtcgaagcactggcaggcagccccacccctttggttgcccatctgttcggtcaaatcgatttcggcataccgcccgtgtatctttgggttgccgccgcgttcaaacatttgctgtcgccgtgggctgccgacccgtatgatgccgcacgctttgccggcgtgtttttcgccgttgtcggactgacttcctgcggctttgccggtttcaactttttgggcagacaccacgggcgcagcgtcgtcctgattctcatcggctgtatcgggctgattccgaccgtacactttctcaaccccgctgccgccgcctttgccgccgccggactggtgctgcacggttattctttggctcgccggcgcgtgattgccgcctcttttctgctcggtacgggttggacgctgatgtcgttggcagcagcttatccggcggcatttgccctgatgctgcccctgcccgtgctgatgtttttccgtccgtggcaaagcaggcgtttgatgttgacggcagtcgcctcgcttgcctttgccctgccgcttatgaccgtttacccgctgctcttggcaaaaacgcagcccgcgctgttcgcgcaatggctcgacgatcacgttttcggtacgttcggcggcgtgcggcacattcagacggcattcagtttgttttactatctgaaaaacctgctttggtttgcattgcctgcgctgccgctggcggtttggacggtttgccgcacgcgcctgttttcgaccgactgggggattttgggcgtcgtctggatgcttgccgttttggtgctgcttgccgtcaatccgcagcgttttcaggataacctcgtctggctgcttccgccgcttgccctgttcggcgcggcgcaactggacagcctgagacgcggcgcggcggcgtttgtcaactggttcggcattatggcgttcggactgtttgccgtgttcctgtggacgggctttttcgccatgaattacggctggcccgccaagcttgccgaacgcgccgcctatttcagcccgtattatgttcctgatatcgatcccattccgatggcggttgccgtactgttcacacccttgtggctgtgggcgattacccgcaaaaacatacgcggcaggcaggcggttaccaactgggcggcaggcgttaccctgacctgggctttgctgatgacgctgttcctgccgtggctggacgcggcgaaaagccacgcgcccgtcgtccggagtatggaggcatcgctttccccggaattaaaacgggagctttcagacggcatcgagtgtatcgacataggcggcggcgacctacacacgcggattgtttggacgcagtacggcacattgccgcaccgcgtcggcgatgtacaatgccgctaccgcatcgtccgcttgccccaaaacgcggatgcgccgcaaggctggcagacggtctggcagggtgcgcgcccgcgcaacaaagacagtaagttcgcactgatacggaaaaccggggaaaatatattaaaaacaacagattga

SEQ ID NO: 598 - protein, 558 aa, Neisseria meningitidis
MLTYTPPDARPPAKTHEKPWLLLLMAFAWLWPGVFSHDLWNPDEPAVYTAVEALAGSPTPLVAHLFGQIDFGIPPVYLWVAAAFKHLLSPWAADPYDAARFAGVFFAVVGLTSCGFAGFNFLGRHHGRSVVLILIGCIGLIPTVHFLNPAAAAFAAAGLVLHGYSLARRRVIAASFLLGTGWTLMSLAAAYPAAFALMLPLPVLMFFRPWQSRRLMLTAVASLAFALPLMTVYPLLLAKTQPALFAQWLDDHVFGTFGGVRHIQTAFSLFYYLKNLLWFALPALPLAVWTVCRTRLFSTDWGILGVVWMLAVLVLLAVNPQRFQDNLVWLLPPLALFGAAQLDSLRRGAAAFVNWFGIMAFGLFAVFLWTGFFAMNYGWPAKLAERAAYFSPYYVPDIDPIPMAVAVLFTPLWLWAITRKNIRGRQAVTNWAAGVTLTWALLMTLFLPWLDAAKSHAPVVRSMEASLSPELKRELSDGIECIDIGGGDLHTRIVWTQYGTLPHRVGDVQCRYRIVRLPQNADAPQGWQTVWQGARPRNKDSKFALIRKTGENILKTTD

SEQ ID NO: 599 - DNA, 8 bp, Neisseria gonorrhoeae
  misc_feature (1)..(8): N= Unknown
nnnnnnnn

SEQ ID NO: 600 - protein, 585 aa, Neisseria gonorrhoeae
MPSEAVSARPLCEYLLHLAIRPFLLTLMLTYTPPDARPPAKTHEKPWLLLLMAFAWLWPGVFSHDLWNPAEPAVYTAVEALAGSPTPLVAHLFGQTDFGIPPVYLWVAAAFKHLLSPWAAHPYDAARFAGVFFAVIGLTSCGFAGFNFLGRHHGRSVVLIHIGCIGLIPVAHFFNPAAAAFAAAGLVLHGYSLARRRVIAASFLLGTGWTLMSLAAAYPAAFALMLPLPVLMFFRPWQSRRLMLTAVASLAFALPLMTVYPLLLAKTQPALFAQWLNYHVFGTFGGVRHIQRAFSLFHYLKNLLWFAPPGLPLAVWTVCRTRLFSTDWGILGIVWMLAVLVLLAFNPQRFQDNLVWLLPPLALFGAAQLDSLRRGAAAFVNWFGIMAFGLFAVFLWTGFFAMNYGWPAKLAERAAYFSPYYVPDIDPIPMAVAVLFTPLWLWAITRKNIRGRQAVTNWAAGVTLTWALLMTLFLPWLDAAKSHAPVVRSMEASFSPELKRELSDGIECIGIGGGDLHTRIVWTQYGTLPHRVGDVRCRYRIVRLPQNADAPQGWQTVWQGARPRNKDSKFALIRKIGENILKTTD

SEQ ID NO: 601 - DNA, 1677 bp, Neisseria gonorrhoeae
atgctgacctataccccgcccgatgcccgcccgcccgccaaaacccacgaaaaaccgtggctgctgctgttgatggcgtttgcctggctgtggcccggcgtgttttcccacgatttgtggaatcctgccgaacctgccgtctataccgccgtcgaagcactggcaggcagccccacccccttggttgcccatctgttcggtcaaaccgatttcggcataccgcccgtgtatctttgggttgccgccgcattcaaacatttgctgtcgccgtgggcagccgacccgtatgatgccgcacgctttgcaggcgtattttttgccgttatcggactgacttcttgcggctttgccggtttcaactttttgggcagacaccacgggcgcagcgttgttttaatccatatcggctgtatcgggctgattccggttgcccatttcctcaatcccgccgccgccgcctttgccgccgccggactggtgctgcacggctactcgctggcacgccggcgcgtgattgccgcctctttcctgctcggtacgggttggacgttgatgtcgctggcggcagcttatccggcggcgtttgcgctgatgctgcccctgcccgtgctgatgtttttccgtccgtggcaaagcaggcgtttgatgttgacggcagtcgcctcgcttgcctttgccctgccgcttatgaccgtttacccgctgctcttggcaaaaacgcagcccgcgctgtttgcgcaatggctcaactatcacgttttcggtacgttcggcggcgtgcggcacattcagagggcattcagtttgtttcactatctgaaaaatctgctttggttcgcaccgcccgggctgccgctggcggtttggacggtttgccgcacacgcctgttttcgaccgactgggggattttgggcattgtctggatgcttgccgttttggtgctgctcgcctttaatccgcagcgttttcaagacaacctcgtctggctgctgccgccgcttgccctgttcggcgcggcgcaactggacagcctgaggcgcggcgcggcggcttttgtcaactggttcggcattatggcgttcgggctgtttgccgtgttcctgtggacgggctttttcgccatgaattacggctggcccgccaagcttgccgaacgcgccgcctacttcagcccgtattacgttcccgacatcgatcccattccgatggcggttgccgtactgttcacacccttgtggctgtgggcgattacccggaaaaacatacgcggcaggcaggcggttaccaactgggcggcaggcgttaccctgacctgggctttgctgatgacgctgttcctgccgtggctggacgcggcgaaaagccacgcgcccgtcgtccggagtatggaggcatcgttttccccggaattaaaacgggagctttcagacggcatcgagtgtatcggcataggcggcggcgacctgcacacgcggattgtttggacgcagtacggcacattgccgcaccgcgtcggcgatgtccgttgccgctaccgtatcgtccgcctgccccaaaacgcggatgcgccgcaaggctggcagacggtctggcagggtgcgcgcccgcgcaacaaagacagtaagtttgcactgatacggaaaatcggggaaaatatattaaaaacaacagattga

SEQ ID NO: 602 - protein, 558 aa, Neisseria gonorrhoeae
MLTYTPPDARPPAKTHEKPWLLLLMAFAWLWPGVFSHDLWNPAEPAVYTAVEALAGSPTPLVAHLFGQTDFGIPPVYLWVAAAFKHLLSPWAADPYDAARFAGVFFAVIGLTSCGFAGFNFLGRHHGRSVVLIHIGCIGLIPVAHFLNPAAAAFAAAGLVLHGYSLARRRVIAASFLLGTGWTLMSLAAAYPAAFALMLPLPVLMFFRPWQSRRLMLTAVASLAFALPLMTVYPLLLAKTQPALFAQWLNYHVFGTFGGVRHIQRAFSLFHYLKNLLWFAPPGLPLAVWTVCRTRLFSTDWGILGIVWMLAVLVLLAFNPQRFQDNLVWLLPPLALFGAAQLDSLRRGAAAFVNWFGIMAFGLFAVFLWTGFFAMNYGWPAKLAERAAYFSPYYVPDIDPIPMAVAVLFTPLWLWAITRKNIRGRQAVTNWAAGVTLTWALLMTLFLPWLDAAKSHAPVVRSMEASFSPELKRELSDGIECIGIGGGDLHTRIVWTQYGTLPHRVGDVRCRYRIVRLPQNADAPQGWQTVWQGARPRNKDSKFALIRKIGENILKTTD

SEQ ID NO: 603 - protein, 180 aa, Neisseria meningitidis
CAATCCGCCAAATGGTTATCGGGCCAAACTCTAGTCGGCACAGCAATTGGGATACGCGGGCAGATAAAGCTTGGCGGCAACCTGCATTACGATATATTTACCGGCCGCGCATTGAAAAAGCCCGAATTTTTCCAATCAAGGAAATGGGCAAGCGGTTTTCAGGTAGGCTATACGTTTTAA

SEQ ID NO: 604 - protein, 59 aa, Neisseria meningitidis
QSAKWLSGQTLVGTAIGIRGQIKLGGNLHYDIFTGRALKKPEFFQSRKWASGFQVGYTF

SEQ ID NO: 605 - DNA, 1029 bp, Neisseria meningitidis
atggataattcgggtagtgaggcgacaggaaaataccaaggaaatatcactttctctgccgacaatcctttgggactgagtgatatgttctatgtaaattatggacgttcgattggcggtacgcccgatgaggaaagttttgacggccatcgcaaagaaggcggatcaaacaattacgccgtacattattcagcccctttcggtaaatggacatgggcattcaatcacaatggctaccgttaccatcaggcagtttccggattatcggaagtctatgactataatggaaaaagttacaatactgatttcggcttcaaccgcctgttgtatcgtgatgccaaacgcaaaacctatctcggtgtaaaactgtggatgagggaaacaaaaagttacattgatgatgccgaactgactgtacaacggcgtaaaactgcgggttggttggcagaactttcccacaaagaatatatcggtcgcagtacggcagattttaagttgaaatataaacgcggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgtctgccgagcggggatggtattggcgcaacgatttgagctggcaatttaaaccaggccatcagctttatcttggggctgatgtaggacatgtttcaggacaatccgccaaatggttatcgggccaaactctagtcggcacagcaattgggatacgcgggcagataaagcttggcggcaacctgcattacgatatatttaccggccgcgcattgaaaaagcccgaatttttccaatcaaggaaatgggcaagcggttttcaggtaggctatacgttttaa

SEQ ID NO: 606 - protein, 342 aa, Neisseria meningitidis
MDNSGSEATGKYQGNITFSADNPLGLSDMFYVNYGRSIGGTPDEESFDGHRKEGGSNNYAVHYSAPFGKWTWAFNHNGYRYHQAVSGLSEVYDYNGKSYNTDFGFNRLLYRDAKRKTYLGVKLWMRETKSYIDDAELTVQRRKTAGWLAELSHKEYIGRSTADFKLKYKRGTGMKDALRAPEEAFGEGTSRMKIWTASADVNTPFQIGKQLFAYDTSVHAQWNKTPLTSQDKLAIGGHHTVRGFDGEMSLSAERGWYWRNDLSWQFKPGHQLYLGADVGHVSGQSAKWLSGQTLVGTAIGIRGQIKLGGNLHYDIFTGRALKKPEFFQSRKWASGFQVGYTF

SEQ ID NO: 607 - DNA, 1029 bp, Neisseria gonorrhoeae
atggataattcgggtagtgaggcgacaggaaaataccaaggaaatatcactttctctgccgacaatccttttggactgagtgatatgttctatgtaaattatggacgttcaattggcggtacgcccgatgaggaaaattttgacggccatcgcaaagaaggcggatcaaacaattacgccgtacattattcagcccctttcggtaaatggacatgggcattcaatcacaatggctaccgttaccatcaggcggtttccggattatcggaagtctatgactataatggaaaaagttacaacactgatttcggcttcaaccgcctgttgtatcgtgatgccaaacgcaaaacctatctcagtgtaaaactgtggacgagggaaacaaaaagttacattgatgatgccgaactgactgtacaacggcgtaaaaccacaggttggttggcagaactttcccacaaaggatatatcggtcgcagtacggcagattttaagttgaaatataaacacggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgcctgccgagcggggatggtattggcgcaacgatttgagctggcaatttaaaccaggccatcagctttatcttggggctgatgtaggacatgtttcaggacaatccgccaaatggttatcgggccaaactctagccggcacagcaattgggatacgcgggcagataaagcttggcggcaacctgcattacgatatatttaccggccgtgcattgaaaaagcccgaatattttcagacgaagaaatgggtaacggggtttcaggtgggttattcgttttga

SEQ ID NO: 608 - protein, 342 aa, Neisseria gonorrhoeae
MDNSGSEATGKYQGNITFSADNPFGLSDMFYVNYGRSIGGTPDEENFDGHRKEGGSNNYAVHYSAPFGKWTWAFNHNGYRYHQAVSGLSEVYDYNGKSYNTDFGFNRLLYRDAKRKTYLSVKLWTRETKSYIDDAELTVQRRKTTGWLAELSHKGYIGRSTADFKLKYKHGTGMKDALRAPEEAFGEGTSRMKIWTASADVNTPFQIGKQLFAYDTSVHAQWNKTPLTSQDKLAIGGHHTVRGFDGEMSLPAERGWYWRNDLSWQFKPGHQLYLGADVGHVSGQSAKWLSGQTLAGTAIGIRGQIKLGGNLHYDIFTGRALKKPEYFQTKKWVTGFQVGYSF

SEQ ID NO: 609 - DNA, 332 bp, Neisseria meningitidis
atgcggacgaaatggtcagcagtgagaagctgcttacttgggcggacaccgccgacatcgataccgctttgaacctgttgtaccgtttgcaaaaactcgaattcctctatggcgatgaaaacggtcattcagacggcatcaatttgwcggacgagcaattgccgttgctgatggaacaattgtccggcagcggtaaggcgttattggtcgatcggaacggtctgtatcttgccaacgccaatttccatcatgaggcggcggaagagttggggttgttggcggcagaagtcgcacagatggaaaagaaataccggctgctgattaagaacaac

SEQ ID NO: 610 - protein, 110 aa, Neisseria meningitidis
  misc_feature (49)..(49): Xaa= any amino acid
MRTKWSAVRSCTWADTADIDTALNLLYRLQKLEFLYGDENGHSDGINLXDEQLPLLMEQLSGSGKALLVDRNGLYLANANFHHEAAEELGLLAAEVAQMEKKYRLLIKNN

SEQ ID NO: 611 - DNA, 645 bp, Neisseria meningitidis
atggaatcaacactttcactacaagcaaatttatatccccgcctgactcctgccggtgcattttatgccgtatccagcgatgcccccagtgccggtaaaactttgttgcacagcctgttgaaagcagatgcggacgaaatggtcagcagtgagaagctgcttacttgggcggacaccgccgacatcgataccgctttgaacctgttgtaccgtttgcaaaaactcgaattcctctatggcgatgaaaacggtcattcagacggcatcaatttgtcggacgagcaattgccgttgctgatggaacaattgtccggcagcggtaaggcgttattggtcgatcggaacggtctgtatcttgccaacgccaatttccatcatgaggcggcggaagagttggggttgttggcggcagaagtcgcacagatggaaaagaaataccggctgctgattaagaacaacctgtatatcaacaataacgcttggggcgtttgcgatccttccggtcagagcgaattgacatttttcccattgtatatcggttcaaccaaatttattttggttatcggcggcattcccgatttgggcaaagaggcatttgttactttggtaaggattttataccgccgttacagcaaccgcgtgtaa

SEQ ID NO: 612 - protein, 214 aa, Neisseria meningitidis
MESTLSLQANLYPRLTPAGAFYAVSSDAPSAGKTLLHSLLKADADEMVSSEKLLTWADTADIDTALNLLYRLQKLEFLYGDENGHSDGINLSDEQLPLLMEQLSGSGKALLVDRNGLYLANANFHHEAAEELGLLAAEVAQMEKKYRLLIKNNLYINNNAWGVCDPSGQSELTFFPLYIGSTKFILVIGGIPDLGKEAFVTLVRILYRRYSNRV

SEQ ID NO: 613 - DNA, 684 bp, Neisseria meningitidis
  misc_feature (13)..(13): N= Unknown
  misc_feature (38)..(38): N= Unknown
  misc_feature (83)..(83): N= Unknown
  misc_feature (144)..(144): N= Unknown
  misc_feature (174)..(174): N= Unknown
  misc_feature (446)..(447): N= Unknown
  misc_feature (615)..(615): N= Unknown
  misc_feature (623)..(623): N= Unknown
  misc_feature (626)..(626): N= Unknown
  misc_feature (663)..(663): N= Unknown
atggaatcaacantttcactacaagcaaatttatatcnccgcctgactcctgccggtgcattttatgccgtatccagcgatgnccccagtgccggtaaaactttgttgcacagcctgttgaaagcggatgcggacgaaatggtnagcagtgagaagctgcttacctgggcgganaccgccgacatcgataccgctttgaacctgttgtaccgtttgcaaaaactcgaattcctctatggcgatgaaaacggtcattcagacggcatcaatttgtcggacgagcaattgccgttgctgatggaacaattgtccggcagcggtaaggcgttattggtcgatcggaacggtctgtatcttgccaacgccaatttccatcatgaggcggcggaagagttggggttgttggcggcagaagtcgcacagatggaaaagaaataccggctgcnnattaagaacaacctgtatatcaacaataacgcttggggcgtttgcgatccttccggtcagagcgaattgacatttttcccattgtatatcggttcaaccaaatttattttggttatcggcggcattcccgatttgggcaaagaggcatttgttactttggtaaggatnttataccnccngttacagcaaccgcgtgtaaaacttgggagagaggangggttatgcagcaattattga

SEQ ID NO: 614 - protein, 227 aa, Neisseria meningitidis
  misc_feature (5)..(5): Xaa= any amino acid
  misc_feature (13)..(13): Xaa= any amino acid
  misc_feature (28)..(28): Xaa= any amino acid
  misc_feature (58)..(58): Xaa= any amino acid
  misc_feature (149)..(149): Xaa= any amino acid
  misc_feature (205)..(205): Xaa= any amino acid
  misc_feature (208)..(209): Xaa= any amino acid
  misc_feature (221)..(221): Xaa= any amino acid
MESTXSLQANLYXRLTPAGAFYAVSSDXPSAGKTLLHSLLKADADEMVSSEKLLTWAXTADIDTALNLLYRLQKLEFLYGDENGHSDGINLSDEQLPLLMEQLSGSGKALLVDRNGLYLANANFHHEAAEELGLLAAEVAQMEKKYRLXIKNNLYINNNAWGVCDPSGQSELTFFPLYIGSTKFILVIGGIPDLGKEAFVTLVRXLYXXLQQPRVKLGREXGLCSNY

SEQ ID NO: 615 - DNA, 8 bp, Neisseria gonorrhoeae
  misc_feature (1)..(8): N= Unknown
nnnnnnnn

SEQ ID NO: 616 - protein, 298 aa, Neisseria gonorrhoeae
MRTKWSAVRSCSRADTADIDTALNLLYRLQKLEFLYGDENGHSDGINLSDEQLPLLMEQLSGSGKALLVDRNGLYLANANFHHESAEELGLLAAEVAQMEKKYRLLIRNNLYINNNAWGVCDPSGQSELTFFPLYIGSTKFILVIAGIPDLSKGGICYFGKDFIPPLQQPRVKLGTGGIMRQLLISILEDLNNTSTDIIASAVISTDGLPMATMLPSHLNSDRVGAISATLLALGSRSVQELACGELEQVMIKGKSGYILLSQAGKDAVLVLVAKETGRLGLILLDAKRAARHIAEAI

SEQ ID NO: 617 - DNA, 642 bp, Neisseria gonorrhoeae
atggaatcaacactttcactacaagcgaatttatatccctgcctgactcctgccggtgcattttatgccgtatccagcgatgcccccagtgccggtaaaactttgttgcgcagcctgttgaaagcggatgcggacgaagtggtcagcagtgagaagctgctcgcggcggacaccgccgacatcgataccgctttgaacctgttgtaccgtttgcaaaaactcgaattcctctatggcgatgaaaacggtcattcagacggcatcaatttgtcggacgagcaattgccgttgctgatggaacaattgtccggcagcggtaaggcattattggtcgatcggaacggtctgtatcttgccaacgccaatttccatcatgagtcggcggaagagttggggttgttggcggcagaagtcgcacagatggaaaagaaataccggctgctgattaggaacaacctgtatatcaacaataacgcttggggcgtttgcgatccttccggtcagagcgaattgacatttttcccattgtatatcggttcaaccaaatttattttggttatcgccggcattcccgatttgagcaaagaggcatttgttactttggtaaggattttataccgccgttacagcaaccgcgtgtaa

SEQ ID NO: 618 - protein, 213 aa, Neisseria gonorrhoeae
MESTLSLQANLYPCLTPAGAFYAVSSDAPSAGKTLLRSLLKADADEVVSSEKLLAADTADIDTALNLLYRLQKLEFLYGDENGHSDGINLSDEQLPLLMEQLSGSGKALLVDRNGLYLANANFHHESAEELGLLAAEVAQMEKKYRLLIRNNLYINNNAWGVCDPSGQSELTFFPLYIGSTKFILVIAGIPDLSKEAFVTLVRILYRRYSNRV

SEQ ID NO: 619 - DNA, 408 bp, Neisseria meningitidis
atgacctttttacaacgtttgcaaggtttggcagacaataaaatctgtgcgtttgcatggttcgtcgtccgccgctttgatgaagaacgcgtaccgcagrcggcggcaagcatgacgtttacgacgctgctggcactcgtccccgtgctgaccgtgatggtggcggtcgcttcgattttccccgtgttcgaccgctggtcggattcgttcgtctccttcgtcaaccaaaccattgtgccgcaggcgcggacatggtgttcgactatatcaatgcgttccgcgagcaggcgaaccggctgacggcaatcggcagcgtgatgctggtcgttacctcgctgatgctgattcggacgatagacaatacgttcaaccgcatctggacgggtcaawtyccagcgtccgtggatg

SEQ ID NO: 620 - protein, 136 aa, Neisseria meningitidis
  misc_feature (34)..(34): Xaa= any amino acid
  misc_feature (81)..(81): Xaa= any amino acid
  misc_feature (130)..(131): Xaa= any amino acid
MTFLQRLQGLADNKICAFAWFVVRRFDEERVPQXAASMTFTTLLALVPVLTVMVAVASIFPVFDRWSDSFVSFVNQTIVPXGADMVFDYINAFREQANRLTAIGSVMLVVTSLMLIRTIDNTFNRIWRVXXQRPWM

SEQ ID NO: 621 - DNA, 1221 bp, Neisseria meningitidis
atgacctttttacaacgtttgcaaggtttggcagacaataaaatctgtgcgtttgcatggttcgtcgtccgccgctttgatgaagaacgcgtaccgcaggcggcggcaagcatgacgtttacgacgctgctggcactcgtccccgtgctgaccgtgatggtggcggtcgcttcgattttccccgtgttcgaccgctggtcggattcgttcgtctccttcgtcaaccaaaccattgtgccgcagggcgcggacatggtgttcgactatatcaatgcgttccgcgagcaggcgaaccggctgacggcaatcggcagcgtgatgctggtcgttacctcgctgatgctgattcggacgatagacaatacgttcaaccgcatctggcgggtcaattcccagcgtccgtggatgatgcagtttctcgtctattgggctttactgacgttcgggccgctgtctttgggcgtgggcatttcctttatggtcggctcggtacaggatgccgcgcttgcctcaggtgcgccgcagtggtcgggcgcgttgcgaacggcggcgacgctgaccttcatgacgcttttgctgtgggggctgtaccgcttcgtgccaaaccgcttcgttcccgcgcggcaggcgtttgtcggggctttggcaacagcgttttgtctggaaaccgcgcgctccctcttcacttggtatatgggcaatttcgacggctaccgctcgatttacggcgcgtttgccgccgtgccgttttttctgttgtggctgaacctgttgtggacgctggtcttgggcggcgcggtgctgacttcttcactctcctactggcagggagaagcgttccgcaggggcttcgactcgcgcggacggtttgacgacgtgttgaaaatcctgctgcttctggatgcggcgcaaaaagaaggcaaagccttgcctgttcaggagttcagacggcatatcaatatgggctacgacgagttgggcgagcttttggaaaagctggcgcggcacggctacatctattccggcagacagggttgggtgttgaaaacgggggcggattcgattgagttgaacgaactcttcaagctcttcgtttaccgtccgttgcctgtggaaagggatcatgtgaaccaagctgtcgatgcggtaatgacaccgtgtttgcagactttgaacatgacgctggcagagtttgacgctcaggcgaaaaaacggcagtag

SEQ ID NO: 622 - protein, 406 aa, Neisseria meningitidis
MTFLQRLQGLADNKICAFAWFVVRRFDEERVPQAAASMTFTTLLALVPVLTVMVAVASIFPVFDRWSDSFVSFVNQTIVPQGADMVFDYINAFREQANRLTAIGSVMLVVTSLMLIRTIDNTFNRIWRVNSQRPWMMQFLVYWALLTFGPLSLGVGISFMVGSVQDAALASGAPQWSGALRTAATLTFMTLLLWGLYRFVPNRFVPARQAFVGALATAFCLETARSLFTWYMGNFDGYRSIYGAFAAVPFFLLWLNLLWTLVLGGAVLTSSLSYWQGEAFRRGFDSRGRFDDVLKILLLLDAAQKEGKALPVQEFRRHINMGYDELGELLEKLARHGYIYSGRQGWVLKTGADSIELNELFKLFVYRPLPVERDHVNQAVDAVMTPCLQTLNMTLAEFDAQAKKRQ

SEQ ID NO: 623 - DNA, 1227 bp, Neisseria meningitidis
  misc_feature (195)..(195): N= Unknown
  misc_feature (258)..(258): N= Unknown
  misc_feature (338)..(338): N= Unknown
  misc_feature (480)..(480): N= Unknown
  misc_feature (560)..(560): N= Unknown
  misc_feature (596)..(596): N= Unknown
  misc_feature (627)..(627): N= Unknown
  misc_feature (729)..(729): N= Unknown
  misc_feature (848)..(848): N= Unknown
  misc_feature (922)..(922): N= Unknown
atgacctttttacaacgtttgcaaggtttggcagacaataaaatctgtgcgtttgcatggttcgtcgtccgccgctttgatgaagaacgcgtaccgcaggcggcggcaagcatgacgtttacgacactgctggcactcgtccccgtgctgaccgtgatggtggcggtcgcttcgattttccccgtgttcgaccgntggtcggattcgttcgtctccttcgtcaaccaaaccattgtgccgcagggcgcggacatggtnttcgactatatcaatgcgttccgcgagcaggcgaaccggctgacggcaatcggcagcgtgatgctggtcgttacctcgcngatgctgattcggacgatagacaatacgttcaaccgcatctggcgggtcaattcccagcgtccgtggatgatgcagtttctcgtctattgggctttactgacgttcgggccgctgtctttgggcgtgggcatttcctttatngtcggctcggtacaggatgccgcgcttgcctcaggtgcgccgcagtggtcgggcgcgttgcgaacggcggcgacgctgancttcatgacgcttttgctgtgggggctgtaccgctncgtgccaaaccgcttcgttcccgcgcggcangcgtttgtcggggctttggcaacagcgttctgtctggaaaccgcgcgttccctctttacttggtatatgggcaatttcgacggctaccgctcgatttacggngcgtttgccgccgtgccgttttttctgttgtggctgaacctgttgtggacgctggtcttgggcggcgcggtgctgacttcttcactctcctactggcagggagaagcgttccgcagggncttcgactcgcgcggacggtttgacgacgtgttgaaaatcctgctgcttctggatgcggcgcaaaaagaaggcnaagccttgcctgttcaggagttcagacggcatatcaatatgggctacgacgagttgggcgagcttttggaaaagctggcgcggcacggctacatctattccggcagacagggttgggtgttgaaaacgggggcggattcgattgagttgaacgaactcttcaagctcttcgtttaccgtccgttgcctgtggaaagggatcatgtgaaccaagctgtcgatgcggtaatgatgccgtgtttgcagactttgaacatgacgctggcagagtttgacgctcaggcgaaaaaacagcagcaatcttga

SEQ ID NO: 624 - protein, 408 aa, Neisseria meningitidis
  misc_feature (113)..(113): Xaa= any amino acid
  misc_feature (160)..(160): Xaa= any amino acid
  misc_feature (187)..(187): Xaa= any amino acid
  misc_feature (199)..(199): Xaa= any amino acid
  misc_feature (209)..(209): Xaa= any amino acid
  misc_feature (283)..(283): Xaa= any amino acid
  misc_feature (308)..(308): Xaa= any amino acid
MTFLQRLQGLADNKICAFAWFVVRRFDEERVPQAAASMTFTTLLALVPVLTVMVAVASIFPVFDRWSDSFVSFVNQTIVPQGADMVFDYINAFREQANRLTAIGSVMLVVTSXMLIRTIDNTFNRIWRVNSQRPWMMQFLVYWALLTFGPLSLGVGISFXVGSVQDAALASGAPQWSGALRTAATLXFMTLLLWGLYRXVPNRFVPARXAFVGALATAFCLETARSLFTWYMGNFDGYRSIYGAFAAVPFFLLWLNLLWTLVLGGAVLTSSLSYWQGEAFRRXFDSRGRFDDVLKILLLLDAAQKEGXALPVQEFRRHINMGYDELGELLEKLARHGYIYSGRQGWVLKTGADSIELNELFKLFVYRPLPVERDHVNQAVDAVMMPCLQTLNMTLAEFDAQAKKQQQS

SEQ ID NO: 625 - DNA, 8 bp, Neisseria gonorrhoeae
  misc_feature (1)..(8): N= Unknown
nnnnnnnn

SEQ ID NO: 626 - protein, 408 aa, Neisseria gonorrhoeae
MTFLQCWQGSADNKICAFAWFVIRRFSEERVPQAAASMTFTTLLALVPVLTVMVAVASIFPVFDRWSDSFVSFVNQTIVPQGADMVFDYIDAFRDQANRLTAIGSVMLVVTSLMLIRTIDNAFNRIWRVNTQRPWMMQFLVYWALLTFGPLSLGVGISFMVGSVQDSVLSSGAQQWADALKTAARLAFMTLLLWGLYRFVPNRFVPARQAFVGALITAFCLETARFLFTWYMGNFDGYRSIYGAFAAVPFFLLWLNLLWTLVLGGAVLTSSLSYWQGEAFRRGFDSRGRFDDVLKILLLLDAAQKEGRTLSVQEFRRHINMGYDELGELLEKLARYGYIYSGRQGWVLKTGADSIELSELFKLFVYRPLPVERDHVNQAVDAVMTPCLQTLNMTLAEFDAQAKKQQQS

SEQ ID NO: 627 - DNA, 1227 bp, Neisseria gonorrhoeae
atgacctttttacaacgttggcaaggtttggcggacaataaaatctgtgcatttgcatggttcgtcatccgccgtttcagtgaagagcgcgtaccgcaggcagcggcgagcatgacgtttacgacactgctggcactcgtccccgtactgaccgtaatggtcgcggtcgcttcgattttccccgtgttcgaccgctggtcggattcgttcgtctccttcgtcaaccaaaccattgtgccgcagggcgcggatatggtgttcgactatatcgacgcattccgcgatcaggcaaaccggctgaccgccatcggcagcgtgatgctggtcgtaacctcgctgatgctgattcggacgatagacaatgcgttcaaccgcatctggcgggttaacacgcaacgcccctggatgatgcagttcctcgtttattgggcgttgctgactttcgggcctttgtctttgggtgtgggcatttcctttatggtcgggtcggttcaagactccgtactctcctccggagcgcaacaatgggcggacgcgttgaagacggcggcaaggctggctttcatgacgcttttgctgtgggggctgtaccgcttcgtgcccaaccgcttcgtgcccgcccggcaggcgtttgtcggagctttgattacggcattctgcctggagacggcacgtttcctgttcacctggtatatgggcaatttcgacggctaccgctcgatttacggcgcatttgccgccgtgccgtttttcctgctgtggttaaacctgctgtggacgctggtcttgggcggggcggtgctgacttcgtcgctgtcttattggcagggcgaggccttccgcaggggattcgactcgcgcggacggtttgacgacgtgttgaaaatcctgctgcttctggatgcggcgcaaaaagaaggccgaaccctgtccgttcaggagttcagacggcatatcaatatgggttacgatgaattgggcgagcttttggaaaagctggcgcggtacggctatatctattccggcagacagggctgggttttgaaaacgggggcggattcgattgagttgagcgaactcttcaagctcttcgtgtaccgcccgttgcctgtggaaagggatcatgtgaaccaagctgtcgatgcggtaatgacgccgtgtttgcagactttgaacatgacgctggcggagtttgacgctcaggcgaaaaaacagcagcagtcttga

SEQ ID NO: 628 - protein, 408 aa, Neisseria gonorrhoeae
MTFLQRWQGLADNKICAFAWFVIRRFSEERVPQAAASMTFTTLLALVPVLTVMVAVASIFPVFDRWSDSFVSFVNQTIVPQGADMVFDYIDAFRDQANRLTAIGSVMLVVTSLMLIRTIDNAFNRIWRVNTQRPWMMQFLVYWALLTFGPLSLGVGISFMVGSVQDSVLSSGAQQWADALKTAARLAFMTLLLWGLYRFVPNRFVPARQAFVGALITAFCLETARFLFTWYMGNFDGYRSIYGAFAAVPFFLLWLNLLWTLVLGGAVLTSSLSYWQGEAFRRGFDSRGRFDDVLKILLLLDAAQKEGRTLSVQEFRRHINMGYDELGELLEKLARYGYIYSGRQGWVLKTGADSIELSELFKLFVYRPLPVERDHVNQAVDAVMTPCLQTLNMTLAEFDAQAKKQQQS

SEQ ID NO: 629 - DNA, 228 bp, Neisseria meningitidis
agacacgcccgccgcatccgcatcgacaccgccatcaaccccgaactggaagccctcgccgaacacctccactaccaatggcagggcttcctctggctcagcaccgatatgcgtcaggaaatttccgccctcgtcatcctgctgcaacgcacccgccgcaaatggctggatgcccacgaacgccaacacctgcgccaaagcctgcttgaaacacgggaacacggctga

SEQ ID NO: 630 - protein, 75 aa, Neisseria meningitidis
RHARRIRIDTAINPELEALAEHLHYQWQGFLWLSTDMRQEISALVILLQRTRRKWLDAHERQHLRQSLLETREHG

SEQ ID NO: 631 - DNA, 1128 bp, Neisseria meningitidis
atgaacacctcgcaacgcaaccgcctcgtcagccgctggctcaactcctacgaacgctaccgctaccgccgcctcatccacgccgtccggctcggcggggccgtcctgttcgccaccgcctccgcccggctgctccacctccaacacggcgagtggatagggatgaccgtcttcgtcgtcctcggcatgctccagtttcaaggggcgatttactccaaggcggtggaacgtatgctcggcacggtcatcgggctgggcgcgggtttgggcgttttatggctgaaccagcattatttccacggcaacctcctcttctacctcaccgtcggcacggcaagcgcactggccggctgggcggcggtcggcaaaaacggctacgtccctatgctggcagggctgacgatgtgtatgctcatcggcgacaacggcagcgaatggctcgacagcggactcatgcgcgccatgaacgtcctcatcggcgcggccatcgccatcgccgccgccaaactgctgccgctgaaatccacactgatgtggcgtttcatgcttgccgacaacctggccgactgcagcaaaatgattgccgaaatcagcaacggcaggcgcatgacccgcgaacgcctcgaggagaacatggcgaaaatgcgccaaatcaacgcacgcatggtcaaaagccgcagccatctcgccgccacatcgggcgaaagccgcatcagccccgccatgatggaagccatgcagcacgcccaccgtaaaatcgtcaacaccaccgagctgctcctgaccaccgccgccaagctgcaatctcccaaactcaacggcagcgaaatccggctgcttgaccgccacttcacactgctccaaaccgacctgcaacaaaccgtcgcccttatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacggctga

SEQ ID NO: 632 - protein, 375 aa, Neisseria meningitidis
MNTSQRNRLVSRWLNSYERYRYRRLIHAVRLGGAVLFATASARLLHLQHGEWIGMTVFVVLGMLQFQGAIYSKAVERMLGTVIGLGAGLGVLWLNQHYFHGNLLFYLTVGTASALAGWAAVGKNGYVPMLAGLTMCMLIGDNGSEWLDSGLMRAMNVLIGAAIAIAAAKLLPLKSTLMWRFMLADNLADCSKMIAEISNGRRMTRERLEENMAKMRQINARMVKSRSHLAATSGESRISPAMMEAMQHAHRKIVNTTELLLTTAAKLQSPKLNGSEIRLLDRHFTLLQTDLQQTVALINGRHARRIRIDTAINPELEALAEHLHYQWQGFLWLSTNMRQEISALVILLQRTRRKWLDAHERQHLRQSLLETREHG

SEQ ID NO: 633 - DNA, 1128 bp, Neisseria meningitidis
atgaacacctcgcaacgcaaccgcctcgtcagccgctggctcaactcctacgaacgctaccgctaccgccgcctcatccacgccgtccggctcggcggggccgtcctgttcgccaccgcctccgcccggctgctccacctccaacacggcgagtggatagggatgaccgtcttcgtcgtcctcggcatgctccagtttcaaggggcgatttactccaaggcggtggaacgtatgctcggcacggtcatcgggctgggcgcgggtttgggcgttttatggctgaaccagcattatttccacggcaacctcctcttctacctcaccgtcggcacggcaagcgcactggccggctgggcggcggtcggcaaaaacggctacgtccctatgctggcggggctgacgatgtgcatgctcatcggcgacaacggcagcgaatggttcgacagcggcctgatgcgcgcgatgaacgtcctcatcggcgcggccatcgccatcgccgccgccaaactgctgccgctgaaatccacactgatgtggcgtttcatgcttgccgacaacctgaccgactgcagcaaaatgattgccgaaatcagcaacggcaggcgcatgacccgcgaacgcctcgaagagaacatggcgaaaatgcgccaaatcaacgcacgcatggtcaaaagccgcagccacctcgccgccacatcgggcgaaagccgcatcagccccgccatgatggaagccatgcagcacgcccaccgtaaaattgtcaacaccaccgagctgctcctgaccaccgccgccaagctgcaatctcccaaactcaacggcagcgaaatccggctgcttgaccgccacttcacactgctccaaaccgacctgcaacaaaccgtcgcccttatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacagttga

SEQ ID NO: 634 - protein, 375 aa, Neisseria meningitidis
MNTSQRNRLVSRWLNSYERYRYRRLIHAVRLGGAVLFATASARLLHLQHGEWIGMTVFVVLGMLQFQGAIYSKAVERMLGTVIGLGAGLGVLWLNQHYFHGNLLFYLTVGTASALAGWAAVGKNGYVPMLAGLTMCMLIGDNGSEWFDSGLMRAMNVLIGAAIAIAAAKLLPLKSTLMWRFMLADNLTDCSKMIAEISNGRRMTRERLEENMAKMRQINARMVKSRSHLAATSGESRISPAMMEAMQHAHRKIVNTTELLLTTAAKLQSPKLNGSEIRLLDRHFTLLQTDLQQTVALINGRHARRIRIDTAINPELEALAEHLHYQWQGFLWLSTNMRQEISALVILLQRTRRKWLDAHERQHLRQSLLETREHS

SEQ ID NO: 635 - DNA, 8 bp, Neisseria gonorrhoeae
  misc_feature (1)..(8): N= Unknown
nnnnnnnn

SEQ ID NO: 636 - protein, 409 aa, Neisseria gonorrhoeae
MSGVRFPSPAPIPSTDPPSGSLCFFTFPLQTASDMNSSQRKRLSGRWLNSYERYRHRRLIHAVRLGGTVLFATALARLLHLQHGEWIGMTVFVVLGMLQFQGAIYSNAVERMLGTVIGLGAGLGVLWLNQHYFHGNLLFYLTIGTASALAGWAAVGKNGYVPMLAGLTMCMLIGDNGSEWLDSGLMRAMNVLIGAAIAIAAAKLLPLKSTLMWRFMLADNLADCSKMIAEISNGRRMTRERLEQNMVKMRQINARMVKSRSHLAATSGESRISPSMMEAMQHAHRKIVNTTELLLTTAAKLQSPKLNGSEIRLLDRHFTLLQTDLQQTAALINGRHARRIRIDTAINPELEALAEHLHYQWQGFLWLSTNMRQEISALVIPLQRTRRKWLDAHERQHLRQSLLETREHG

SEQ ID NO: 637 - DNA, 1128 bp, Neisseria gonorrhoeae
atgaactcctcgcaacgcaaacgcctttccggccgctggctcaactcctacgaacgctaccgccaccgccgcctcatacatgccgtgcggctcggcggaaccgtcctgttcgccaccgcactcgcccggctactccacctccaacacggcgaatggatagggatgaccgtcttcgtcgtcctcggcatgctccagttccaaggcgcgatttactccaacgcggtggaacgtatgctcggtacggtcatcgggctgggcgcgggtttgggcgttttatggctgaaccagcattatttccacggcaacctcctcttctacctgaccatcggcacggcaagcgcactggccggctgggcggcggtcggcaaaaacggctacgtccctatgctggcggggctgacgatgtgcatgctcatcggcgacaacggcagcgaatggctcgacagcggcctgatgcgcgcgatgaacgtcctcatcggcgccgccatcgccattgccgccgccaaactgctgccgctgaaatccacactgatgtggcgtttcatgcttgccgacaacctggccgactgcagcaaaatgattgccgaaatcagcaacggcaggcgtatgacgcgcgaacgtttggagcagaatatggtcaaaatgcgccaaatcaacgcacgcatggtcaaaagccgcagccacctcgccgccacatcgggcgaaagccgcatcagcccctccatgatggaagccatgcagcacgcccaccgcaaaatcgtcaacaccaccgagctgctcctgaccaccgccgccaagctgcaatctcccaaactcaacggcagcgaaatccggctgctcgaccgccacttcacactgctccaaaccgacctgcaacaaaccgccgccctcatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacggctga

SEQ ID NO: 638 - protein, 375 aa, Neisseria gonorrhoeae
MNSSQRKRLSGRWLNSYERYRHRRLIHAVRLGGTVLFATALARLLHLQHGEWIGMTVFVVLGMLQFQGAIYSNAVERMLGTVIGLGAGLGVLWLNQHYFHGNLLFYLTIGTASALAGWAAVGKNGYVPMLAGLTMCMLIGDNGSEWLDSGLMRAMNVLIGAAIAIAAAKLLPLKSTLMWRFMLADNLADCSKMIAEISNGRRMTRERLEQNMVKMRQINARMVKSRSHLAATSGESRISPSMMEAMQHAHRKIVNTTELLLTTAAKLQSPKLNGSEIRLLDRHFTLLQTDLQQTAALINGRHARRIRIDTAINPELEALAEHLHYQWQGFLWLSTNMRQEISALVILLQRTRRKWLDAHERQHLRQSLLETREHG

SEQ ID NO: 639 - DNA, 710 bp, Neisseria meningitidis
gccgaagacacgcgcgttaccgcacagcttttgagcgcgtacggcattcagggcaaactcgtcagtgtgcgcgaacacaacgaacggcagatggcggacaagattgtcggctatctttcagacggcatggttgtggcacaggtttccgatgcgggtacgccggccgtgtgcgacccgggcgcgaaactcgcccgccgcgtgcgtgaggccgggtttaaagtcgttcccgtcgtgggcgcaacgcggtgatggcggctttgagcgtggccggtgtggaaggatccgatttttatttcaacggttttgtaccgccgaaatcgggagaacgcaggaaactgtttgccaaatgggtgcgggcggcgtttcctatcgtcatgtttgaaacgccgcaccgcatcggtgcagcgcttgccgatatggcggaactgttccccgaacgccgattaatgctggcgcgcgaaattacgaaaacgtttgaaacgttcttaagcggcacggttggggaaattcagacggcattgtctgccgacggcgaccaatcgcgcggcgagatggtgttggtgctttatccggcgcaggatgaaaaacacgaaggcttgtccgagtccgcgcaaaacatcatgaaaatcctcacagccgagctgccgaccaaacaggcggcggagcttgctgccaaaatcacgggcgagggaaagaaagctttgtacgat

SEQ ID NO: 640 - protein, 237 aa, Neisseria meningitidis
  misc_feature (81)..(81): Xaa= any amino acid
AEDTRVTAQLLSAYGIQGKLVSVREHNERQMADKIVGYLSDGMVVAQVSDAGTPAVCDPGAKLARRVREAGFKVVPVVGAXAVMAALSVAGVEGSDFYFNGFVPPKSGERRKLFAKWVRAAFPIVMFETPHRIGAALADMAELFPERRLMLAREITKTFETFLSGTVGEIQTALSADGDQSRGEMVLVLYPAQDEKHEGLSESAQNIMKILTAELPTKQAAELAAKITGEGKKALYD

SEQ ID NO: 641 - DNA, 876 bp, Neisseria meningitidis; identical to SEQ ID NO: 287

SEQ ID NO: 642 - protein, 291 aa, Neisseria meningitidis; identical to SEQ ID NO: 288

SEQ ID NO: 643 - DNA, 8 bp, Neisseria gonorrhoeae
  misc_feature (1)..(8): N= Unknown
nnnnnnnn

SEQ ID NO: 644 - protein, 300 aa, Neisseria gonorrhoeae; identical to SEQ ID NO: 292

SEQ ID NO: 645 - DNA, 876 bp, Neisseria gonorrhoeae; identical to SEQ ID NO: 293

SEQ ID NO: 646 - protein, 291 aa, Neisseria gonorrhoeae; identical to SEQ ID NO: 294

SEQ ID NO: 647 - DNA, 2938 bp, Neisseria meningitidis
  misc_feature (2439)..(2439): N= Unknown
atgaaaacaaccgacaaacggacaaccgaaacacaccgcaaagccccgaaaaccggtcgcatccgcttctcgctgcttacttagccatatgcctgtcgttcggcattcttccccaagcctgggcgggacacacttatttcggcatcaactaccaatactatcgcgactttgccgaaaataaaggcaagtttgcagtcggggcgaaagatattgaggtttacaacaaaaaaggggagttggtcggcaaatcaatgacaaaagccccgatgattgatttttctgtggtgtcgcgtaacggcgtggcggcattggtgggcgtatcaatatattgtgagcgtggcacataacggcggctataacaacgttgattttggtgcggaaggaakaatatcccgatcaacawcgwwttacttataaaattgtgaaacggaataattataaagcagggactaaaggccatccttatggcggcgattatcatatgccgcgtttgcataaatwtgtcacagatgcagaacctgttgaaatgaccagttatatggatgggcggaaatatatcgatcaaaataattaccctgaccgtgttcgtattggggcaggcaggcaatattggcgatctgatgaagatgagcccaataaccgcgaaagttcatatcatattgcaagtggctcaccaatgtttatctatgatgcccaaaagcaaaagtggttaattaatggggtattgcaaacgggcaacccctatataggaaaaagcaatggcttccagctggttcgtaaagattggttctatgatgaaatctttgctggagatacccattcagtattctacgaaccacgtcaaaatgggaaatactcttttaacgacgataataatggcacaggaaaaatcaatgccaaacatgaacacaattctctgcctaatagattaaaaacacgaaccgttcaattgtttaatgtttctttatccgagacagcaagagaacctgtttatcatgctgcaggtggtgtcaacagttatcgacccagactgaataatggagaaaatatttcctttattgacgaaggaaaaggcgaattgatacttaccagcaacatcaatcaaggtgctggaggattatatttccaaggagattttacggtctcgcctgaaaataacgaaacttggcaaggcgcgggcgttcatatcagtgaagacagtaccgttacttggaaagtaaacggcgtggcaaacgaccgcctgtccaaaatcggcaaaggcacgctggataaagtgactgcttcattgactaagaccgacatcagcggcaatgtcgatcttgccgatcacgctcatttaaatctcacagggcttgccacactcaacggcaatcttagtgcaaatggcgatacacgttatacagtcagccacaacgccacccaaaacggcaaccktagcctcgtggsaatgcccaagcaacatttaatcaagccacattaaacggcaacacatcggcttcgggcaatgcttcatttaatctaagcgaccacgccgtacaaaacggcagtctgacgctttccggcaacgctaaggcaaacgtaagccattccgcactcaacggtaatgtctccctagccgataaggcagtattccattttgaaagcagccgctttaccggacaaatcagcggcggcaaggatacggcattacacttaaaagacagcgaatggacgctgccgtcaggarcggaattaggcaatttaaaccttgacaacgccaccattacactcaattccgcctatcgccacgatgcggcaggggcgcaaaccggcagtgcgacagatgcgccgcgccgccgttcgcgccgttcgcgccgttccctattatmcgttacaccgccaacttcggtagaatcccgtttcaacacgctgacggtaaacggcaaattgaacggtcagggaacattccgctttatgtcggaactcttcggctaccgcagcgacaaattgaagctggcggaaagttccgaaggcacttacaccttggcggtcaacaataccggcaacgaacctgcaagcctcgaacaattgacggtagtggaaggaaaagacaacaaaccgctgtccgaaaaccttaatttcaccctgcaaaacgaacacgtcgatgcaggcgcgtggttagaccgcgtatttgccgaagaccgccgcaacgccgtttggacaagcggcatccgggacaccaaacactaccgttcgcaagatttccgcgcctaccgccaacaaaccgacctgcgccaaatcggtatgcagaaaaacctcggcagcgggcgcgtcggcatcctgttttcgcacaaccggaccgaaaacaccttcgacgacggcatcggcaactcggcacggcttgcccacggcgccgttttcgggcaatacggcatcgacaggttctacatcggcatcagncgcgggcgcgggttttagcagcggcagcctttcagacggcatcggagsmaaawtccgccgccgcgtgctgcattacggcattcaggcacgataccgcgccggtttcggcggattcggcatcgaaccgcacatcggcgcaacgcgctatttcgtccaaaaagcggattaccgctacgaaaacgtcaatatcgccacccccggccttgcattcaaccgctaccgcgcgggcattaaggcagattattcattcaaaccggcgcaacacatttccatcacgccttatttgagcctgtcctataccgatgccgcttcgggcaaagtccgaacacgcgtcaataccgccgtattggctcaggatttcggcaaaacccgcagtgcggaatggggcgtaaacgccgaaatcaaaggtttcacgctgtccctccacgctgccgccgccaaaggcccgcaactggaagcgcaacacagcgcgggcatcaaattaggctaccgctggtaa

SEQ ID NO: 648 - protein, 979 aa, Neisseria meningitidis
  misc_feature (24)..(24): Xaa= any amino acid
  misc_feature (129)..(129): Xaa= any amino acid
  misc_feature (132)..(132): Xaa= any amino acid
  misc_feature (135)..(135): Xaa= any amino acid
  misc_feature (137)..(137): Xaa= any amino acid
  misc_feature (168)..(168): Xaa= any amino acid
  misc_feature (479)..(479): Xaa= any amino acid
  misc_feature (483)..(483): Xaa= any amino acid
  misc_feature (577)..(577): Xaa= any amino acid
  misc_feature (624)..(624): Xaa= any amino acid
  misc_feature (830)..(830): Xaa= any amino acid
  misc_feature (832)..(832): Xaa= any amino acid
MKTTDKRTTETHRKAPKTGRIRFXAAYLAICLSFGILPQAWAGHTYFGINYQYYRDFAENKGKFAVGAKDIEVYNKKGELVGKSMTKAPMIDFSVVSRNGVAALVGVQYIVSVAHNGGYNNVDFGAEGXNIXDQXRXTYKIVKRNNYKAGTKGHPYGGDYHMPRLHKXVTDAEPVEMTSYMDGRKYIDQNNYPDRVRIGAGRQYWRSDEDEPNNRESSYHIASGSPMFIYDAQKQKWLINGVLQTGNPYIGKSNGFQLVRKDWFYDEIFAGDTHSVFYEPRQNGKYSFNDDNNGTGKINAKHEHNSLPNRLKTRTVQLFNVSLSETAREPVYHAAGGVNSYRPRLNNGENISFIDEGKGELILTSNINQGAGGLYFQGDFTVSPENNETWQGAGVHISEDSTVTWKVNGVANDRLSKIGKGTLDKVTASLTKTDISGNVDLADHAHLNLTGLATLNGNLSANGDTRYTVSHNATQNGNXSLVXNAQATFNQATLNGNTSASGNASFNLSDHAVQNGSLTLSGNAKANVSHSALNGNVSLADKAVFHFESSRFTGQISGGKDTALHLKDSEWTLPSGXELGNLNLDNATITLNSAYRHDAAGAQTGSATDAPRRRSRRSRRSLLXVTPPTSVESRFNTLTVNGKLNGQGTFRFMSELFGYRSDKLKLAESSEGTYTLAVNNTGNEPASLEQLTVVEGKDNKPLSENLNFTLQNEHVDAGAWLDRVFAEDRRNAVWTSGIRDTKHYRSQDFRAYRQQTDLRQIGMQKNLGSGRVGILFSHNRTENTFDDGIGNSARLAHGAVFGQYGIDRFYIGISAGAGFSSGSLSDGIGXKXRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 649 - DNA, 4374 bp, Neisseria meningitidis
atgaaaacaaccgacaaacggacaaccgaaacacaccgcaaagccccgaaaaccggccgcatccgcttctcgcctgcttacttagccatatgcctgtcgttcggcattcttccccaagcctgggcgggacacacttatttcggcatcaactaccaatactatcgcgactttgccgaaaataaaggcaagtttgcagtcggggcgaaagatattgaggtttacaacaaaaaaggggagttggtcggcaaatcaatgacaaaagccccgatgattgatttttctgtggtgtcgcgtaacggcgtggcggcattggtgggcgatcaatatattgtgagcgtggcacataacggcggctataacaacgttgattttggtgcggaaggaagaaatcccgatcaacatcgttttacttataaaattgtgaaacggaataattataaagcagggactaaaggccatccttatggcggcgattatcatatgccgcgtttgcataaatttgtcacagatgcagaacctgttgaaatgaccagttatatggatgggcggaaatatatcgatcaaaataattaccctgaccgtgttcgtattggggcaggcaggcaatattggcgatctgatgaagatgagcccaataaccgcgaaagttcatatcatattgcaagtgcgtattcttggctcgttggtggcaatacctttgcacaaaatggatcaggtggtggcacagtcaacttaggtagtgaaaaaattaaacatagcccatatggttttttaccaacaggaggctcatttggcgacagtggctcaccaatgtttatctatgatgcccaaaagcaaaagtggttaattaatggggtattgcaaacgggcaacccctatataggaaaaagcaatggcttccagctggttcgtaaagattggttctatgatgaaatctttgctggagatacccattcagtattctacgaaccacgtcaaaatgggaaatactcttttaacgacgataataatggcacaggaaaaatcaatgccaaacatgaacacaattctctgcctaatagattaaaaacacgaaccgttcaattgtttaatgtttctttatccgagacagcaagagaacctgtttatcatgctgcaggtggtgtcaacagttatcgacccagactgaataatggagaaaatatttcctttattgacgaaggaaaaggcgaattgatacttaccagcaacatcaatcaaggtgctggaggattatatttccaaggagattttacggtctcgcctgaaaataacgaaacttggcaaggcgcgggcgttcatatcagtgaagacagtaccgttacttggaaagtaaacggcgtggcaaacgaccgcctgtccaaaatcggcaaaggcacgctgcacgttcaagccaaaggggaaaaccaaggctcgatcagcgtgggcgacggtacagtcattttggatcagcaggcagacgataaaggcaaaaaacaagcctttagtgaaatcggcttggtcagcggcaggggtacggtgcaactgaatgccgataatcagttcaaccccgacaaactctatttcggctttcgcggcggacgtttggatttaaacgggcattcgctttcgttccaccgtattcaaaataccgatgaaggggcgatgattgtcaaccacaatcaagacaaagaatccaccgttaccattacaggcaataaagatattgctacaaccggcaataacaacagcttggatagcaaaaaagaaattgcctacaacggttggtttggcgagaaagatacgaccaaaacgaacgggcggctcaaccttgtttaccagcccgccgcagaagaccgcaccctgctgctttccggcggaacaaatttaaacggcaacatcacgcaaacaaacggcaaactgtttttcagcggcagaccaacaccgcacgcctacaatcatttaaacgaccattggtcgcaaaaagagggcattcctcgcggggaaatcgtgtgggacaacgactggatcaaccgcacatttaaagcggaaaacttccaaattaaaggcggacaggcggtggtttcccgcaatgttgccaaagtgaaaggcgattggcatttgagcaatcacgcccaagcagtttttggtgtcgcaccgcatcaaagccacacaatctgtacacgttcggactggacgggtctgacaaattgtgtcgaaaaaaccattaccgacgataaagtgattgcttcattgactaagaccgacatcagcggcaatgtcgatcttgccgatcacgctcatttaaatctcacagggcttgccacactcaacggcaatcttagtgcaaatggcgatacacgttatacagtcagccacaacgccacccaaaacggcaaccttagcctcgtgggcaatgcccaagcaacatttaatcaagccacattaaacggcaacacatcggcttcgggcaatgcttcatttaatctaagcgaccacgccgtacaaaacggcagtctgacgctttccggcaacgctaaggcaaacgtaagccattccgcactcaacggtaatgtctccctagccgataaggcagtattccattttgaaagcagccgctttaccggacaaatcagcggcggcaaggatacggcattacacttaaaagacagcgaatggacgctgccgtcaggcacggaattaggcaatttaaaccttgacaacgccaccattacactcaattccgcctatcgccacgatgcggcaggggcgcaaaccggcagtgcgacagatgcgccgcgccgccgttcgcgccgttcgcgccgttccctattatccgttacaccgccaacttcggtagaatcccgtttcaacacgctgacggtaaacggcaaattgaacggtcagggaacattccgctttatgtcggaactcttcggctaccgcagcgacaaattgaagctggcggaaagttccgaaggcacttacaccttggcggtcaacaataccggcaacgaacctgcaagcctcgaacaattgacggtagtggaaggaaaagacaacaaaccgctgtccgaaaaccttaatttcaccctgcaaaacgaacacgtcgatgccggcgcgtggcgttaccaactcatccgcaaagacggcgagttccgcctgcataatccggtcaaagaacaagagctttccgacaaactcggcaaggcagaagccaaaaaacaggcggaaaaagacaacgcgcaaagccttgacgcgctgattgcggccgggcgcgatgccgtcgaaaagacagaaagcgttgccgaaccggcccggcaggcaggcggggaaaatgtcggcattatgcaggcggaggaagagaaaaaacgggtgcaggcggataaagacaccgccttggcgaaacagcgcgaagcggaaacccggccggctaccaccgccttcccccgcgcccgccgcgcccgccgggatttgccgcaactgcaaccccaaccgcagccccaaccgcagcgcgacctgatcagccgttatgccaatagcggtttgagtgaattttccgccacgctcaacagcgttttcgccgtacaggacgaattagaccgcgtatttgccgaagaccgccgcaacgccgtttggacaagcggcatccgggacaccaaacactaccgttcgcaagatttccgcgcctaccgccaacaaaccgacctgcgccaaatcggtatgcagaaaaacctcggcagcgggcgcgtcggcatcctgttttcgcacaaccggaccgaaaacaccttcgacgacggcatcggcaactcggcacggcttgcccacggcgccgttttcgggcaatacggcatcgacaggttctacatcggcatcagcgcgggcgcgggttttagcagcggcagcctttcagacggcatcggaggcaaaatccgccgccgcgtgctgcattacggcattcaggcacgataccgcgccggtttcggcggattcggcatcgaaccgcacatcggcgcaacgcgctatttcgtccaaaaagcggattaccgctacgaaaacgtcaatatcgccacccccggccttgcattcaaccgctaccgcgcgggcattaaggcagattattcattcaaaccggcgcaacacatttccatcacgccttatttgagcctgtcctataccgatgccgcttcgggcaaagtccgaacacgcgtcaataccgccgtattggctcaggatttcggcaaaacccgcagtgcggaatggggcgtaaacgccgaaatcaaaggtttcacgctgtccctccacgctgccgccgccaaaggcccgcaactggaagcgcaacacagcgcgggcatcaaattaggctaccgctggtaa

SEQ ID NO: 650 - protein, 1457 aa, Neisseria meningitidis
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGRNPDQHRFTYKIVKRNNYKAGTKGHPYGGDYHMPRLHKFVTDAEPVEMTSYMDGRKYIDQNNYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPRQNGKYSFNDDNNGTGKINAKHEHNSLPNRLKTRTVQLFNVSLSETAREPVYHAAGGVNSYRPRLNNGENISFIDEGKGELILTSNINQGAGGLYFQGDFTVSPENNETWQGAGVHISEDSTVTWKVNGVANDRLSKIGKGTLHVQAKGENQGSISVGDGTVILDQQADDKGKKQAFSEIGLVSGRGTVQLNADNQFNPDKLYFGFRGGRLDLNGHSLSFHRIQNTDEGAMIVNHNQDKESTVTITGNKDIATTGNNNSLDSKKEIAYNGWFGEKDTTKTNGRLNLVYQPAAEDRTLLLSGGTNLNGNITQTNGKLFFSGRPTPHAYNHLNDHWSQKEGIPRGEIVWDNDWINRTFKAENFQIKGGQAVVSRNVAKVKGDWHLSNHAQAVFGVAPHQSHTICTRSDWTGLTNCVEKTITDDKVIASLTKTDISGNVDLADHAHLNLTGLATLNGNLSANGDTRYTVSHNATQNGNLSLVGNAQATFNQATLNGNTSASGNASFNLSDHAVQNGSLTLSGNAKANVSHSALNGNVSLADKAVFHFESSRFTGQISGGKDTALHLKDSEWTLPSGTELGNLNLDNATITLNSAYRHDAAGAQTGSATDAPRRRSRRSRRSLLSVTPPTSVESRFNTLTVNGKLNGQGTFRFMSELFGYRSDKLKLAESSEGTYTLAVNNTGNEPASLEQLTVVEGKDNKPLSENLNFTLQNEHVDAGAWRYQLIRKDGEFRLHNPVKEQELSDKLGKAEAKKQAEKDNAQSLDALIAAGRDAVEKTESVAEPARQAGGENVGIMQAEEEKKRVQADKDTALAKQREAETRPATTAFPRARRARRDLPQLQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIDRFYIGISAGAGFSSGSLSDGIGGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 651 - DNA, 4350 bp, Neisseria meningitidis
  misc_feature (219)..(219): N= Unknown
  misc_feature (387)..(387): N= Unknown
  misc_feature (474)..(474): N= Unknown
  misc_feature (706)..(706): N= Unknown
  misc_feature (941)..(941): N= Unknown
  misc_feature (1026)..(1026): N= Unknown
  misc_feature (1492)..(1492): N= Unknown
  misc_feature (1643)..(1643): N= Unknown
  misc_feature (1645)..(1645): N= Unknown
  misc_feature (1841)..(1841): N= Unknown
  misc_feature (2008)..(2008): N= Unknown
  misc_feature (2094)..(2094): N= Unknown
  misc_feature (2175)..(2175): N= Unknown
  misc_feature (2197)..(2197): N= Unknown
  misc_feature (2201)..(2201): N= Unknown
  misc_feature (2241)..(2241): N= Unknown
  misc_feature (2245)..(2245): N= Unknown
  misc_feature (2247)..(2247): N= Unknown
  misc_feature (2255)..(2255): N= Unknown
  misc_feature (2259)..(2259): N= Unknown
  misc_feature (2262)..(2262): N= Unknown
  misc_feature (2265)..(2266): N= Unknown
  misc_feature (2269)..(2269): N= Unknown
  misc_feature (2272)..(2272): N= Unknown
  misc_feature (2276)..(2276): N= Unknown
  misc_feature (2278)..(2279): N= Unknown
  misc_feature (2282)..(2282): N= Unknown
  misc_feature (2286)..(2286): N= Unknown
  misc_feature (2290)..(2290): N= Unknown
  misc_feature (2292)..(2292): N= Unknown
  misc_feature (2297)..(2297): N= Unknown
  misc_feature (2301)..(2301): N= Unknown
  misc_feature (2302)..(2302): N= Unknown
  misc_feature (2307)..(2307): N= Unknown
  misc_feature (2310)..(2310): N= Unknown
  misc_feature (2434)..(2434): N= Unknown
  misc_feature (2441)..(2441): N= Unknown
  misc_feature (2625)..(2625): N= Unknown
  misc_feature (2760)..(2760): N= Unknown
  misc_feature (2869)..(2869): N= Unknown
  misc_feature (2949)..(2949): N= Unknown
  misc_feature (3290)..(3290): N= Unknown
  misc_feature (3366)..(3366): N= Unknown
  misc_feature (3401)..(3401): N= Unknown
  misc_feature (3427)..(3427): N= Unknown
  misc_feature (3498)..(3498): N= Unknown
  misc_feature (3606)..(3606): N= Unknown
  misc_feature (3619)..(3619): N= Unknown
  misc_feature (3628)..(3628): N= Unknown
  misc_feature (3761)..(3761): N= Unknown
  misc_feature (3878)..(3878): N= Unknown
  misc_feature (3882)..(3882): N= Unknown
  misc_feature (4068)..(4068): N= Unknown
  misc_feature (4074)..(4074): N= Unknown
  misc_feature (4119)..(4119): N= Unknown
  misc_feature (4128)..(4128): N= Unknown
  misc_feature (4137)..(4137): N= Unknown
  misc_feature (4194)..(4194): N= Unknown
  misc_feature (4273)..(4273): N= Unknown
  misc_feature (4296)..(4296): N= Unknown
atgaaaacaaccgacaaacggacaaccgaaacacaccgcaaagccccgaaaaccggccgcatccgcttctcgcctgcttacttagccatatgcctgtcgttcggcattcttccccaagcttgggcgggacacacttatttcggcatcaactaccaatactatcgcgactttgccgaaaataaaggcaagtttgcagtcggggcgaaagatattgaggtntacaacaaaaaaggggagttggtcggcaaatcaatgacaaaagccccgatgattgatttttctgtggtgtcgcgtaacggcgtggcggcattggtgggcgatcaatatattgtgagcgtggcacataacggcggctataacaacgttgattttggtgcggaaggaagnaatcccgatcagcaccgtttttcttaccaaattgtgaaaagaaataattataagcctgacaattcacacccttacaacggcgattancatatgccgcgtttgcataaatttgtcacagatgcagaacctgtcgaaatgacgagtgacatgagggggaatacctattccgataaagaaaaatatcccgagcgtgtccgcatcggctcaggacaccactattggcgttatgatgatgacaaacacggcgatttatcctactccggcgcatggttaattggcggcaatacacatatgcagggttggggaaataatggcgtanttagtttgagcggcgatgtgcgccatgccaacgactatggccctatgccgattgcaggtgcggcaggcgacagcggttcgccaatgtttatttatgacaaaacaaacaataaatggctgctcaacggagttttacaaaccggctacccttattccggcagggaaaacggtttccagctgatacgcaaagattggttctacgatgacatttacagaggcgatacacataccgtctnttttgaaccgcgcagtaacggacatttttcctttacatccaacaacaacggtacgggtacggtaacagaaaccaacgaaaaggtntccaatccaaagcttaaagtacagacagtccgactgtttgacgaatctttgaatgaaactgataaagaaccagtttacgcggcagggggtgttaatcagtaccgtccaaggttaaacaacggtgaaaacctttcttttatcgattacggcaacggcaaactcatcttatcaaacaacatcaaccaaggcgcgggcggtttgtattttgaaggtgattttacggtctcgcctgaaaacaacgaaacgtggcaaggcgcgggcgttcatatcagtgaagacagtaccgttacttggaaagtaaacggcgtggcaaacgaccgcctgtccaaaatcggcaaaggcacgctgcacgttcaagccaaaggggaaaaccaaggctcgatcagcgtgggcgacggtacagtcattttggatcagcaggcagacgataaaggcaaaaaacaagcctttagtgaaatcggcttgntcagcggcaggggtacggtgcaactgaatgccgataatcagttcaaccccgacaaactctatttcggctttcgcggcggacgtttggatttaaacgggcattcgctttcgttccaccgtattcaaaataccgatgaaggggcgatgattgncnatcataatgccacaacaacatccaccgttaccattacagggaatgaaagtattacacaaccgagtggtaagaatatcaatagacttaattacagcaaagaaattgcctacaacggttggtttggcgagaaagatacgaccaaaacgaacgggcggctcaaccttgtttaccagcccgccgcagaagaccgcacccngctgctttccggcggaacaaatttaaacggcaacatcacgcaaacaaacggcaaactgtttttcagcggcagaccgacaccgcacgcctacaatcatttaggaagcgggtggtcaaaaatggaaggtatcccacaaggagaaatcgtgtgggacaacgactggatcnaccgcacgtttaaagcggaaaatttccatattcagggcgggcaggcggtgatttcccgcaatgttgccaaagtggaaggcgattgncatttgagcaatcacgcccaagcagtttttggtgtcgcaccgcatcaaagccatacaatctgtacacgttcggactggacnggtctgacaaattgtgtcgaanaaancattaccgacgataaagtgattgcttcattgactaagacngacntnagcggcantgtnagnctnnccnatnacgntnnttnaaanctcncngggcntgcnncactnaanggcaatcttagtgcaaatggcgatacacgttatacagtcagccacaacgccacccaaaacggcaaccttagcctcgtgggcaatgcccaagcaacatttaatcaagccacattaaacggcaacncatcggnttcgggcaatgcttcatttaatctaagcaacaacgccgcacaaaacggcagtctgacgctttccgacaacgctaaggcaaacgtaagccattccgcactcaacggcaatgtctccctagccgataaggcagtattccattttgaaaacagccgctttaccggacaactcagcggcagcaagganacagcattacacttaaaagacagcgaatggacgctgccgtcaggcacggaattaggcaatttaaaccttgacaacgccaccattacactcaattccgcctatcgccacgatgctgcaggcgcgcaaaccggcagngtgtcagacacgccgcgccgccgttcgcgccgttccctattatccgttacaccgccaacttcggtagaatcccgtttcaacacgctgacggtaaacggcaaattgaacngtcaaggaacattccgctttatgtcggaactcttcggctaccgaagcgacaaattgaagctggcggaaagttccgaaggnacttacaccttggcggtcaacaataccggcaacgaacccgtaagcctcgatcaattgacggtagtggaagggaaagacaacaaaccgctgtccgaaaaccttaatttcaccctgcaaaacgaacacgtcgatgccggcgcgtggcgttaccaactcatccgcaaagacggcgagttccgcctgcataatccggtcaaagaacaagagctttccgacaaactcggcaaggcagaagccaaaaaacaggcggaaaaagacaacgcgcaaagccttgacgcgctgattgcggccgggcgcgatgccgccgaaaagacagaaagcgttgccgaaccggcccggcnggcaggcggggaaaatgtcggcattatgcaggcggaggaagagaaaaaacgggtgcaggcggataaagacagcgcnttggcgaaacagcgcgaagcggaaacccggccggntaccaccgccttcccccgcgcccgcngcgcccgccgggatttgccgcaaccgcagccccaaccgcaacctcaaccccaaccgcagcgcgacctgatnagccgttatgccaatagcggtttgagtgaattttccgccacgctcaacagcgttttcgccgtacaggacgaattggaccgcgtgtttgccgaagaccgccgcaacgcngtttggacaagcngcatccggnacaccaaacactaccgttcgcaagatttccgcgcctaccgccaacaaaccgacctgcgccaaatcggtatgcagaaaaacctcggcagcgggcgcgtcggcatcctgttttcgcacaaccggaccgaaaacancttcgacgacggcatcggcaactcggcacggcttgcccacggcgccgttttcgggcaatacggcatcggcaggttcgacatcggcatcagcacgggcgcgggttttagcagcggcantctntcagacggcatcggaggcaaaatccgccgccgcgtgctgcattacggcattcaggcacgataccgcgccggtttcggcggattcggcatcgaaccgtacatcggcgcaacgcgctatttcgtccaaaaagcggattaccgctacgaaaacgtcaatatcgccacccccggtcttgcgttcaaccgntaccgngcgggcattaaggcagattattcattcaaaccggcgcaacacatntccatcacnccttatttnagcctgtcctataccgatgccgcttcgggcaaagtccgaacacgcgtcaataccgcngtattggctcaggatttcggcaaaacccgcagtgcggaatggggcgtaaacgccgaaatcaaaggtttcacgctgtccntccacgctgccgccgccaaaggnccgcaactggaagcgcaacacagcgcgggcatcaaattaggctaccgctggtaa

SEQ ID NO: 652 - protein, 1449 aa, Neisseria meningitidis
  misc_feature (129)..(129): Xaa= any amino acid
  misc_feature (158)..(158): Xaa= any amino acid
  misc_feature (236)..(236): Xaa= any amino acid
  misc_feature (314)..(314): Xaa= any amino acid
  misc_feature (498)..(498): Xaa= any amino acid
  misc_feature (548)..(549): Xaa= any amino acid
  misc_feature (614)..(614): Xaa= any amino acid
  misc_feature (670)..(670): Xaa= any amino acid
  misc_feature (698)..(698): Xaa= any amino acid
  misc_feature (733)..(734): Xaa= any amino acid
  misc_feature (749)..(749): Xaa= any amino acid
  misc_feature (752)..(752): Xaa= any amino acid
  misc_feature (754)..(754): Xaa= any amino acid
  misc_feature (756)..(762): Xaa= any amino acid
  misc_feature (764)..(764): Xaa= any amino acid
  misc_feature (766)..(766): Xaa= any amino acid
  misc_feature (768)..(768): Xaa= any amino acid
  misc_feature (770)..(770): Xaa= any amino acid
  misc_feature (812)..(812): Xaa= any amino acid
  misc_feature (814)..(814): Xaa= any amino acid
  misc_feature (875)..(875): Xaa= any amino acid
  misc_feature (920)..(920): Xaa= any amino acid
  misc_feature (957)..(957): Xaa= any amino acid
  misc_feature (1097)..(1097): Xaa= any amino acid
  misc_feature (1134)..(1134): Xaa= any amino acid
  misc_feature (1143)..(1143): Xaa= any amino acid
  misc_feature (1166)..(1166): Xaa= any amino acid
  misc_feature (1207)..(1207): Xaa= any amino acid
  misc_feature (1210)..(1210): Xaa= any amino acid
  misc_feature (1254)..(1254): Xaa= any amino acid
  misc_feature (1293)..(1293): Xaa= any amino acid
  misc_feature (1373)..(1373): Xaa= any amino acid
  misc_feature (1379)..(1379): Xaa= any amino acid
  misc_feature (1425)..(1425): Xaa= any amino acid
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGXNPDQHRFSYQIVKRNNYKPDNSHPYNGDXHMPRLHKFVTDAEPVEMTSDMRGNTYSDKEKYPERVRIGSGHHYWRYDDDKHGDLSYSGAWLIGGNTHMQGWGNNGVXSLSGDVRHANDYGPMPIAGAAGDSGSPMFIYDKTNNKWLLNGVLQTGYPYSGRENGFQLIRKDWFYDDIYRGDTHTVXFEPRSNGHFSFTSNNNGTGTVTETNEKVSNPKLKVQTVRLFDESLNETDKEPVYAAGGVNQYRPRLNNGENLSFIDYGNGKLILSNNINQGAGGLYFEGDFTVSPENNETWQGAGVHISEDSTVTWKVNGVANDRLSKIGKGTLHVQAKGENQGSISVGDGTVILDQQADDKGKKQAFSEIGLXSGRGTVQLNADNQFNPDKLYFGFRGGRLDLNGHSLSFHRIQNTDEGAMIXXHNATTTSTVTITGNESITQPSGKNINRLNYSKEIAYNGWFGEKDTTKTNGRLNLVYQPAAEDRTXLLSGGTNLNGNITQTNGKLFFSGRPTPHAYNHLGSGWSKMEGIPQGEIVWDNDWIXRTFKAENFHIQGGQAVISRNVAKVEGDXHLSNHAQAVFGVAPHQSHTICTRSDWTGLTNCVEXXITDDKVIASLTKTDXSGXVXLXXXXXXXLXGXAXLXGNLSANGDTRYTVSHNATQNGNLSLVGNAQATFNQATLNGNXSXSGNASFNLSNNAAQNGSLTLSDNAKANVSHSALNGNVSLADKAVFHFENSRFTGQLSGSKXTALHLKDSEWTLPSGTELGNLNLDNATITLNSAYRHDAAGAQTGXVSDTPRRRSRRSLLSVTPPTSVESRFNTLTVNGKLNXQGTFRFMSELFGYRSDKLKLAESSEGTYTLAVNNTGNEPVSLDQLTVVEGKDNKPLSENLNFTLQNEHVDAGAWRYQLIRKDGEFRLHNPVKEQELSDKLGKAEAKKQAEKDNAQSLDALIAAGRDAAEKTESVAEPARXAGGENVGIMQAEEEKKRVQADKDSALAKQREAETRPXTTAFPRARXARRDLPQPQPQPQPQPQPQRDLXSRYANSGLSEFSATLNSVFAVQDELDRVFAEDRRNAVWTSXIRXTKHYRSQDFRAYRQQTDLRQIGMQKNLGSGRVGILFSHNRTENXFDDGIGNSARLAHGAVFGQYGIGRFDIGISTGAGFSSGXLSDGIGGKIRRRVLHYGIQARYRAGFGGFGIEPYIGATRYFVQKADYRYENVNIATPGLAFNRYRAGIKADYSFKPAQHXSITPYXSLSYTDAASGKVRTRVNTAVLAQDFGKTRSAEWGVNAEIKGFTLSXHAAAAKGPQLEAQHSAGIKLGYRW

SEQ ID NO: 653 - DNA, 4407 bp, Neisseria gonorrhoeae
atgaaaacaaccgacaaacggacaaccgaaacacaccgcaaagcccctaaaaccggccgcatccgcttctcgcccgcttacttagccatatgcctgtcgttcggcattctgccccaagcccgggcgggacacacttatttcggcatcaactaccaatactatcgcgactttgccgaaaataaaggcaagtttgcagtcggggcgaaagatattgaggtttacaacaaaaaaggggagttggtcggcaaatcgatgacgaaagccccgatgattgatttttctgtggtatcgcgtaacggcgtggcggcattggcgggcgatcaatatattgtgagcgtggcacataacggcggctataacaatgttgattttggtgcggagggaagcaatcccgatcagcaccgcttttcttaccaaattgtgaaaagaaataattataaagcagggactaacggccatccttatggcggcgattatcatatgccgcgtttgcacaaatttgtcacagatgcagaacctgttgagatgaccagttatatggatgggtggaaatacgctgatttaaataaataccctgatcgtgttcgaatcggagcaggcagacaatattggcggtctgatgaagacgaacccaataaccgcgaaagttcatatcatattgcaagcgcatattcttggctcgtcggtggcaatacctttgcacaaaatggatcaggtggtggcacagtcaacttaggtagcgaaaaaattaaacatagcccatatggttttttaccaacaggaggctcatttggcgacagtggctcaccaatgtttatctatgatgcccaaaagcaaaagtggttaattaatggggtattgcaaacaggcaacccctatataggaaaaagcaatggcttccagctagttcgtaaagattggttctatgatgaaatctttgctggagatacccattcagtattctacgaaccacatcaaaatgggaaatacttttttaacgacaataataatggcgcaggaaaaatcgatgccaaacataaacactattctctaccttatagattaaaaacacgaaccgttcaattgtttaatgtttctttatccgagacagcaagagaacctgtttatcatgctgcaggtggggtcaacagttatcgacccagactgaataatggagaaaatatttcctttattgacaaaggaaaaggtgaattgatacttaccagcaacatcaaccaaggcgcgggcggtttgtattttgagggtaattttacggtctcgcctaaaaacaacgaaacgtggcaaggcgcgggcgttcatatcagtgatggcagtaccgttacttggaaagtaaacggcgtggcaaacgaccgcctgtccaaaatcggcaaaggcacgctgctggttcaagccaaaggggaaaaccaaggctcggtcagcgtgggcgacggtaaagtcatcttagatcagcaggcggacgatcaaggcaaaaaacaagcctttagtgaaatcggcttggtcagcggcagggggacggtgcaactgaatgccgataatcagttcaaccccgacaaactctatttcggctttcgcggcggacgtttggatttgaacgggcattcgctttcgttccaccgcattcaaaataccgatgaaggggcgatgattgtcaaccacaatcaagacaaagaatccaccgttaccattacaggcaataaagatattactacaaccggcaataacaacaacttggatagcaaaaaagaaattgcctacaacggttggtttggcgagaaagatgcaaccaaaacgaacgggcggctcaatctgaattaccaaccggaagaagcggatcgcactttactgctttccggcggaacaaatttaaacggcaatatcacgcaaacaaacggcaaactgtttttcagcggcagaccgacaccgcacgcctacaatcatttaggaagcgggtggtcaaaaatggaaggtatcccacaaggagaaatcgtgtgggacaacgattggatcgaccgcacatttaaagcggaaaacttccatattcagggcggacaagcggtggtttcccgcaatgttgccaaagtggaaggcgattggcatttaagcaatcacgcccaagcagttttcggtgtcgcaccgcatcaaagccacacaatctgtacacgttcggactggacgggtctgacaagttgtaccgaaaaaaccattaccgacgataaagtgattgcttcattgagcaagaccgacatcagaggcaatgtcagccttgccgatcacgctcatttaaatctcacaggacttgccacactcaacggcaatcttagtgcaggcggagacacgcactatacggttacgcgcaacgccacccaaaacggcaacctcagcctcgtgggcaatgcccaagcaacatttaatcaagccacattaaacggcaacacatcggcttcggacaatgcttcatttaatctaagcaacaacgccgtacaaaacggcagtctgacgctttccgacaacgctaaggcaaacgtaagccattccgcactcaacggcaatgtctccctagccgataaggcagtattccattttgaaaacagccgctttaccggaaaaatcagcggcggcaaggatacggcattacacttaaaagacagcgaatggacgctgccgtcgggcacggaattaggcaatttaaaccttgacaacgccaccattacactcaattccgcctatcgacacgatgcggcaggcgcgcaaaccggcagtgcggcagatgcgccgcgccgccgttcgcgccgttccctattatccgttacgccgccaacttcggcagaatcccgtttcaacacgctgacggtaaacggcaaattgaacggtcagggaacattccgctttatgtcggaactcttcggctaccgcagcggcaaattgaagctggcggaaagttccgaaggcacttacaccttggctgtcaacaataccggcaacgaacccgtaagtctcgagcaattgacggtagtggaaggaaaagacaacacaccgctgtccgaaaatcttaatttcaccctgcaaaacgaacacgtcgatgccggcgcatggcgttatcagcttatccgcaaagacggcgagttccgcctgcataatccggtcaaagaacaagagctttccgacaaactcggcaaggcgggagaaacagaggccgccttgacggcaaaacaggcacaacttgccgccaaacaacaggcggaaaaagacaacgcgcaaagccttgacgcgctgattgcggccgggcgcaatgccaccgaaaaggcagaaagtgttgccgaaccggcccggcaggcaggcggggaaaatgccggcattatgcaggcggaggaagagaaaaaacgggtgcaggcggataaagacaccgccttggcgaaacagcgcgaagcggaaacccggccggctaccaccgccttcccccgcgcccgccgcgcccgccgggatttgccgcaaccgcagccccaaccgcaaccccaaccgcagcgcgacctgatcagccgttatgccaatagcggtttgagtgaattttccgccacgctcaacagcgttttcgccgtacaggacgaattggaccgcgtgtttgccgaagaccgccgcaacgccgtttggacaagcggcatccgggacaccaaacactaccgttcgcaagatttccgcgcctaccgccaacaaaccgacctgcgccaaatcggtatgcagaaaaacctcggcagcgggcgcgtcggcatcctgttttcgcacaaccggaccggaaacaccttcgacgacggcatcggcaactcggcacggcttgcccacggtgccgttttcgggcaatacggcatcggcaggttcgacatcggcatcagcgcgggcgcgggttttagtagcggcagcctttcagacggcatcagaggcaaaatccgccgccgcgtgctgcattacggcattcaggcaagataccgcgcaggtttcggcggattcggcatcgaaccgcacatcggcgcaacgcgctatttcgtccaaaaagcggattaccgatacgaaaacgtcaatatcgccaccccgggccttgcattcaaccgctaccgcgcgggcattaaggcagattattcattcaaaccggcgcaacacatttccatcacgccttatttgagcctgtcctataccgatgccgcttccggcaaagtccgaacgcgcgtcaataccgccgtattggcgcaggatttcggcaaaacccgcagtgcggaatggggcgtaaacgccgaaatcaaaggtttcacgctgtccctccacgctgccgccgccaaggggccgcaattggaagcgcagcacagcgcgggcatcaaattaggctaccgctggtaa

SEQ ID NO: 654 - protein, 1468 aa, Neisseria gonorrhoeae
MKTTDKRTTETHRKAPKTGRIRFSPAYLAICLSFGILPQARAGHTYFGINYQYYRDFAENKGKFAVGAKDIEVYNKKGELVGKSMTKAPMIDFSVVSRNGVAALAGDQYIVSVAHNGGYNNVDFGAEGSNPDQHRFSYQIVKRNNYKAGTNGHPYGGDYHMPRLHKFVTDAEPVEMTSYMDGWKYADLNKYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPHQNGKYFFNDNNNGAGKIDAKHKHYSLPYRLKTRTVQLFNVSLSETAREPVYHAAGGVNSYRPRLNNGENISFIDKGKGELILTSNINQGAGGLYFEGNFTVSPKNNETWQGAGVHISDGSTVTWKVNGVANDRLSKIGKGTLLVQAKGENQGSVSVGDGKVILDQQADDQGKKQAFSEIGLVSGRGTVQLNADNQFNPDKLYFGFRGGRLDLNGHSLSFHRIQNTDEGAMIVNHNQDKESTVTITGNKDITTTGNNNNLDSKKEIAYNGWFGEKDATKTNGGLNLNYPPEEADRTLLLSGGTNLNGNITQTNGKLFFSGRPTPHAYNHLGSGWSKMEGIPQGEIVWDNDWIDRTFKAENFHIQGGQAVVSRNVAKVEGDWHLSNHAQAVFGVAPHQSHTICTRSDWTGLTSCTEKTITDDKVIASLSKTDVRGNVSLADHAHLNLTGLATFNGNLVQAETRTIRLRANATQNGNLSLVGNAQATFNQATLNGNTSASDNASFNLSNNAVQNGSLTLSDNAKANVSHSALNGNVSLADKAVFHFENSRFTGKISGGKDTALHLKDSEWTLPSGTELGNLNLDNATITLNSAYRHDAAGAQTGSAADAPRRRSRRSLLSVTPPTSAESRFNTLTVNGKLNGQGTFRFMSELFGYRSGKLKLAESSEGTYTLAVNNTGNEPVSLEQLTVVEGKDNTPLSENLNFTLQNEHVDAGAWRYQLIRKDGEFRLHNPVKEQELSDKLGKAGETEAALTAKQAQLAAKQQAEKDNAQSLDALIAAGRNATEKAESVAEPARQAGGENAGIMQAEEEKKRVQADKDTALAKQREAETRPATTAFPRARRARRDLPQPQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTGNTFDDGIGNSARLAHGAVFGQYGIGRFDIGISAGAGFSSGSLSDGIRGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 655 - DNA, 422 bp, Neisseria meningitidis
aaggtgtggcaatttgtcgaagaccgctgcgtgccgtcgtgcctgccgacagttttgaaccgaccgcgcaaaaattgaacctgtttaaggcgggtgcggcaaccattttgttttatgaagatcaaaatgtcgtcaaaggtttgcaggagcagttccctgcttatgccgctaacttccccgtttgggcggatcaggcaaacgcgatggtgcagtatgccgtttggacgacacttgccgcggtcggcgtaggtgcaaacctgcaacattacaatcccttgcccgatgcggcgattgccaaagcgtggaatatccccgaaaactggttgttgcgcgcacaaatggttatcggcggtattgaaggggcggcaggtgaaaagacctttgaacccgttgcagaacgtttgaaagtgttcggcgcataa

SEQ ID NO: 656 - protein, 140 aa, Neisseria meningitidis
  misc_feature (8)..(8): Xaa= any amino acid
KVWQFVEXPLRAVVPADSFEPTAQKLNLFKAGAATILFYEDQNVVKGLQEQFPAYAANFPVWADQANAMVQYAVWTTLAAVGVGANLQHYNPLPDAAIAKAWNIPENWLLRAQMVIGGIEGAAGEKTFEPVAERLKVFGA

SEQ ID NO: 657 - DNA, 396 bp, Neisseria meningitidis
ctgcgtgccgtcgtgcctgccgacagttttgaaccgaccgcgcaaaaattgaacctgtttaaggcgggtgcggcaaccattttgttttatgaagatcaaaatgtcgtcaaaggtttgcaggagcagttccctgcttatgccgctaacttccccgtttgggcggatcaggcaaacgcgatggtgcagtatgccgtttggacgacacttgccgcggtcggcgtaggtgcaaacctgcaacattacaatcccttgcccgatgcggcgattgccaaagcgtggaatatccccgaaaactggttgttgcgcgcacaaatggttatcggcggtattgaaggggcggcaggtgaaaagacctttgaacccgttgcagaacgtttgaaagtgttcggcgcataa

SEQ ID NO: 658 - protein, 131 aa, Neisseria meningitidis
LRAVVPADSFEPTAQKLNLFKAGAATILFYEDQNVVKGLQEQFPAYAANFPVWADQANAMVQYAVWTTLAAVGVGANLQHYNPLPDAAIAKAWNIPENWLLRAQMVIGGIEGAAGEKTFEPVAERLKVFGA

SEQ ID NO: 659 - DNA, 606 bp, Neisseria meningitidis
atgacccgtcaatctctgcaacaggctgccgaaagccgccgttccatttattcgttaaataaaaatctgcccgtcggcaaagatgaaatcgtccaaatcgtcgaacacgccgttttgcacacaccttcttcgttcaattcccaatctgcccgtgtggtcgtgctgtttggcgaagagcatgataaggtgtggcaatttgtcgaagacgcgctgcgtgccgtcgtgcctgccgacagttttgaaccgaccgcgcaaaaattgaacctgtttaaggcgggtgcggcaactattttgttttatgaagatcaaaatgtcgtcaaaggtttgcaggagcagttccctgcttatgccgccaactttcccgtttgggcggaccaggcgaacgcgatggtgcagtatgccgtttggacgacacttgccgcggtcggcgtaggtgcaaacctgcaacattacaatcccttgcccgatgcggcgattgccaaagcgtggaatatccccgaaaactggttgttgcgcgcacaaatggttatcggcggtattgaaggggcggcaggtgaaaagacctttgaaccagttgcagaacgtttgaaagtgttcggcgcataa

SEQ ID NO: 660 - protein, 201 aa, Neisseria meningitidis
MTRQSLQQAAESRRSIYSLNKNLPVGKDEIVQIVEHAVLHTPSSFNSQSARVVVLFGEEHDKVWQFVEDALRAVVPADSFEPTAQKLNLFKAGAATILFYEDQNVVKGLQEQFPAYAANFPVWADQANAMVQYAVWTTLAAVGVGANLQHYNPLPDAAIAKAWNIPENWLLRAQMVIGGIEGAAGEKTFEPVAERLKVFGA

SEQ ID NO: 661 - DNA, 525 bp, Neisseria gonorrhoeae
atggccgttgcgtcaaatgtcagcttggatatgtccaatcctacggtgttacgcatgggattacccttatatattgcgtccctaagaaggggcgcaatatataaggtgtggcaatttgtcgaagacgcgctgcgtgccgtcgtgcctgccgacagttttgaaccgaccgcgcaaaaattgaagctgtttaaggcgggcgcggcaaccattttgttttatgaagatcaaaatgtcgtcaaaggtttgcaggagcagttccctgcttatgccgccaactttcccgtttgggcggaccaggcgaacgctatggtacagtatgccgtctggacgacacttgccgcggtcggtgcaggtgcaaatctgcaacattacaaccccttgcccgatgtggcgattgctaaagcgtggaatattcccgaaaactggctgttgcgcgcgcaaatggttatcggtggtattgaaggggcggcaggtgaaaaagtctttgaacccgttgcggaacgtttgaaagtgttcggcgcataa

SEQ ID NO: 662 - protein, 174 aa, Neisseria gonorrhoeae
MAVASNVSLDMSNPTVLRMGLPLYIASLRRGAIYKVWQFVEDALRAVVPADSFEPTAQKLKLFKAGAATILFYEDQNVVKGLQEQFPAYAANFPVWADQANAMVQYAVWTTLAAVGAGANLQHYNPLPDVAIAKAWNIPENWLLRAQMVIGGIEGAAGEKVFEPVAERLKVFGA

SEQ ID NO: 663 - DNA, 633 bp, Neisseria meningitidis
ggctacaactacctgttcgcgcgcggcagccgcatcgccaactaccaaatcaacggcatccccgttgccgacgcgctggccgatacgggtcaatgccaacaccgccgcctatgagcgcgtagaagtcgtgcgcggcgtggcggggctgctggacggcacgggcgagccttccgccaccgtcaatctggtgcgcaaacgcctgacccgcaagccattgtttgaagtccgcgccgaagcgggcaaccgcaaacatttcgggctggacgcggacgtatcgggcagcctgaacaccgaagcrcrctgcgcggccgcctggtttccaccttcggacgcggcgactcgtggcggcggcgcgaacgcagccgskatgccgaactctacggcattttggaatacgacatcgcaccgcaaacccgcgtccacgcargcatggactaccagcaggcgaaagaaaccgccgacgcgccgctcagctacgccgtgtacgacagccaaggttatgccaccgccttcggcccgaaagacaaccccgccacaaattgggcgaacagccaccaccgtgcgctcaacctgttcgccggcatcgaacaccgcttcaaccaagactggaaactcaaagccgaatacgactac

SEQ ID NO: 664 - protein, 211 aa, Neisseria meningitidis
  misc_feature (99)..(100): Xaa= any amino acid
  misc_feature (123)..(123): Xaa= any amino acid
  misc_feature (143)..(143): Xaa= any amino acid
GYNYLFARGSRIANYQINGIPVADALADTGNANTAAYERVEVVRGVAGLLDGTGEPSATVNLVRKRLTRKPLFEVRAEAGNRKHFGLDADVSGSLNTEXXLRGRLVSTFGRGDSWRRRERSRXAELYGILEYDIAPQTRVHAXMDYQQAKETADAPLSYAVYDSQGYATAFGPKDNPATNWANSHHRALNLFAGIEHRFNQDWKLKAEYDY

SEQ ID NO: 665 - DNA, 2178 bp, Neisseria meningitidis
atgacacgcttcaaatattccctgctgtttgccgccctgttgcccgtgtacgcgcaggccgatgtttctgtttcagacgaccccaaaccgcaggaaagcactgaattgccgaccatcaccgttaccgccgaccgcaccgcgagttccaacgacggctacactgtttccggcacgcacaccccgctcgggctgcccatgaccctgcgcgaaatcccgcagagcgtcagcgtcatcacatcgcaacaaatgcgcgaccaaaacatcaaaacgctcgaccgcgccctgttgcaggcgaccggcaccagccgccagatttacggctccgaccgcgcgggctacaactacctgttcgcgcgcggcagccgcatcgccaactaccaaatcaacggcatccccgttgccgacgcgctggccgatacgggcaatgccaacaccgccgcctatgagcgcgtagaagtcgtgcgcggcgtggcggggctgctggacggcacgggcgagccttccgccaccgtcaatctggtgcgcaaacgcctgacccgcaagccattgtttgaagtccgcgccgaagcgggcaaccgcaaacatttcgggctggacgcggacgtatcgggcagcctgaacaccgaaggcacgctgcgcggccgcctggtttccaccttcggacgcggcgactcgtggcggcggcgcgaacgcagccgcgatgccgaactctacggcattttggaatacgacatcgcaccgcaaacccgcgtccacgcaggcatggactaccagcaggcgaaagaaaccgccgacgcgccgctcagctacgccgtgtacgacagccaaggttatgccaccgccttcggcccgaaagacaaccccgccacaaattgggcgaacagccgccaccgtgcgctcaacctgttcgccggcatcgaacaccgcttcaaccaagactggaaactcaaagccgaatacgactacacccgcagccgcttccgccagccctacggcgtagcaggcgtgctttccatcgaccacaacaccgccgccaccgacctgattcccggttattggcacgccgacccgcgcacccacagcgccagcgtgtcattgatcggcaaataccgcctgttcggccgcgaacacgatttaatcgcgggtatcaacggttacaaatacgccagcaacaaatacggcgaacgcagcatcatccccaacgccattcccaacgcctacgaattttcccgcacgggtgcctacccgcagcctgcatcgtttgcccaaaccatcccgcaatacggcaccaggcggcaaatcggcggctatctcgccacccgtttccgcgccgccgacaacctttcgctgattttgggcggacgatacacccgttaccgcaccggcagctacgacagccgcacacaaggcatgacctatgtgtccgccaaccgtttcaccccctacacaggcatcgtgttcgacctgaccggcaacctgtctctttacggctcgtacagcagcctgttcgtcccgcaatcgcaaaaagacgaacacggcagctacctgaaacccgtaaccggcaacaatctggaagccggcatcaaaggcgaatggcttgaaggccgtctgaacgcatccgccgccgtgtaccgcgcccgtaaaaacaacctcgccaccgcagcaggacgcgacccgagcggcaacacctactaccgcgccgccaaccaagccaaaacccacggctgggaaatcgaagtcggcggccgcatcacgcccgaatggcagatacaggcaggttacagccaaagcaaaacccgcgaccaagacggcagccgcctgaaccccgacagcgtacccgaacgcagcttcaaactcttcactgcctaccactttgcccccgaagcccccagcggctggaccatcggcgcaggcgtgcgctggcagagcgaaacccacaccgaccctgccacgctccgcatccccaaccccgccgccaaagcccgcgccgccgacaacagccgccaaaaagcctacgccgtcgccgacatcatggcgcgttaccgcttcaatccgcgcgccgaactgtcgctgaacgtggacaatctgttcaacaaacactaccgcacccagcccgaccgccacagctacggcgcactgcggacagtgaacgcggcgtttacctatcggtttaaataa

SEQ ID NO: 666 - protein, 725 aa, Neisseria meningitidis
MTRFKYSLLFAALLPVYAQADVSVSDDPKPQESTELPTITVTADRTASSNDGYTVSGTHTPLGLPMTLREIPQSVSVITSQQMRDQNIKTLDRALLQATGTSRQIYGSDRAGYNYLFARGSRIANYQINGIPVADALADTGNANTAAYERVEVVRGVAGLLDGTGEPSATVNLVRKRLTRKPLFEVRAEAGNRKHFGLDADVSGSLNTEGTLRGRLVSTFGRGDSWRRRERSRDAELYGILEYDIAPQTRVHAGMDYQQAKETADAPLSYAVYDSQGYATAFGPKDNPATNWANSRHRALNLFAGIEHRFNQDWKLKAEYDYTRSRFRQPYGVAGVLSIDHNTAATDLIPGYWHADPRTHSASVSLIGKYRLFGREHDLIAGINGYKYASNKYGERSIIPNAIPNAYEFSRTGAYPQPASFAQTIPQYGTRRQIGGYLATRFRAADNLSLILGGRYTRYRTGSYDSRTQGMTYVSANRFTPYTGIVFDLTGNLSLYGSYSSLFVPQSQKDEHGSYLKPVTGNNLEAGIKGEWLEGRLNASAAVYRARKNNLATAAGRDPSGNTYYRAANQAKTHGWEIEVGGRITPEWQIQAGYSQSKTRDQDGSRLNPDSVPERSFKLFTAYHFAPEAPSGWTIGAGVRWQSETHTDPATLRIPNPAAKARAADNSRQKAYAVADIMARYRFNPRAELSLNVDNLFNKHYRTQPDRHSYGALRTVNAAFTYRFK

SEQ ID NO: 667 - DNA, 2178 bp, Neisseria meningitidis
atgacacgcttcaaatattccctgctgtttgccgccctgttgcccgtgtacgcgcaggccgatgtttctgtttcagacgacccaaaaccgcaggaaagcactgaattgccgaccatcaccgttaccgccgaccgcaccgcgagttccaacgacggctacactgtttccggcacgcacaccccgctcgggctgcccatgaccctgcgcgaaatcccgcagagcgtcagcgtcatcacatcgcaacaaatgcgcgaccaaaacatcaaagcgctcgaccgcgccctgttgcaggcgaccggcaccagccgccagatttacggctccgaccgcgcgggctacaactacctgttcgcgcgcggcagccgcatcgccaactaccaaatcaacggcatccccgttgccgacgcgctggccgatacgggcaatgccaacaccgccgcctatgagcgcgtagaagtcgtgcgcggcgtggcggggctgctggacggcacgggcgagccttccgccaccgtcaatctggtgcgcaaacgcccgacccgcaagccattgtttgaagtccgcgccgaagcgggcaaccgcaaacatttcgggctgggcgcggacgtatcgggcagcctgaatgccgaaggcacgctgcgcggccgcctggtttccaccttcggacgcggcgactcgtggcggcagcgcgaacgcagccgcgatgccgaactctacggcattttggaatacgacatcgcaccgcaaacccgcgtccacgcaggcatggactaccagcaggcgaaagaaaccgccgacgcgccgctcagctacgccgtgtacgacagccaaggttatgccaccgccttcggcccgaaagacaaccccgccacaaattgggcgaacagccgccaccgtgcgctcaacctgttcgccggcatcgaacaccgcttcaaccaagactggaaactcaaagccgaatacgactacacccgcagccgcttccgccagccctacggcgtagcaggcgtgctttccatcgaccacaacaccgccgccaccgacctgattcccggttattggcacgccgacccgcgcacccacagcgccagcgtgtcattaatcggcaaataccgcctgttcggccgcgaacacgatttaatcgcgggtatcaacggttacaaatacgccagcaacaaatacggcgaacgcagcatcatccccaacgccattcccaacgcctacgaattttcccgcacgggtgcctacccgcagcctgcatcgtttgcccaaaccatcccgcaatacggcaccaggcggcaaatcggcggctatctcgccacccgtttccgcgccgccgacaacctttcgctgatactcggcggcagatacagccgttaccgcaccggcagctacgacagccgcacacaaggcatgacctatgtgtccgccaaccgtttcaccccctacacaggcatcgtgttcgacctgaccggcaacctgtcgctttacggctcgtacagcagcctgttcgtcccgcaatcgcaaaaagacgaacacggcagctacctgaaacccgtaaccggcaacaatctggaagccggcatcaaaggcgaatggcttgaaggccgtctgaacgcatccgccgccgtgtaccgcgcccgtaaaaacaacctcgccaccgcagcaggacgcgacccgagcggcaacacctactaccgcgccgccaaccaagccaaaacccacggctgggaaatcgaagtcggcggccgcatcacgcccgaatggcagatacaggcaggttacagccaaagcaaaacccgcgaccaagacggcagccgcctgaaccccgacagcgtacccgaacgcagcttcaaactcttcactgcctaccactttgcccccgaagcccccagcggctggaccatcggcgcaggcgtgcgctggcagagcgaaacccacaccgaccctgccacgctccgcatccccaaccccgccgccaaagcccgcgccgccgacaacagccgccaaaaagcctacgccgtcgccgacatcatggcgcgttaccgcttcaatccgcgcgccgaactgtcgctgaacgtggacaatctgttcaacaaacactaccgcacccagcccgaccgccacagctacggcgcactgcggacagtgaacgcggcgtttacctatcggtttaaataa

SEQ ID NO: 668 - protein, 725 aa, Neisseria meningitidis
MTRFKYSLLFAALLPVYAQADVSVSDDPKPQESTELPTITVTADRTASSNDGYTVSGTHTPLGLPMTLREIPQSVSVITSQQMRDQNIKALDRALLQATGTSRQIYGSDRAGYNYLFARGSRIANYQINGIPVADALADTGNANTAAYERVEVVRGVAGLLDGTGEPSATVNLVRKRPTRKPLFEVRAEAGNRKHFGLGADVSGSLNAEGTLRGRLVSTFGRGDSWRQRERSRDAELYGILEYDIAPQTRVHAGMDYQQAKETADAPLSYAVYDSQGYATAFGPKDNPATNWANSRHRALNLFAGIEHRFNQDWKLKAEYDYTRSRFRQPYGVAGVLSIDHNTAATDLIPGYWHADPRTHSASVSLIGKYRLFGREHDLIAGINGYKYASNKYGERSIIPNAIPNAYEFSRTGAYPQPASFAQTIPQYGTRRQIGGYLATRFRAADNLSLILGGRYSRYRTGSYDSRTQGMTYVSANRFTPYTGIVFDLTGNLSLYGSYSSLFVPQSQKDEHGSYLKPVTGNNLEAGIKGEWLEGRLNASAAVYRARKNNLATAAGRDPSGNTYYRAANQAKTHGWEIEVGGRITPEWQIQAGYSQSKTRDQDGSRLNPDSVPERSFKLFTAYHFAPEAPSGWTIGAGVRWQSETHTDPATLRIPNPAAKARAADNSRQKAYAVADIMARYRFNPRAELSLNVDNLFNKHYRTQPDRHSYGALRTVNAAFTYRFK

SEQ ID NO: 669 - DNA, 8 bp, Neisseria gonorrhoeae
  misc_feature (1)..(8): N= Unknown
nnnnnnnn

SEQ ID NO: 670 - protein, 623 aa, Neisseria gonorrhoeae
SAVDACRIPGYNYLFARGSRIANYQINGIPVADALADTGNANTAAYERVEVVRGVAGLPDGTGEPSATVNLVRKHPTRKPLFEVRAEAGNRKHFGLGADVSGSLNAEGTLRGRLVSTFGRGDSWRQLERSRDAELYGILEYDIAPQTRVHAGMDYQQAKETADAPLSYAVYDSQGYATAFGPKDNPATNWSNSRNRALNLFAGIEHRFNQDWKLKAEYDYTRSRFRQPYGVAGVLSIDHSTAATDLIPGYWHADPRTHSASMSLTGKYRLFGREHDLIAGINGYKYASNKYGERSIIPNAIPNAYEFSRTGAYPQPSSFAQTIPQYDTRRQIGGYLATRFRAADNLSLILGGRYSRYRAGSYNSRTQGMTYVSANRFTPYTGIVFDLTGNLSLYGSYSSLFVPQLQKDEHGSYLKPVTGNNLEADIKGEWLEGRLNASAAVYRARKNNLATAAGRDQSGNTYYRAANQAKTHGWEIEVGGRITPEWQIQAGYSQSKPRDQDGSRLNPDSVPERSFKLFTAYHLAPEAPSGRTIGAGVRRQGETHTDPAALRIPNPAAKARAVANSRQKAYAVADIMARYRFNPRTELSLNVDNLFNKHYRTQPDRHSYGALRTVNAAFTYRFK

SEQ ID NO: 671 - DNA, 2178 bp, Neisseria gonorrhoeae
atgacacgcttcaaatactccctgctttttgccgccctgctacccgtgtacgcgcaggccgatgtttctgtttcagacgaccccaaaccgcaggaaagcaccgaattgccgaccatcaccgttaccgccgaccgcaccgcgagttccaacgacggctacaccgtttccggcacgcacaccccgttcgggctgcccatgaccctgcgcgaaatcccgcagagcgtcagcgtcatcacatcgcaacaaatgcgcgaccaaaacatcaaaacgctcgaccgcgccctgttgcaggcgaccggcaccagccgccagatttacggctccgaccgcgcgggctacaactacctgttcgcgcgcggcagccgcatcgccaactaccaaatcaacggcatccccgttgccgacgcgctggccgatacgggcaatgccaacaccgccgcctatgagcgcgtagaagtcgtgcgcggcgtggcggggctgccggacggcacgggcgagccttctgccaccgtcaatctggtacgcaaacacccgacccgcaagccattgtttgaagtccgcgccgaagccggcaaccgcaaacatttcgggctgggcgcggacgtatcgggcagcctgaacgccgaaggcacgctgcgcggccgcctggtttccaccttcggacgcggcgactcgtggcggcagctcgaacgcagccgcgatgccgaactctacggcattttggaatacgacatcgcaccgcaaacccgcgtccacgcaggcatggactaccagcaggcgaaagaaaccgcagacgcgccgctcagctacgccgtgtacgacagccaaggttatgccaccgccttcggcccaaaagacaaccccgccacaaattggtcgaacagccgcaaccgtgcgctcaacctgttcgccggcatagaacaccgcttcaaccaagactggaaactcaaagccgaatacgactacacccgtagccgcttccgccagccctacggtgtggcaggcgtactttccatcgaccacagcactgccgccaccgacctgattcccggttattggcacgccgatccgcgcacccacagcgccagcatgtcattgaccggcaaataccgcctgttcggccgcgagcacgatttaatcgcgggtatcaacggctacaaatacgccagcaacaaatacggcgaacgcagcatcattcccaacgccattcccaacgcctacgaattttcccgcacgggcgcctatccgcagccatcatcgtttgcccaaaccatcccgcaatacgacaccaggcggcaaatcggcggctatctcgccacccgtttccgcgccgccgacaacctttcgctgatactcggcggcagatacagccgctaccgcgcaggcagctacaacagccgcacacaaggcatgacctatgtgtccgccaaccgtttcaccccctacacaggcatcgtgttcgatctgaccggcaacctgtcgctttacggctcgtacagcagcctgttcgtcccgcaattgcaaaaagacgaacacggcagctacctgaaacccgtaaccggcaacaatctggaagccgacatcaaaggcgaatggcttgaagggcgtctgaacgcatccgccgccgtgtaccgcgcccgtaaaaacaacctcgccaccgcagcaggacgcgaccagagcggcaacacctactatcgcgccgccaaccaagccaaaacccacggctgggaaatcgaagtcggcggccgcatcacgcccgaatggcagatacaggcaggctacagccaaagcaaaccccgcgaccaagacggcagccgcctgaaccccgacagcgtacccgaacgcagcttcaaactcttcaccgcctaccacttagcccccgaagcccccagcggccggaccatcggtgcgggtgtgcgccggcagggcgaaacccacaccgacccagccgcgctccgcatccccaaccccgccgccaaagcccgcgccgtcgccaacagccgccagaaagcctacgccgtcgccgacatcatggcgcgttaccgcttcaatccgcgcaccgaactgtcgctgaacgtggacaacctgttcaacaaacactaccgcacccagcccgaccgccacagctacggcgcactgcggacagtgaacgcggcgtttacctatcggtttaaataa

SEQ ID NO: 672 - protein, 725 aa, Neisseria gonorrhoeae
MTRFKYSLLFAALLPVYAQADVSVSDDPKPQESTELPTITVTADRTASSNDGYTVSGTHTPFGLPMTLREIPQSVSVITSQQMRDQNIKTLDRALLQATGTSRQIYGSDRAGYNYLFARGSRIANYQINGIPVADALADTGNANTAAYERVEVVRGVAGLPDGTGEPSATVNLVRKHPTRKPLFEVRAEAGNRKHFGLGADVSGSLNAEGTLRGRLVSTFGRGDSWRQLERSRDAELYGILEYDIAPQTRVHAGMDYQQAKETADAPLSYAVYDSQGYATAFGPKDNPATNWSNSRNRALNLFAGIEHRFNQDWKLKAEYDYTRSRFRQPYGVAGVLSIDHSTAATDLIPGYWHADPRTHSASMSLTGKYRLFGREHDLIAGINGYKYASNKYGERSIIPNAIPNAYEFSRTGAYPQPSSFAQTIPQYDTRRQIGGYLATRFRAADNLSLILGGRYSRYRAGSYNSRTQGMTYVSANRFTPYTGIVFDLTGNLSLYGSYSSLFVPQLQKDEHGSYLKPVTGNNLEADIKGEWLEGRLNASAAVYRARKNNLATAAGRDQSGNTYYRAANQAKTHGWEIEVGGRITPEWQIQAGYSQSKPRDQDGSRLNPDSVPERSFKLFTAYHLAPEAPSGRTIGAGVRRQGETHTDPAALRIPNPAAKARAVANSRQKAYAVADIMARYRFNPRTELSLNVDNLFNKHYRTQPDRHSYGALRTVNAAFTYRFK

SEQ ID NO: 673 - DNA, 366 bp, Neisseria meningitidis
  misc_feature (332)..(332): N= Unknown
  misc_feature (352)..(352): N= Unknown
atgcgcacggcagtggttttgctgttgatcatgccgatggcggcttcgtcggcaatgatgccggaaatggtgtgcgcgggcgtgtcgccgggaacggcaatcatatccaagccgaccgaacaaacggcggtcatggcttcgagtttgtccagcgtcagcacgcctgcttcggcggcggcaatcataccttcgtcttcggaaacggggataaacgcgccactcaaacccccgaccgcgctggaagccatcatgccgccttttttcacggcatcgttcagcaatgccaaagctgctgttgtgccgtgcgtaccgcagacgctcaagcccatttnttcaagaatgcgtgccactnagtcgccgacgggg

SEQ ID NO: 674 - protein, 122 aa, Neisseria meningitidis
  misc_feature (111)..(111): Xaa= any amino acid
  misc_feature (118)..(118): Xaa= any amino acid
MRTAVVLLLIMPMAASSAMMPEMVCAGVSPGTAIISKPTEQTAVMASSLSSVSTPASAAAIIPSSSETGINAPLKPPTALEAIMPPFFTASFSNAKAAVVPCVPQTLKPIXSRMRATXSPTG

SEQ ID NO: 675 - DNA, 924 bp, Neisseria meningitidis
atgcgcacggcagtggttttgctgttgatcatgccgatggcggcttcgtcggcaatgatgccggaaatggtgtgcgcgggcgtgtcgccgggaacggcaatcatatccaagccgaccgaacaaacggcggtcatggcttcgagtttgtccagcgtcagcacgcctgcttcggcggcggcaatcataccttcgtcttcggaaacggggataaacgcgccactcaaacccccgaccgcgctggaagccatcatgccgccttttttcacggcatcgttcagcaatgccaaagctgctgttgtgccgtgcgtaccgcagacgctcaagcccatttcttcaagaatgcgtgccactgagtcgccgacggcgggggtcggcgccagcgacaagtcgagaataccaaacgggatattcagcatttttgaggcttcgcggccgatgagttcgcccacgcgggtaattttgaaagcagttttcttcactacttccgcaacttcggtcaatgtcgttgcatctgaattttccaacgcggcttttacgacacctgggccggatacgccgacattgataacggcatccgcttcgcccgaaccatgaaacgcgcccgccataaacgggttgtcttccaccgcgttgcagaacacgacaattttagcgcagccgaaaccttcgggcgtgatttccgccgtgcgtttgacggtttcgcccgccagcttgaccgcatccatattgataccggcacgcgtactgccgatattgatggagctgcacacaatatcggtagtcttcatcgcttcgggaatggagcggattaacacctcatccgaaggcgacatccctttttgcaccaacgcggaaaaaccgccgataaaagacacaccgatggctttggcagctttatccaaagtttgcgccacgctgacgtaa

SEQ ID NO: 676 - protein, 306 aa, Neisseria meningitidis
MRTAVVLLLIMPMAASSAMMPEMVCAGVSPGTAIISKPTEQTAVMASSLSSVSTPASAAAIIPSSSETGINAPLKPPTALEAIMPPFFTASFSNAKAAVVPCVPQTLKPISSRMRATESPTAGVGASDKSRIPNGIFSIFEASRPMSSPTRVILKAVFFTTSATSVNVVASEFSNAAFTTPGPDTPTLITASASPEPNAPAINGLSSTALQNTTILAQPKPSGVISAVRLTVSPASLTASILIPARVLPILMELHTISVVFIASGMERINTSSEGDIPFCTNAEKPPIKDTPMALAALSKVCATLT

SEQ ID NO: 677 - DNA, 924 bp, Neisseria meningitidis
  misc_feature (111)..(111): N= Unknown
  misc_feature (201)..(201): N= Unknown
  misc_feature (610)..(610): N= Unknown
  misc_feature (625)..(625): N= Unknown
  misc_feature (682)..(682): N= Unknown
  misc_feature (810)..(810): N= Unknown
  misc_feature (678)..(678): N= Unknown
atgcgcacggcagtggttttgctgttgatcatgccgatggcggcttcgtcggcaatgatgccggaaatggtgtgcgcgggtgtgtcgccgggaacggcaatcatatccaanccgaccgaacaaacggcggtcatcgcttcgagtttatccaacgtcagcacgcctgcttcggcggcggcaatcataccttcgtcttcgganacggggataaacgcgccactcaaaccgccaaccgcgctcgaagccatcatgccgccctttttcacggcatcgttcagcaatgccaaagctgctgttgtgccgtgcgtaccgcagacgctcaaacccatttcttcaagaatgcgcgccaccgagtcgccgacggcaggggtcggtgccagcgacaagtcgagaataccaaacgggatattcagcatttttgaggcttcgcggccgatgagttcgcccacgcgggtaattttgaaggcggttttcttcacaacttcggcaacttcggtcaatgtcgttgcatccgaattttccaacgcggcttttacgacacccgggccggatacgccgacattaatcacagcatccgcttcgcctgagccgtgaaacgcgcccgccatanacgggttgtcttccnccgcgttgcagaacacgacgattttggcgcagccgaaaccttctagtgtgatttcanccgtgcgtttgatggtttcgcccgccagtctgaccgcgtccatattgataccggcgcgcgtactgccgatattgatggagctgcacacgatatcagtagtcttcatcgcttcgggaatggaacggatnaacacctcgtcagaaggcgacatacctttttgcaccagcgcggaaaagccgccaataaaagacacgccgatggctttggcagccttatccaaagtttgcgccacgctgacgtaa

SEQ ID NO: 678 - protein, 306 aa, Neisseria meningitidis
  misc_feature (37)..(37): Xaa= any amino acid
  misc_feature (67)..(67): Xaa= any amino acid
  misc_feature (203)..(203): Xaa= any amino acid
  misc_feature (208)..(208): Xaa= any amino acid
  misc_feature (227)..(227): Xaa= any amino acid
  misc_feature (269)..(269): Xaa= any amino acid
MRTAVVLLLIMPMAASSAMMPEMVCAGVSPGTAIISXPTEQTAVIASSLSNVSTPASAAAIIPSSSXTGINAPLKPPTALEAIMPPFFTASFSNAKAAVVPCVPQTLKPISSRMRATESPTAGVGASDKSRIPNGIFSIFEASRPMSSPTRVILKAVFFTTSATSVNVVASEFSNAAFTTPGPDTPTLITASASPEPNAPAIXGLSSXALQNTTILAQPKPSSVISXVRLMVSPASLTASILIPARVLPILMELHTISVVFIASGMERXNTSSEGDIPFCTSAEKPPIKDTPMALAALSKVCATLT

SEQ ID NO: 679 - DNA, 924 bp, Neisseria gonorrhoeae
atgcgcacggcggtggttttgctgttgatcatgccgatggcggcttcgtcggcgatgatgccggaaatggtgtgcgcgggcgtgtcgccgggaacggcaatcatgtccaaaccaacggagcagacggcggtcatggcttcgagtttgtccagcgtcaacacgcctgcctcggcggcggcaatcataccttcgtcttcggaaacggggataaacgcgccgctcaaaccgccgaccgcgctggaagccatcatgccgccctttttcacggcatcgttcagcaatgccaaagctgctgttgtgccgtgcgtaccgcagacgctcaagcccatttcttcaagaatgcgcgccaccgagtcgccgacggcgggggtcggtgccagcgacaaatcgagaatgccgaacgggatattcagcatttttgaggcttcgcgaccgatgagttcgcccacgcgggtgattttgaaagcggttttcttcacgacttcggcgacctcggtcaggctgaccgcgtccgaattttccagcgcggctttgaccacgcctggaccggatacgccgacattaatcacagcatccgcttcgcccgagccgtggaacgcacccgccataaacggattgtcttccaccgcgttgcagaacacgacgattttggcgcagccgaaaccttcgggtgtgatttcagccgtgcgtttgatggtttcgcctgccagcttgaccgcatccatattgataccggcacgcgtgctgccgatattgatggagctgcacacgatatcggtagttttcatcgcttcgggaacggaacggatcaacacctcatccgaaggcgacatacctttttgcaccagcgcggaaaagccgccgataaaggacacgccgatggctttggctgccttgtccaaagtctgcgccacgctgacataa

SEQ ID NO: 680 - protein, 307 aa, Neisseria gonorrhoeae
MRTAVVLLLIMPMAASSAMMPEMVCAGVSPGTAIMSKPTEQTAVMASSLSSVNTPASAAAIIPSSSETGINAPLKPPTALEAIMPPFFTASFSNAKAAVVPCVPQTLKPISSRMRATESPTAGVGASDKSRMPNGIFSIFEASRPMSSPTRVILKAVFFTTSATSVRLTASEFSSAALTTPGPDTPTLITASASPEPWNAPAINGLSSTALQNTTILAQPKPSGVISAVRLMVSPASLTASILIPARVLPILMELHTISVVFIASGTERINTSSEGDIPFCTSAEKPPIKDTPMALAALSKVCATLT

SEQ ID NO: 681 - DNA, 183 bp, Neisseria meningitidis
accgacgtgcaaaaagagttggtcggcgaacaacgcaagtgggcgcaggaaaaaatcagcaactgccgacaagccgccgcgcaggcagaccggcaggaatacgccgaatacctcaagctgcaatgcgacacgcggatgacgcgcgaacggatacagtatcttcgcggctattccatcgattag

SEQ ID NO: 682 - protein, 60 aa, Neisseria meningitidis
TDVQKELVGEQRKWAQEKISNCRQAAAQADRQEYAEYLKLQCDTRMTRERIQYLRGYSID

SEQ ID NO: 683 - DNA, 1017 bp, Neisseria meningitidis
atgtatcggaaactcattgcgctgccgtttgccctgctgcttgccgcttgcggcagggaagaaccgcccaaggcattggaatgcgccaaccccgccgtgttgcaaggcatacgcggcaatattcaggaaacgctcacgcaggaagcgcgttctttcgcgcgcgaagacggcaggcagtttgtcgatgccgacaaaattatcgccgccgcctacggtttggcgttttctttggaacacgcttcggaaacgcaggaaggcgggcgcacgttctgtatcgccgatttgaacattaccgtgccgtctgaaacgcttgccgatgccaaggcaaacagccccctgttgtacggggaaactgctttgtcggatattgtgcggcagaagacgggcggcaatgtcgagtttaaagacggcgtattgacggcagccgtccgcttcctgcccgtcaaagacggtcagacggcatttgtcgacaacacggtcggtatggcggcgcaaacgctgtctgccgcgctgctgccttacggcgtgaagagcatcgtgatgatagacggcaaggcggtgaaaaaagaagacgcggtcaggattttgagcggaaaagcccgtgaagaagaaccgtccaaacccacgcccgaagacattttggaacacaatgccgccggcggcgatgcgggcgtaccccaagccgcagaaggcgcgcccgaaccggaaatcctgcatcctgacgacggcgagcgtgccgataccgttaccgtatcacggggcgaagtggaagaggcgcgcgtacaaaaccagcgtgcggaatccgaaattaccaaactttggggaggactcgataccgacgtgcaaaaagagttggtcggcgaacaacgcaagtgggcgcaggaaaaaatcagcaactgccgacaagccgccgcgcaggcagaccggcaggaatacgccgaatacctcaagctgcaatgcgacacgcggatgacgcgcgaacggatacagtatcttcgcggctattccatcgattag

SEQ ID NO: 684 - protein, 338 aa, Neisseria meningitidis
MYRKLIALPFALLLAACGREEPPKALECANPAVLQGIRGNIQETLTQEARSFAREDGRQFVDADKIIAAAYGLAFSLEHASETQEGGRTFCIADLNITVPSETLADAKANSPLLYGETALSDIVRQKTGGNVEFKDGVLTAAVRFLPVKDGQTAFVDNTVGMAAQTLSAALLPYGVKSIVMIDGKAVKKEDAVRILSGKAREEEPSKPTPEDILEHNAAGGDAGVPQAAEGAPEPEILHPDDGERADTVTVSRGEVEEARVQNQRAESEITKLWGGLDTDVQKELVGEQRKWAQEKISNCRQAAAQADRQEYAEYLKLQCDTRMTRERIQYLRGYSID

SEQ ID NO: 685 - DNA, 1017 bp, Neisseria meningitidis
  misc_feature (106)..(106): N= Unknown
  misc_feature (115)..(115): N= Unknown
  misc_feature (169)..(169): N= Unknown
  misc_feature (173)..(173): N= Unknown
  misc_feature (193)..(193): N= Unknown
  misc_feature (213)..(213): N= Unknown
  misc_feature (215)..(215): N= Unknown
  misc_feature (217)..(218): N= Unknown
  misc_feature (220)..(221): N= Unknown
  misc_feature (223)..(223): N= Unknown
  misc_feature (225)..(225): N= Unknown
  misc_feature (274)..(274): N= Unknown
  misc_feature (458)..(458): N= Unknown
  misc_feature (586)..(586): N= Unknown
  misc_feature (592)..(592): N= Unknown
  misc_feature (595)..(595): N= Unknown
  misc_feature (607)..(607): N= Unknown
  misc_feature (622)..(622): N= Unknown
  misc_feature (625)..(626): N= Unknown
  misc_feature (780)..(780): N= Unknown
  misc_feature (865)..(865): N= Unknown
atgtatcggaaactcattgcgctgccgtttgccctgctgcttgccgcttgcggcagggaagaaccgcccaaggcattggaatgcgccaaccccgccgtgttgcaangcatacgcngcaatattcaggaaacgctcacgcaggaagcgcgttctttcgcgcgcgaagacngcangcagtttgtcgatgccgacnaaattatcgccgccgcctangntnngnngntntctttggaacacgcttcggaaacgcaggaaggcgggcgcacgttctgtntcgccgatttgaacattaccgtgccgtctgaaacgcttgccgatgccaaggcaaacagccccctgctgtacggggaaaccgctttgtcggatattgtgcggcagaagacgggcggcaatgtcgagtttaaagacggcgtattgacggcagccgtccgcttcctacccgtcaaagacggtcaganggcatttgtcgacaacacggtcggtatggcggcgcaaacgctgtctgccgcgttgctgccttacggcgtgaagagcatcgtgatgatagacggcaaggcggtaaaaaaagaagacgcggtcaggattntgagcnganaagcccgtgaanaagaaccgtccaaanccnngcccgaagacattttggaacataatgccgccggaggggatgcagacgtaccccaagccggagaagacgcgcccgaaccggaaatcctgcatcctgacgacggcgagcgtgccgataccgttaccgtatcacggggcgaagtggaagaggcgcgngtacaaaaccagcgtgcggaatccgaaattaccaaactttggggaggactcgataccgacgtgcaaaaagagttggtcggcgaanaacgcaagtgggcgcaggaaaaaatcagcaactgccgacaagccgccgcgcaggcagaccggcaggaatacgccgaatacctcaagctgcaatgcgacacgcggatgacgcgcgaacggatacagtatcttcgcggctattccatcgattag

SEQ ID NO: 686 - protein, 338 aa, Neisseria meningitidis
  misc_feature (36)..(36): Xaa= any amino acid
  misc_feature (39)..(39): Xaa= any amino acid
  misc_feature (57)..(58): Xaa= any amino acid
  misc_feature (65)..(65): Xaa= any amino acid
  misc_feature (71)..(75): Xaa= any amino acid
  misc_feature (92)..(92): Xaa= any amino acid
  misc_feature (153)..(153): Xaa= any amino acid
  misc_feature (196)..(196): Xaa= any amino acid
  misc_feature (198)..(199): Xaa= any amino acid
  misc_feature (203)..(203): Xaa= any amino acid
  misc_feature (208)..(209): Xaa= any amino acid
  misc_feature (289)..(289): Xaa= any amino acid
MYRKLIALPFALLLAACGREEPPKALECANPAVLQXIRXNIQETLTQEARSFAREDXXQFVDADXIIAAAXXXXXSLEHASETQEGGRTFCXADLNITVPSETLADAKANSPLLYGETALSDIVRQKTGGNVEFKDGVLTAAVRFLPVKDGQXAFVDNTVGMAAQTLSAALLPYGVKSIVMIDGKAVKKEDAVRIXSXXAREXEPSKXXPEDILEHNAAGGDADVPQAGEDAPEPEILHPDDGERADTVTVSRGEVEEARVQNQRAESEITKLWGGLDTDVQKELVGEXRKWAQEKISNCRQAAAQADRQEYAEYLKLQCDTRMTRERIQYLRGYSID

SEQ ID NO: 687 - DNA, 1017 bp, Neisseria gonorrhoeae
atgtatcggaaactcattgcgctgccgtttgccctgctgcttgcagcgtgcggcagggaagaaccgcccaaggcgttggaatgcgccaaccccgccgtgttgcaggacatacgcggcagtattcaggaaacgctcacgcaggaagcgcgttctttcgcgcgcgaagacggcaggcagtttgtcgatgccgacaaaattatcgccgccgcctacggtttggcgttttctttggaacacgcttcggaaacgcaggaaggcgggcgcacgttctgtatcgccgatttgaacattaccgtgccgtctgaaacgcttgccgatgccgaggcaaacagccccctgctgtatggggaaacgtctttggcagacatcgtgcagcagaagacgggcggcaatgtcgagtttaaagacggcgtattgacggcagccgtccgcttcctgcccgccaaagacgctcggacggcatttatcgacaacacggtcggtatggcgacgcaaacgctgtctgccgcgttgctgccttacggcgtgaagagcatcgtgatgatagacggcaaggcggtgacaaaagaagacgcggtcagggttttgagcggcaaagcccgtgaagaagaaccgtccaaacccacccccgaagacattttggaacacaatgccgccggcggcgatgcgggcgtaccccaagccgcagaaggcgcacccgaacccgaaatcctgcatcccgacgacgtcgagcgtgccgataccgttaccgtatcacggggcgaagtggaagaggcgcgcgtacaaaaccaacgtgcggaatccgaaattaccaaactttggggaggactcgataccgacgtgcaaaaagagttggtcggcgaacagcgcaagtgggcgcaggaaaaaatcagcaactgccgacaagccgccgcgcaggcagaccggcaggaatacgccgaatacctcaagctccaatgcgacacgcggatgacgcgcgaacggatacagtatcttcgcggctattccatcgattag

SEQ ID NO: 688 - protein, 338 aa, Neisseria gonorrhoeae
MYRKLIALPFALLLAACGREEPPKALECANPAVLQDIRGSIQETLTQEARSFAREDGRQFVDADKIIAAAYGLAFSLEHASETQEGGRTFCIADLNITVPSETLADAEANSPLLYGETSLADIVQQKTGGNVEFKDGVLTAAVRFLPAKDARTAFIDNTVGMATQTLSAALLPYGVKSIVMIDGKAVTKEDAVRVLSGKAREEEPSKPTPEDILEHNAAGGDAGVPQAAEGAPEPEILHPDDVERADTVTVSRGEVEEARVQNQRAESEITKLWGGLDTDVQKELVGEQRKWAQEKISNCRQAAAQADRQEYAEYLKLQCDTRMTRERIQYLRGYSID

SEQ ID NO: 689 - DNA, 909 bp, Neisseria meningitidis
atgcagctgatcgactattcacattcatttttctcggttgtgccaccctttttggcactggcacttgccgtcattacccgccgcgtactgctgtctttaggcatcggtattctggwysgcgttgcctttttggtcggcggcaaccccgtcgacggtctgacacacctgaaagacatggtcgtcggcttggcttggtcagacgsygattggtcgctgggcaaaccaaaaatcttggttttcckgatacttttgggtatttttacttccctgctgacctactccggcagcaatacttcgctggtattcggcggcacttgcggcgtctttgccgtcgttctctgcacgctcggcacgattaaaaccgccgactatcccaaagccgtttggcagggtgcgaaatctatgttcggcgcaatcgccattttaatcctcgcttggctcatcagtacggttgtcggcgaaatgcacaccggcgattacctctccacactggttgcgggcaacatccatcccggcttcctgcccgtcatcctcttcctgctcgccagcgtgatggcgtttgccacaggcacaagctgggggacgttcggcattatgctgccgattgccgccgccatggcggtcaaagtcgaacccgcgctgattatcccgtgtatgtccgcagtaatggcgggggcggtatgcggcgaccactgctcgcccatttccgacacgaccatcctgtcgtccaccggcgcgcgctgcaaccacatcgaccacgttacctcgcaactgccttacgccttaaccgttgccgccgccgccgcatcgggctacctcgcattgggtctgacaaaatccgcgctgttgggctttggcacgacaggcattgtattggcggtgctgatttttctgttgaaagataaaaaa

SEQ ID NO: 690 - protein, 303 aa, Neisseria meningitidis
  misc_feature (39)..(40): Xaa= any amino acid
  misc_feature (68)..(68): Xaa= any amino acid
  misc_feature (81)..(81): Xaa= any amino acid
MQLIDYSHSFFSVVPPFLALALAVITRRVLLSLGIGILXXVAFLVGGNPVDGLTHLKDMVVGLAWSDXDWSLGKPKILVFXILLGIFTSLLTYSGSNTSLVFGGTCGVFAVVLCTLGTIKTADYPKAVWQGAKSMFGAIAILILAWLISTVVGEMHTGDYLSTLVAGNIHPGFLPVILFLLASVMAFATGTSWGTFGIMLPIAAAMAVKVEPALIIPCMSAVMAGAVCGDHCSPISDTTILSSTGARCNHIDHVTSQLPYALTVAAAAASGYLALGLTKSALLGFGTTGIVLAVLIFLLKDKK

SEQ ID NO: 691 - DNA, 1521 bp, Neisseria meningitidis
atgcagctgatcgactattcacattcatttttctcggttgtgccaccctttttggcactggcacttgccgtcattacccgccgcgtactgctgtctttaggcatcggtattctggtcggcgttgcctttttggtcggcggcaaccccgtcgacggtctgacacacctgaaagacatggtcgtcggcttggcttggtcagacggcgattggtcgctgggcaaaccaaaaatcttggttttcctgatacttttgggtatttttacttccctgctgacctactccggcagcaatcaggcgtttgccgactgggcaaaacggcacattaaaaaccggcgcggcgcgaaaatgctgaccgcctgcctcgtgttcgtaacctttatcgacgactatttccacagtctcgccgtcggtgcgattgcccgccccgttaccgacaagtttaaagtttcccgcaccaaactcgcctacatcctcgactccactgccgctcctatgtgcgtgctgatgcccgtttcaagctggggcgcgtcgattatcgccacgcttgccggactgctcgttacctacaaaatcaccgaatacacgccgatggggacgtttgtcgccatgagcctgatgaactattacgcactgtttgccctgattatggtgttcgtcgtcgcatggttttccttcgacatcggctcgatggcacgtttcgaacaagccgcgttgaacgaagcccacgatgaaactgccgtttcagacgctaccaaaggtcgtgtttacgcactgattattcccgttttggccttaatcgcctcaacggtttccgccatgatctacaccggcgcgcaggcaagcgaaaccttcagcattttgggggcatttgaaaacacggacgtaaacacttcgctggtattcggcggcacttgcggcgtccttgccgtcgttctctgcacgctcggcacgattaaaaccgccgactatcccaaagccgtttggcagggtgcgaaatctatgttcggcgcaatcgccattttaatcctcgcttggctcatcagtacggttgtcggcgaaatgcacaccggcgattacctctccacactggttgcgggcaacatccatcccggcttcctgcccgtcatcctcttcctgctcgccagcgtgatggcgtttgccacaggcacaagctgggggacgttcggcattatgctgccgattgccgccgccatggcggtcaaagtcgaacccgcgctgattatcccgtgtatgtccgcagtaatggcgggggcggtatgcggcgaccactgctcgcccatttccgacacgaccatcctgtcgtccaccggcgcgcgctgcaaccacatcgaccacgttacctcgcaactgccttacgccttaaccgttgccgccgccgccgcatcgggctacctcgcattgggtctgacaaaatccgcgctgttgggctttggcacgacaggcattgtattggcggtgctgatttttctgttgaaagataaaaaacgcgccaacgcctga

SEQ ID NO: 692 - protein, 506 aa, Neisseria meningitidis
MQLIDYSHSFFSVVPPFLALALAVITRRVLLSLGIGILVGVAFLVGGNPVDGLTHLKDMVVGLAWSDGDWSLGKPKILVFLILLGIFTSLLTYSGSNQAFADWAKRHIKNRRGAKMLTACLVFVTFIDDYFHSLAVGAIARPVTDKFKVSRTKLAYILDSTAAPMCVLMPVSSWGASIIATLAGLLVTYKITEYTPMGTFVAMSLMNYYALFALIMVFVVAWFSFDIGSMARFEQAALNEAHDETAVSDATKGRVYALIIPVLALIASTVSAMIYTGAQASETFSILGAFENTDVNTSLVFGGTCGVLAVVLCTLGTIKTADYPKAVWQGAKSMFGAIAILILAWLISTVVGEMHTGDYLSTLVAGNIHPGFLPVILFLLASVMAFATGTSWGTFGIMLPIAAAMAVKVEPALIIPCMSAVMAGAVCGDHCSPISDTTILSSTGARCNHIDHVTSQLPYALTVAAAAASGYLALGLTKSALLGFGTTGIVLAVLIFLLKDKKRANA

SEQ ID NO: 693 - DNA, 1521 bp, Neisseria meningitidis
  misc_feature (229)..(229): N= Unknown
  misc_feature (415)..(415): N= Unknown
  misc_feature (1120)..(1120): N= Unknown
  misc_feature (1362)..(1362): N= Unknown
  misc_feature (1410)..(1410): N= Unknown
  misc_feature (1457)..(1457): N= Unknown
atgcagctgatcgactattcacattcatttttctcggttgtgccaccctttttggcactggcacttgccgtcattacccgccgcgtactgctgtctttaggcatcggtattctggtcggcgttgcctttttggtcggcggcaaccccgtcgacggtctgacacacctgaaagacatggtcgtcggcttggcttggtcagacggcgattggtcgctgggcaaaccaaaantcttggttttcctgatacttttgggtatttttacttccctgctgacctactccggcagcaatcaggcgtttgccgactgggcaaaacggcacattaaaaaccggcgcggcgcgaaaatgctgaccgcctgcctcgtgttcgtaacctttatcgacgactatttccacagtctcgccgtcggtgcgnttgcccgccccgttaccgacaagtttaaagtttcccgcgccaaactcgcctacatcctcgactccactgccgcgcctatgtgcgtgctgatgcccgtttcaagctggggcgcgtcgattatcgccacgcttgccggactgctcgttacctacaaaatcaccgaatacacgccgatggggacgtttgtcgccatgagcctgatgaactattacgcactgtttgccctgattatggtgttcgtcgtcgcatggttctccttcgacatcggctcgatggcacgtttcgaacaagccgcgttgaacgaagcccacgatgaaactgccgtttcagacggcagctggggcagggtttacgcattgattattcccgttttggccttaatcgcctcaacggtttccgccatgatctacaccggtgcacaggcaagcgaaaccttcagcattttgggtgcatttgaaaatacggacgtgaacacttcgctggtattcggcggcacttgcggcgtgcttgccgtcgtcctctgcacgctcggcacgattaaaatcgccgattatcccaaagccgtttggcagggtgcgaaatccatgttcggcgcaatcgccattttaatccttgcctggctcatcagtacggttgtcggcgaaatgcacacaggcgactacctctccacgctggttgcgggcaacatccatcccggcttcctgnccgtcatccttttcctgctcgccagcgtgatggcgtttgccacaggcacaagctgggggacgttcggcatcatgctgccgattgccgccgccatggcggtcaaagtcgatccctcactgattatcccgtgtatgtccgccgtgatggcgggggcggtatgcggcgaccactgctcgcccatttccgacacgaccatcctgtcgtccaccggcgcgcgctgcaaccacatcgaccacgttacntcgcaactgccttacgccttaaccgttgccgccgccgccgcatcgggntacctcgcattgggtctgacaaaatccgcgctgttgggttttggcangacaggcattgtattggcggtgctgatttttctgttgaaagataaaaaacgcgccaacgcctga

SEQ ID NO: 694 - protein, 506 aa, Neisseria meningitidis
  misc_feature (77)..(77): Xaa= any amino acid
  misc_feature (139)..(139): Xaa= any amino acid
  misc_feature (374)..(374): Xaa= any amino acid
  misc_feature (486)..(486): Xaa= any amino acid
MQLIDYSHSFFSVVPPFLALALAVITRRVLLSLGIGILVGVAFLVGGNPVDGLTHLKDMVVGLAWSDGDWSLGKPKXLVFLILLGIFTSLLTYSGSNQAFADWAKRHIKNRRGAKMLTACLVFVTFIDDYFHSLAVGAXARPVTDKFKVSRAKLAYILDSTAAPMCVLMPVSSWGASIIATLAGLLVTYKITEYTPMGTFVAMSLMNYYALFALIMVFVVAWFSFDIGSMARFEQAALNEAHDETAVSDGSWGRVYALIIPVLALIASTVSAMIYTGAQASETFSILGAFENTDVNTSLVFGGTCGVLAVVLCTLGTIKIADYPKAVWQGAKSMFGAIAILILAWLISTVVGEMHTGDYLSTLVAGNIHPGFLXVILFLLASVMAFATGTSWGTFGIMLPIAAAMAVKVDPSLIIPCMSAVMAGAVCGDHCSPISDTTILSSTGARCNHIDHVTSQLPYALTVAAAAASGYLALGLTKSALLGFGXTGIVLAVLIFLLKDKKRANA

SEQ ID NO: 695 - DNA, 1521 bp, Neisseria gonorrhoeae
atgcagctgattgactattcacattcatttttctcggttgtgccaccctttttggcactggcacttgccgtcattacccgccgcgtactgctgtctttaggcatcggtattttggtcggcgttgcctttttggtcggcggcaaccccgtcgacggtctgacacacctgaaagacatggtcgtcggcttggcttgggcagacggcgattggtcgctgggcaaaccaaaaatcttggttttcctgatacttttgggcattttcacttcactgctgacctactccggcagcaatcaggcgtttgccgactgggcaaaacggcacattaaaaaccggtgcggcgcgaaaatgctgaccgcctgcctcgtgttcgtaacctttatcgacgactatttccacagcctcgccgtcggtgcgattgcccgccccgttaccgacaagtttaaagtttcccgcgccaaactcgcctacatcctcgactccactgcctcgcccatgtgcgtgctgatgcccgtttcaagctggggcgcgtcgattatcgccacgcttgccggattgctcgttacctacaaaattaccgaatacacgccgatggggacgtttgtcgccatgagcctgatgaactattacgcgctgtttgccctgattatggtattcgtcgtcgcatggttctccttcgacatcggctcgatggcgcgtttcgaacaggctgcgttgaacgaagcccaggacgaaaccgccgcttcagacgctaccaaaggtcgtgtttacgcattgattattcccgttttggccttaatcgcctcaacggtttccgccatgatctacaccggcgcgcaggcaagcgaaaccttcagcattttgggggcatttgaaaataccgacgtaaacacttcgctggtattcggcggcacttgcggcgtgcttgccgtcgtcctctgcacgttcggcacgattaaaaccgccgattatcccaaagccgtgtggcagggtgcgaaatccatgttcggcgcaatcgccattttaatcctcgcctggctcatcagtacggttgtcggcgaaatgcacacgggcgactacctctccacgctggttgcgggcaacatccatcccggcttcctgcccgtcatcctcttcctgctcgccagcgtgatggcgtttgccacaggcacaagctgggggacgttcggcattatgctgccgattgccgccgccatggcggtcaaagtcgaacccgcgctgattatcccgtgtatgtccgcagtaatggcgggggcggtatgcggcgaccactgttcgcccatctccgacacgaccatcctgtcgtccaccggcgcgcgctgcaaccacatcgaccacgttacctcgcaactgccttatgccctgacggttgccgccgccgccgcatcgggctacctcgcattgggtctgacaaaatccgcgctgttgggctttggcacgaccggtattgtattggcggtgctgatttttctgttgaaagataaaaaacgcgccgacgtttga

SEQ ID NO: 696 - protein, 506 aa, Neisseria gonorrhoeae
MQLIDYSHSFFSVVPPFLALALAVITRRVLLSLGIGILVGVAFLVGGNPVDGLTHLKDMVVGLAWADGDWSLGKPKILVFLILLGIFTSLLTYSGSNQAFADWAKRHIKNRCGAKMLTACLVFVTFIDDYFHSLAVGAIARPVTDKFKVSRAKLAYILDSTASPMCVLMPVSSWGASIIATLAGLLVTYKITEYTPMGTFVAMSLMNYYALFALIMVFVVAWFSFDIGSMARFEQAALNEAQDETAASDATKGRVYALIIPVLALIASTVSAMIYTGAQASETFSILGAFENTDVNTSLVFGGTCGVLAVVLCTFGTIKTADYPKAVWQGAKSMFGAIAILILAWLISTVVGEMHTGDYLSTLVAGNIHPGFLPVILFLLASVMAFATGTSWGTFGIMLPIAAAMAVKVEPALIIPCMSAVMAGAVCGDHCSPISDTTILSSTGARCNHIDHVTSQLPYALTVAAAAASGYLALGLTKSALLGFGTTGIVLAVLIFLLKDKKRADV

SEQ ID NO: 697 - DNA, 247 bp, Neisseria meningitidis
  misc_feature (20)..(20): N= Unknown
aagcaatggtatgccgacgnagtatcaagacggaaatggttatggtcaacgatgagcctgccaaaattctgacttgggatgaaagcggccgattactctcggaactgtctatccgccaccatcaacgcaacggggtggttttggagtggtatgaagatggttctaaaaagagcgaagtgtttatcaggatgacaagttggtcaggaaaacccagtgggataaggatggttatttaatcgaaccctga

SEQ ID NO: 698 - protein, 82 aa, Neisseria meningitidis
  misc_feature (7)..(7): Xaa= any amino acid
  misc_feature (60)..(60): Xaa= any amino acid
KQWYADXSIKTEMVMVNDEPAKILTWDESGRLLSELSIRHHQRNGVVLEWYEDGSKKSEXVYQDDKLVRKTQWDKDGYLIEP

SEQ ID NO: 699 - DNA, 738 bp, Neisseria meningitidis
atgaaaaaattatctcggattgtattttcaactgtcctgttgggtttttcggccgctttgccggcgcagacctattctgtttattttaatcagaacggaaagctgacggcgacgatgtcttctgccgcttatatcaggcaatatagtgtggtggcgggtattgcgcacgcgcaggatttttattatccgtcgatgaagaaatattctgaaccttatatcgttgcttcaacgcaaatcaaatcttttgtgcctaccctgcaaaacggtatgttgattttgtggcattttaatggtcagaaaaaaatggcggggggcttcagcaagggtaagccggacggggagtgggtcaactggtatccgaacggtaaaaaatctgccgttatgccttataaaaatggcttgagtgagggtacgggataccgctattaccgtaacggcggcaaggaaagcgaaatccagtttaagcaaaataaggcaaacggcgtatggaagcaatggtatgccgacggcagtatcaagacggaaatggttatggtcaacgatgagcctgccaaaattctgacttgggatgaaagcggccgattactctcggaactgtctatccgccaccatcaacgcaacggggtggttttggagtggtatgaagatggttctaaaaagagcgaagctgtttatcaggatgacaagttggtcaggaaaacccagtgggataaggatggttatttaatcgaaccctga

SEQ ID NO: 700 - protein, 245 aa, Neisseria meningitidis
MKKLSRIVFSTVLLGFSAALPAQTYSVYFNQNGKLTATMSSAAYIRQYSVVAGIAHAQDFYYPSMKKYSEPYIVASTQIKSFVPTLQNGMLILWHFNGQKKMAGGFSKGKPDGEWVNWYPNGKKSAVMPYKNGLSEGTGYRYYRNGGKESEIQFKQNKANGVWKQWYADGSIKTEMVMVNDEPAKILTWDESGRLLSELSIRHHQRNGVVLEWYEDGSKKSEAVYQDDKLVRKTQWDKDGYLIEP

SEQ ID NO: 701 - DNA, 738 bp, Neisseria meningitidis
  misc_feature (71)..(71): N= Unknown
  misc_feature (115)..(115): N= Unknown
  misc_feature (129)..(129): N= Unknown
  misc_feature (177)..(177): N= Unknown
  misc_feature (183)..(183): N= Unknown
  misc_feature (291)..(291): N= Unknown
  misc_feature (309)..(309): N= Unknown
  misc_feature (419)..(420): N= Unknown
  misc_feature (613)..(613): N= Unknown
  misc_feature (662)..(662): N= Unknown
  misc_feature (714)..(714): N= Unknown
atgaaaaaattatctcggattgtattttcaactgtcctgttgggtttttcggccgctttgccggcgcaganctattctgtttattttaatcagaacgggaaactgacggcgacgntgtcttctgccgcntatatcaggcaatatagtgtggcggagggtattgcgcacgcgcagganttttantatccgtcgatgaagaaatattccgaaccttatatcgttgcttcaacgcaaatcaaatcttttgtgcctaccctgcaaaacggtatgttgattttgtggcattttaanggtcagaaaaaaatggcngggggcttcagcaagggtaagccggacggggagtgggtcaactggtatccgaacggtaaaaaatctgccgttatgccttataaaaatggtttgagtgaaggtacggggtnncgctattaccgtaacggcggcaaggaaagcgaaatccagtttaaacagaataaggcaaacggcgtatggaagcaatggtatgccgacggcaatatcaaaacggaaatggttatggtcaatgatgagcctgccaaaattctgacatgggatgaaagcggtcgattactctcggaactgtctatccatcatcatnaacgtaatggagtagtcttagagtggtatgaagatggttctaaaaagantgaagctgtttatcaggatgataagttggtcaggaaaacccagtgggataangatggttatttaatcgaaccctga

SEQ ID NO: 702 - protein, 245 aa, Neisseria meningitidis
  misc_feature (24)..(24): Xaa= any amino acid
  misc_feature (39)..(39): Xaa= any amino acid
  misc_feature (59)..(59): Xaa= any amino acid
  misc_feature (61)..(61): Xaa= any amino acid
  misc_feature (97)..(97): Xaa= any amino acid
  misc_feature (140)..(140): Xaa= any amino acid
  misc_feature (205)..(205): Xaa= any amino acid
  misc_feature (221)..(221): Xaa= any amino acid
  misc_feature (238)..(238): Xaa= any amino acid
MKKLSRIVFSTVLLGFSAALPAQXYSVYFNQNGKLTATXSSAAYIRQYSVAEGIAHAQXFXYPSMKKYSEPYIVASTQIKSFVPTLQNGMLILWHFXGQKKMAGGFSKGKPDGEWVNWYPNGKKSAVMPYKNGLSEGTGXRYYRNGGKESEIQFKQNKANGVWKQWYADGNIKTEMVMVNDEPAKILTWDESGRLLSELSIHHHXRNGVVLEWYEDGSKKXEAVYQDDKLVRKTQWDXDGYLIEP

SEQ ID NO: 703 - DNA, 738 bp, Neisseria gonorrhoeae
atgaagaaattatctcggattgtattttcaatcgtactgttgggtttttcggccgctttgccggcgcagacctattctgtttattttaatcagaacgggaaactgacggcgacgatgtcttctgccgcttatatcaggcaatatagtgtggcggcgggtatcgcacacgcgcaggatttttattatccgtcgatgaagaaatattccgaaccttatatcgttgcttcaacgcaaatcaaatcttttgtgcctaccctgcaaaacggtatgttgattttgtggcattttaatggtcagaaaaaaatggcggggggcttcagcaagggtaagccggacggggaatgggtcaactggtatccgaacggtaaaaaatctgcggttatgccttataaaaatggcttgagtgagggtacgggataccgttattaccgtaacggcggcaaggaaagcgaaatccagtttaagcaaaataaggcgaacggcgtatggaagcaatggtatgccgatggaagtatcaagacggaaatggttatggtcaacgatgagcctgccaaaattctgacttgggatgaaagcggccgattactttcggaactgtctatccgccaccataaacgcaacggggtggttttggagtggtatgaagatggttctaaaaagagcgaggctgtttatcaggatgacaagttggtcaggaaaacccaatgggataaggatggttatttaatcgaaccctga

SEQ ID NO: 704 - protein, 245 aa, Neisseria gonorrhoeae
MKKLSRIVFSIVLLGFSAALPAQTYSVYFNQNGKLTATMSSAAYIRQYSVAAGIAHAQDFYYPSMKKYSEPYIVASTQIKSFVPTLQNGMLILWHFNGQKKMAGGFSKGKPDGEWVNWYPNGKKSAVMPYKNGLSEGTGYRYYRNGGKESEIQFKQNKANGVWKQWYADGSIKTEMVMVNDEPAKILTWDESGRLLSELSIRHHKRNGVVLEWYEDGSKKSEAVYQDDKLVRKTQWDKDGYLIEP

SEQ ID NO: 705 - DNA, 517 bp, Neisseria meningitidis
atgaaatttaccaagcaccccgtctgggcaatggcgttccgcccattttattcgctggcggctctgtacggcgcattgtccgtattgctgtggggtttcggctacacgggaacgcackagctgtccggtttctattggcacgcgcatgagatgatttggggttatgccggactggtcgtcatcgccttcctgctgaccgccgtcgccacttggacggggcagccgcccacgcggggcggcgtatctggtcggcttgactatcttttggctggctgcgcggattgccgcctttatcccgggttggggtgcgtcggcaagcggcatactcggtacgctgtttttctggtacggcgcggtgtgcatggctttgcccgttatccgttcgcagaatcaacgcaactatgttgccgtgttcgcgctgttcgtcttgggcggcacgcatgcggcgttccacgtccagctgcacaacggcaacctaggcggactcttgagcggattgcagtcgggcttggtgatg

SEQ ID NO: 706 - protein, 172 aa, Neisseria meningitidis
  misc_feature (40)..(40): Xaa= any amino acid
MKFTKHPVWAMAFRPFYSLAALYGALSVLLWGFGYTGTHXLSGFYWHAHEMIWGYAGLVVIAFLLTAVATWTGQPPTRGGVLVGLTIFWLAARIAAFIPGWGASASGILGTLFFWYGAVCMALPVIRSQNQRNYVAVFALFVLGGTHAAFHVQLHNGNLGGLLSGLQSGLVM

SEQ ID NO: 707 - DNA, 1155 bp, Neisseria meningitidis
atgaaatttaccaagcaccccgtctgggcaatggcgttccgcccattttattcgctggcggctctgtacggcgcattgtccgtattgctgtggggtttcggctacacgggaacgcacgagctgtccggtttctattggcacgcgcatgagatgatttggggttatgccggactggtcgtcatcgccttcctgctgaccgccgtcgccacttggacggggcagccgcccacgcggggcggcgttctggtcggcttgactatcttttggctggctgcgcggattgccgcctttatcccgggttggggtgcgtcggcaagcggcatactcggtacgctgtttttctggtacggcgcggtgtgcatggctttgcccgttatccgttcgcagaatcaacgcaactatgttgccgtgttcgcgctgttcgtcttgggcggcacgcatgcggcgttccacgtccagctgcacaacggcaacctaggcggactcttgagcggattgcagtcgggcttggtgatggtgtcgggttttatcggtctgattggtacgcggattatttcgttttttacgtccaaacgcttgaatgtgccgcagattcccagtccgaaatgggtggcgcaggcttcgctgtggctgcccatgctgactgccatgctgatggcgcacggtgtgttggcttggctgtctgccgtttttgcctttgcggcaggtgtgatttttaccgtgcaggtgtaccgctggtggtataaacccgtgttgaaagagccgatgctgtggattctgtttgccggctatctgtttaccggattggggctgattgcggtcggcgcgtcttatttcaaacccgctttcctcaatctgggtgtgcatctgatcggggtcggcggtatcggcgtgctgactttgggcatgatggcgcgtaccgcgcttggtcatacgggcaatccgatttatccgccgcccaaagccgttcccgttgcgttttggctgatgatggcggcaaccgccgtccgtatggttgccgtattttcttccggcactgcctacacgcacagcatccgcacctcttcggttttgtttgcactcgcgcttttggtgtatgcgtggaagtatattccttggctgattcgtccgcgttcggacggcaggcccggttga

SEQ ID NO: 708 - protein, 384 aa, Neisseria meningitidis
MKFTKHPVWAMAFRPFYSLAALYGALSVLLWGFGYTGTHELSGFYWHAHEMIWGYAGLVVIAFLLTAVATWTGQPPTRGGVLVGLTIFWLAARIAAFIPGWGASASGILGTLFFWYGAVCMALPVIRSQNQRNYVAVFALFVLGGTHAAFHVQLHNGNLGGLLSGLQSGLVMVSGFIGLIGTRIISFFTSKRLNVPQIPSPKWVAQASLWLPMLTAMLMAHGVLAWLSAVFAFAAGVIFTVQVYRWWYKPVLKEPMLWILFAGYLFTGLGLIAVGASYFKPAFLNLGVHLIGVGGIGVLTLGMMARTALGHTGNPIYPPPKAVPVAFWLMMAATAVRMVAVFSSGTAYTHSIRTSSVLFALALLVYAWKYIPWLIRPRSDGRPG

SEQ ID NO: 709 - DNA, 1155 bp, Neisseria meningitidis
atgaaatttaccaagcaccccgtttgggcaatggcgttccgcccgttttattcactggcggctctgtacggcgcattgtccgtattgctgtggggtttcggctacacgggaacgcacgagctgtccggtttctattggcacgcgcatgagatgatttggggttatgccggactggtcgtcatcgccttcctgctgaccgccgtcgccacttggacggggcagccgcccacgcggggcggcgttctggtcggcttgactatcttttggctggctgcgcggattgccgcctttatcccgggttggggtgcgtcggcaagcggcatactcggtacgctgtttttctggtacggcgcggtgtgcatggctttgcccgttatccgttcgcagaatcaacgcaattatgttgccgtgttcgcgctgttcgtcttgggcggtacgcacgcggcgttccacgtccagctgcacaacggcaacctaggcggactcttgagcggattgcagtcgggcttggtgatggtgtcgggttttatcggtctgattggtacgcggattatttcgttttttacgtccaaacggttgaatgtgccgcagattcccagtccgaaatgggtggcgcaggcttcgctgtggctgcccatgctgaccgccatgctgatggcgcacggcgtgatgccttggctgtcggcggctttcgcgtttgcggcaggtgtgatttttaccgtgcaggtgtaccgctggtggtataagcctgtgttgaaagagccgatgctgtggattctgtttgccggctatctgtttaccggattggggctgattgcggtcggcgcgtcttatttcaaacccgctttcctcaatctgggtgtgcatctgatcggggtcggcggtatcggcgtgctgactttgggcatgatggcgcgtaccgcgctcggtcatacgggcaatccgatttatccgccgcccaaagccgttcccgttgcgttttggctgatgatggcggcaaccgccgtccgtatggttgccgtattttcttccggcactgcctacacgcacagcatacgcacctcttcggttttgtttgcactcgcgcttttggtgtatgcgtggaagtatattccttggctgattcgtccgcgttcggacggcaggcccggttga

SEQ ID NO: 710 - protein, 384 aa, Neisseria meningitidis
MKFTKHPVWAMAFRPFYSLAALYGALSVLLWGFGYTGTHELSGFYWHAHEMIWGYAGLVVIAFLLTAVATWTGQPPTRGGVLVGLTIFWLAARIAAFIPGWGASASGILGTLFFWYGAVCMALPVIRSQNQRNYVAVFALFVLGGTHAAFHVQLHNGNLGGLLSGLQSGLVMVSGFIGLIGTRIISFFTSKRLNVPQIPSPKWVAQASLWLPMLTAMLMAHGVMPWLSAAFAFAAGVIFTVQVYRWWYKPVLKEPMLWILFAGYLFTGLGLIAVGASYFKPAFLNLGVHLIGVGGIGVLTLGMMARTALGHTGNPIYPPPKAVPVAFWLMMAATAVRMVAVFSSGTAYTHSIRTSSVLFALALLVYAWKYIPWLIRPRSDGRPG

SEQ ID NO: 711 - DNA, 8 bp, Neisseria gonorrhoeae
  misc_feature (1)..(8): N = Unknown
nnnnnnnn

SEQ ID NO: 712 - protein, 271 aa, Neisseria gonorrhoeae
MKFTKHPVWAMAFRPFYSLAALYGALSVLLWGFGYTGTHELSGFYWHAHEMIWGYAGLVVIAFLLTAVATWTGQPPTRGGVLVGLTAFWLAARIAAFIPGWGAAASGILGTLFFWYGAVCMALPVIRSQNRRNYVAVFAIFVLGGTHAAFHVQLHNGNLGGLLSGLQSGLVMVWGFIGLIGMKIISFFTSKRLKLPQIPSPKWVAHASLWLPMLNAILMAHRVMPWLSAAFPFAAGVIFTVQVYAGGITPIEETSCGSVAGICYRLGNSSG

SEQ ID NO: 713 - DNA, 1155 bp, Neisseria gonorrhoeae
atgaaatttaccaaacatcccgtctgggcaatggcgttccgcccgttttattcactggcggcactgtacggcgcattgtccgtattgctgtggggtttcggctacacgggaacgcacgagctgtccggtttctattggcacgcgcatgagatgatttggggttatgccggtctcgtcgtcatcgccttcctgctgaccgccgtcgccacttggacgggacagccgcccacgaggggcggcgttctggtcggcttgaccgccttttggctggctgcgcggattgccgcctttatcccgggttggggtgcggcggcaagcggcatactcggtacgctgtttttctggtacggcgcggtgtgcatggctttgcccgttatccgttcgcaaaaccggcgcaactatgtcgccgtattcgcaatatttgtgctgggcggtacgcatgcggcgttccacgtccagctgcacaacggcaacctaggcggactcttgagcggattgcagtcgggcctggttatggtgtcgggctttatcggcctgattgggatgaggattatttcgttttttacgtccaaacggttgaacgtgccgcagattcccagtccgaaatgggtggcgcaggcttcgctgtggctacccatgctgaccgccatactgatggcgcacggcgtgatgccttggctgtcggcggctttcgcgtttgcggcgggcgtgatttttaccgtacaggtgtaccgctggtggtataaacccgtattgaaagaaccgatgctgtggattctgtttgccggctatctgtttaccggattggggctgattgcggtcggcgcgtcttatttcaaacctgccttcctcaatctgggcgtacatctgatcggggtcggcggtatcggcgtgctgactttgggcatgatggcgcgtaccgcgctcggtcatacgggcaattcgatttatccgccgcccaaagccgttcccgttgcgttttggctgatgatggcggcaaccgccgtccgtatggttgccgtattttcttccggcactgcctacacgcacagcatccgcacgtcttcggttttgtttgcactcgcgctgctggtgtatgcgtggaaatacattccgtggctgatccgtccgcgttcggacggcaggcccggttga

SEQ ID NO: 714 - protein, 384 aa, Neisseria gonorrhoeae
MKFTKHPVWAMAFRPFYSLAALYGALSVLLWGFGYTGTHELSGFYWHAHEMIWGYAGLVVIAFLLTAVATWTGQPPTRGGVLVGLTAFWLAARIAAFIPGWGAAASGILGTLFFWYGAVCMALPVIRSQNRRNYVAVFAIFVLGGTHAAFHVQLHNGNLGGLLSGLQSGLVMVSGFIGLIGMRIISFFTSKRLNVPQIPSPKWVAQASLWLPMLTAILMAHGVMPWLSAAFAFAAGVIFTVQVYRWWYKPVLKEPMLWILFAGYLFTGLGLIAVGASYFKPAFLNLGVHLIGVGGIGVLTLGMMARTALGHTGNSIYPPPKAVPVAFWLMMAATAVRMVAVFSSGTAYTHSIRTSSVLFALALLVYAWKYIPWLIRPRSDGRPG

SEQ ID NO: 715 - DNA, 570 bp, Neisseria meningitidis
atgccgtctgaaggttcagacggcmtcggtgycggggaaycagaagyggtagcgcatgcccaatgagacttcgtgggttttgaagcgggtgttttccaagcgtccccagttgtggtaacggtatccggtgtcyaargtcagcttgggygtgatgtcgaaaccgacaccggcgatgacaccaagaccyamgctgctgatrctgtkgctttcgtgataggsaggtttgytggkmksasyttgtayratwkkgcctsscwstgkagmgccktkckytggtkkaswgrwartagtcgtggtttytkttyycaccgaatgaacytgatgtttaacgtgtccgtaggcgacgcgcgcgccgatatagggtttgaatttatcgttgagtttgaaatcgtaaatggcggacaagccgagagaagaaacggcgtggaagctgccgtttccctgatgttttgtttgggtttctttgtagttgttgtttatctcttcagtaacttttttagtagaagaattactttctttccattttctgtaactggcataatctgccgctattctccagccgccgaaatc

SEQ ID NO: 716 - protein, 190 aa, Neisseria meningitidis
  misc_feature (9)..(9): Xaa= any amino acid
  misc_feature (11)..(11): Xaa= any amino acid
  misc_feature (14)..(14): Xaa= any amino acid
  misc_feature (16)..(16): Xaa= any amino acid
  misc_feature (22)..(22): Xaa= any amino acid
  misc_feature (45)..(46): Xaa= any amino acid
  misc_feature (50)..(50): Xaa= any amino acid
  misc_feature (63)..(63): Xaa= any amino acid
  misc_feature (67)..(67): Xaa= any amino acid
  misc_feature (76)..(76): Xaa= any amino acid
  misc_feature (78)..(79): Xaa= any amino acid
  misc_feature (82)..(83): Xaa= any amino acid
  misc_feature (85)..(88): Xaa= any amino acid
  misc_feature (90)..(91): Xaa= any amino acid
  misc_feature (93)..(96): Xaa= any amino acid
  misc_feature (101)..(102): Xaa= any amino acid
MPSEGSDGXGXGEXEXVAHAQXDFVGFEAGVFQASPVVVTVSGVXXQLGXDVETDTGDDTKTXAADXVAFVIGRFXGXXLYXXAXXXXAXXWXXXXSRGFXXHRMNLMFNVSVGDARADIGFEFIVEFEIVNGGQAERRNGVEAAVSLMFCLGFFVVVVYLFSNFFSRRITFFPFSVTGIICRYSPAAEI

SEQ ID NO: 717 - DNA, 8 bp, Neisseria gonorrhoeae
  misc_feature (1)..(8): N = Unknown
nnnnnnnn

SEQ ID NO: 718 - protein, 360 aa, Neisseria gonorrhoeae
MPSETVGSIVNVGVDESVGFSPPFPSIQHFYRFHRIHRIRLFRPPGPMQLNRHSHGSGNLGRGVWATVLSDKFPCGQVRIPACAGMTNFEIAVLSGMTVRVFYCARPAPVNGGRLKMPSEGSDGIGIGESEAVAHAQRGFVGFEAGVFQASPVVVAVAGVQGQAGRDVYAHARHRAEAQAAAAVAFLIGVFLRMSVRINRNCCVSITRVGGKSTCYFFSRIDAVSDVSVGDARTDIGFEFVVEFEIVNGGQAERRNGVECAVFLMFRLLVFYVKLVAAKSFIILSFQLFYVHGIFIVVPFPVTGIIRGDAPAAEVVADRHPGVDGMRTDVSEIIAYRAYFVFAWSGWFRIIVGNAFGGVG

SEQ ID NO: 719 - DNA, 435 bp, Neisseria meningitidis
atgtttgcttttttagaagccttttttgtcgaatacggttatgcggctgttttttttgtattggtcatctgcggtttcggcgtgccgattcccgaggatttgaccttggtaacaggcggcgtgatttcgggtatgggttataccaatccgcatattatgtttgcagtcggtatgctcggcgtattggtcggggacggcatcatgttcgccgccggacgaatttgggggcagarartcctarggttcaracctattgcgsgcatcatgacgccgraacgttatgagcaggttcaggaaaaattcgacaaatacggtaactgggtcttatttgtcgcccgtttcctgcccggtttgagaacggccgtatttgttacagccggtatcagccgcaaggtttcatacttgcgttttatcattatggatggactggccgca

SEQ ID NO: 720 - protein, 145 aa, Neisseria meningitidis
  misc_feature (78)..(79): Xaa= any amino acid
  misc_feature (81)..(81): Xaa= any amino acid
  misc_feature (83)..(83): Xaa= any amino acid
  misc_feature (87)..(87): Xaa= any amino acid
  misc_feature (92)..(92): Xaa= any amino acid
MFAFLEAFFVEYGYAAVFFVLVICGFGVPIPEDLTLVTGGVISGMGYTNPHIMFAVGMLGVLVGDGIMFAAGRIWGQXXLXFXPIAXIMTPXRYEQVQEKFDKYGNWVLFVARFLPGLRTAVFVTAGISRKVSYLRFIIMDGLAA

SEQ ID NO: 721 - protein, 684 aa, Neisseria meningitidis
ATGTTTGCTTTTTTAGAAGCCTTTTTTGTCGAATACGGTTATGCGGCTGTTTTTTTTGTATTGGTCATCTGCGGTTTCGGCGTGCCGATTCCCGAGGATTTGACCTTGGTAACAGGCGGCGTGATTTCGGGTATGGGTTATACCAATCCGCATATTATGTTTGCAGTCGGTATGCTCGGCGTATTGGTCGGGGACGGCATCATGTTCGCCGCCGGACGAATTTGGGGGCAGAAAATCCTAAGGTTCAAACCTATTGCGCGCATCATGACGCCGAAACGTTATGAGCAGGTTCAGGAAAAATTCGACAAATACGGTAACTGGGTCTTATTTGTCGCCCGTTTCCTGCCCGGTTTGAGAACGGCCGTATTTGTTACAGCCGGTATCAGCCGCAAGGTTTCATACTTGCGTTTTATCATTATGGATGGACTGGCCGCACTGATTTCCGTCCCTATTTGGATTTATCTGGGCGAATACGGTGCGCACAACATCGATTGGCTGATGGCGAAAATGCACAGCCTGCAATCGGGTATTTTTGTTATCTTGGGTATAGGTGCGACCGTTGTCGCTTGGATTTGGTGGAAAAAACGCCAACGTATCCAGTTTTACCGCAGCAAATTGAAAGAAAAGCGGGCGCAACGCAAAGCCGCCAAGGCAGCCAAAAAAGCCGCGCAAAGCAAACAATAA

SEQ ID NO: 722 - protein, 227 aa, Neisseria meningitidis
MFAFLEAFFVEYGYAAVFFVLVICGFGVPIPEDLTLVTGGVISGMGYTNPHIMFAVGMLGVLVGDGIMFAAGRIWGQKILRFKPIARIMTPKRYEQVQEKFDKYGNWVLFVARFLPGLRTAVFVTAGISRKVSYLRFIIMDGLAALISVPIWIYLGEYGAHNIDWLMAKMHSLQSGIFVILGIGATVVAWIWWKKRQRIQFYRSKLKEKRAQRKAAKAAKKAAQSKQ

SEQ ID NO: 723 - DNA, 684 bp, Neisseria meningitidis
atgtttgcccttttggaagccttttttgtcgaatacggctatgcggccgtgtttttcgttttggtcatctgcggtttcggcgtgccgattcccgaggatttgaccttggtaacaggcggcgtgatttcgggtatgggttataccaatccgcatattatgtttgcagtcggtatgctcggcgtattggtcggggacggcatcatgttcgccgccggacgcatctgggggcagaaaatcctcaagttcaaaccgattgcgcgcatcatgacgccgaaacgttacgcacaggttcaggaaaaattcgacaaatacggcaactgggtgttatttgtcgctcgtttcctgcccggtttgcggactgccgttttcgttaccgccggcatcagccgcaaagtatcgtatctgcgctttctgattatggacgggcttgccgcgctgatttccgtgcccgtttggatttacttgggcgagtacggcgcgcacaacatcgattggctgatggcgaaaatgcacagcctgcaatccggcatcttcatcgcattgggcgtgctggcggcggcgctggcgtggttctggtggcgcaaacgccgacattatcagctttaccgcgcacaattgagcgaaaaacgcgccaaacgcaaggcggaaaaggcagcgaaaaaagcggcacagaagcagcagtaa

SEQ ID NO: 724 - protein, 227 aa, Neisseria meningitidis
MFALLEAFFVEYGYAAVFFVLVICGFGVPIPEDLTLVTGGVISGMGYTNPHIMFAVGMLGVLVGDGIMFAAGRIWGQKILKFKPIARIMTPKRYAQVQEKFDKYGNWVLFVARFLPGLRTAVFVTAGISRKVSYLRFLIMDGLAALISVPVWIYLGEYGAHNIDWLMAKMHSLQSGIFIALGVLAAALAWFWWRKRRHYQLYRAQLSEKRAKRKAEKAAKKAAQKQQ

SEQ ID NO: 725 - DNA, 8 bp, Neisseria gonorrhoeae
  misc_feature (1)..(8): N = Unknown
nnnnnnnn

SEQ ID NO: 726 - protein, 122 aa, Neisseria gonorrhoeae
YPVLFVARFLPGLRTAVFVTAGISRKVSYLRFLIMDGLAALISVPVWIYLGEYGAHNIDWLMAKMHSLQSGIFIALGVLAAALAWFWWRKRRHYQLYRAQLSEKRAKRKAEKAAKKAAQKQQ

SEQ ID NO: 727 - DNA, 684 bp, Neisseria gonorrhoeae
atgtttgcccttttggaagccttttttgtcgaatacggctatgcggccgtgtttttcgttttggtcatctgcggtttcggcgtgccgattcccgaagatttgaccttggtaacgggcggcgtgatttcgggtatgggttataccaatccgcatattatgtttgcggtcggtatgctcggcgtgttggcgggcgacggcgtgatgtttgccgccggacgcatctgggggcagaaaatcctcaagttcaaaccgattgcgcgcatcatgacgccgaaacgttacgcgcaggttcaggaaaaattcgacaaatacggcaactgggttctgtttgtcgcccgtttcctgccgggtttgcggactgccgttttcgttaccgccggcatcagccgcaaagtatcgtatctgcgctttctgattatggacgggctggccgcgctgatttccgtgcccgtttggatttacttgggcgagtacggcgcgcacaacatcgattggctgatggcgaaaatgcacagcctgcaatcgggcatcttcatcgcattgggcgtgctggcggcggcgctggcgtggttctggtggcgcaaacgccgacattatcagctttaccgcgcacaattgagcgaaaaacgcgccaaacgcaaggcggaaaaggcagcgaaaaaagcggcacagaagcagcagtaa

SEQ ID NO: 728 - protein, 227 aa, Neisseria gonorrhoeae
MFALLEAFFVEYGYAAVFFVLVICGFGVPIPEDLTLVTGGVISGMGYTNPHIMFAVGMLGVLAGDGVMFAAGRIWGQKILKFKPIARIMTPKRYAQVQEKFDKYGNWVLFVARFLPGLRTAVFVTAGISRKVSYLRFLIMDGLAALISVPVWIYLGEYGAHNIDWLMAKMHSLQSGIFIALGVLAAALAWFWWRKRRHYQLYRAQLSEKRAKRKAEKAAKKAAQKQQ

SEQ ID NO: 729 - DNA, 441 bp, Neisseria meningitidis
atgaaaaaattattggcggccgtgatgatggcaggtttggcaggcgcggtttccgccgccggagtccacgttgaggacggctgggcgcgcaccaccgtcgaaggtatgaaaataggcggcgcgttcatgaaaatccacaacgacgaagccaaacaagactttttgctcggcggaagcagccccgttgccgaccgcgtcgaagtgcatacccacatcaacgacaacggcgtgatgcggatgcgcgaagtcgaaggcggcgtgcctttggaagcgaaatccgttaccgaactcaaacccggcagctatcatgtgatgtttatgggtttgaaaaaacaattaaaagagggcgataaaattcccgttaccctgaaatttaaaaacgccaaagcgcaaaccgtccaactggaagtcaaaatcgcgccgatgccggcaatgaaccac

SEQ ID NO: 730 - protein, 147 aa, Neisseria meningitidis
MKKLLAAVMMAGLAGAVSAAGVHVEDGWARTTVEGMKIGGAFMKIHNDEAKQDFLLGGSSPVADRVEVHTHINDNGVMRMREVEGGVPLEAKSVTELKPGSYHVMFMGLKKQLKEGDKIPVTLKFKNAKAQTVQLEVKIAPMPAMNH

SEQ ID NO: 731 - DNA, 474 bp, Neisseria meningitidis
atgaaaaaattattggcggccgtgatgatggcaggtttggcaggcgcggtttccgccgccggagtccacgttgaggacggctgggcgcgcaccaccgtcgaaggtatgaaaataggcggcgcgttcatgaaaatccacaacgacgaagccaaacaagactttttgctcggcggaagcagccccgttgccgaccgcgtcgaagtgcatacccacatcaacgacaacggcgtgatgcggatgcgcgaagtcgaaggcggcgtgcctttggaagcgaaatccgttaccgaactcaaacccggcagctatcatgtgatgtttatgggtttgaaaaaacaattaaaagagggcgataaaattcccgttaccctgaaatttaaaaacgccaaagcgcaaaccgtccaactggaagtcaaaatcgcgccgatgccggcaatgaaccacggtcatcaccacggcgaagcgcatcagcactaa

SEQ ID NO: 732 - protein, 157 aa, Neisseria meningitidis
MKKLLAAVMMAGLAGAVSAAGVHVEDGWARTTVEGMKIGGAFMKIHNDEAKQDFLLGGSSPVADRVEVHTHINDNGVMRMREVEGGVPLEAKSVTELKPGSYHVMFMGLKKQLKEGDKIPVTLKFKNAKAQTVQLEVKIAPMPAMNHGHHHGEAHQH

SEQ ID NO: 733 - DNA, 474 bp, Neisseria meningitidis
  misc_feature (7)..(7): N= Unknown
  misc_feature (325)..(325): N= Unknown
  misc_feature (345)..(345): N= Unknown
atgaaanaactattggcagccgtgatgatggcaggtttggcaggcgcggtttccgccgccggaatccacgttgaggacggctgggcgcgcaccaccgtcgaaggtatgaaaatgggcggcgcgttcatgaaaatccacaacgacgaagccaaacaagactttttgctcggcggaagcagccctgttgccgaccgcgtcgaagtgcatacccatatcaatgataacggtgtgatgcggatgcgcgaagtcgaaggcggcgtgcctttggaggcgaaatccgttaccgaactcaaacccggcagctatcatgtcatgtttatgggtntgaaaaaacaattaaaaganggcgacaagattcccgttaccctgaaatttaaaaacgccaaagcacaaaccgtccaactggaagtcaaaaccgcgccgatgtcggcaatggaccacggtcatcaccacggcgaagcgcatcagcactaa

SEQ ID NO: 734 - protein, 157 aa, Neisseria meningitidis
  misc_feature (3)..(3): Xaa= any amino acid
  misc_feature (109)..(109): Xaa= any amino acid
  misc_feature (115)..(115): Xaa= any amino acid
MKXLLAAVMMAGLAGAVSAAGIHVEDGWARTTVEGMKMGGAFMKIHNDEAKQDFLLGGSSPVADRVEVHTHINDNGVMRMREVEGGVPLEAKSVTELKPGSYHVMFMGXKKQLKXGDKIPVTLKFKNAKAQTVQLEVKTAPMSAMDHGHHHGEAHQH

SEQ ID NO: 735 - DNA, 8 bp, Neisseria gonorrhoeae
  misc_feature (1)..(8): N = Unknown
nnnnnnnn

SEQ ID NO: 736 - protein, 86 aa, Neisseria gonorrhoeae
INDNGVMRMREVKGGVPLEAKSVTELKPGSYHVMFMGLKKQLKEGDKIPVTLKFKNAKAQTVQLEVKTAPMSAMNHGHHHGEAHQH

SEQ ID NO: 737 - DNA, 474 bp, Neisseria gonorrhoeae
atgaaaaaattattggcagccgtgatgatggcaggtttggcaggcgcggtttccgccgccggagtccatgtcgaggacggctgggcgcgcaccactgtcgaaggtatgaaaatgggcggcgcgttcatgaaaatccacaacgacgaagccatacaagactttgtgctcggcggaagcatgcccgttgccgaccgcgtcgaagtgcatacacacatcaacgacaacggcgtgatgcgtatgcgcgaagtcaaaggcggcgtgcctttggaggcgaaatccgttaccgaactcaaacccggcagctatcacgtgatgtttatgggtttgaaaaaacaactgaaagagggcgacaagattcccgttaccctgaaatttaaaaacgccaaagcgcaaaccgtccaactggaagtcaaaaccgcgccgatgtcggcaatgaaccacggtcatcaccacggcgaagcgcatcagcactaa

SEQ ID NO: 738 - protein, 157 aa, Neisseria gonorrhoeae
MKKLLAAVMMAGLAGAVSAAGVHVEDGWARTTVEGMKMGGAFMKIHNDEAIQDFVLGGSMPVADRVEVHTHINDNGVMRMREVKGGVPLEAKSVTELKPGSYHVMFMGLKKQLKEGDKIPVTLKFKNAKAQTVQLEVKTAPMSAMNHGHHHGEAHQH

SEQ ID NO: 739 - DNA, 702 bp, Neisseria meningitidis
atgacggtaactgcggccgaaggcggcaaagctgccaaggcgttaaaaaaatatctgattacgggcattttggtctggctgccgattgcggtaacggtttgggtggtttcctatatcgtttccgcgtccgatcagctcgtcaacctgctgccgaagcaatggcggccgcaatatgttttggggtttaatatcccggggctgggcgttatcgttgccattgccgtattgtttgtaaccggattgtttgccgccaacgtattgggtcggcagatcctcgccgcgtgggacagcctgttggggcggattccggttgtgaaatccatctattcgagtgtgaaaaaagtatccgaatacgtgctgtccgacagcagccgttcgtttaaaacgccggtactcgtgccgtttccccagcccggtatttggacgatygctttcgtgtcagggcaggtgtcgaatgcggttaaggccgcattgccgaasgacggcgattatctttccgtgtatgttccgaccacgccgaatccgaccggcggttactatattatggtaaagaaaagcgatgtgcgcgaactcgatatgagcgtggacgaascattgaaatatgtgatttcgctgggtatggtcatccctgacgacctgcccgtcaaaacattggcasgacctatgccgtctgaaaaggcggatttgcccgaacaacaataa

SEQ ID NO: 740 - protein, 233 aa, Neisseria meningitidis
  misc_feature (160)..(160): Xaa= any amino acid
  misc_feature (198)..(198): Xaa= any amino acid
  misc_feature (220)..(220): Xaa= any amino acid
MTVTAAEGGKAAKALKKYLITGILVWLPIAVTVWVVSYIVSASDQLVNLLPKQWRPQYVLGFNIPGLGVIVAIAVLFVTGLFAANVLGRQILAAWDSLLGRIPVVKSIYSSVKKVSEYVLSDSSRSFKTPVLVPFPQPGIWTIAFVSGQVSNAVKAALPXDGDYLSVYVPTTPNPTGGYYIMVKKSDVRELDMSVDEXLKYVISLGMVIPDDLPVKTLAXPMPSEKADLPEQQ

SEQ ID NO: 741 - DNA, 702 bp, Neisseria meningitidis
  misc_feature (11)..(11): N= Unknown
atgacggaacntgcggccgaaggcggcaaagctgccaargcgttaaaaaaatatctgattacgggcattttggtctggctgccgattgcggtaacggtttgggtggtttcctatatcgtttccgcgtccgatcagctcgtcaacctgctgccgaagcaatggcggccgcaatatgttttggggtttaatatcccggggctgggcgttatcgttgccattgccgtattgtttgtaaccggattgtttgccgccaacgtattgggtcggcagatcctcgccgcgtgggacagcctgttggggcggattccggttgtgaaatccatctattcgagtgtgaaaaaagtatccgaatcgctgctgtccgacagcagccgttcgtttaaaacgccggtactcgtgccgtttccccagcccggtatttggacgattgctttcgtgtcagggcaggtgtcgaatgcggttaaggccgcattgccgaaggacggcgattatctttccgtgtatgttccgaccacgccgaatccgaccggcggttactatattatggtaaagaaaagcgatgtgcgcgaactcgatatgagcgtggacgaagcattgaaatatgtgatttcgctgggtatggtcatccctgacgacctgcccgtcaaaacattggcaggacctatgccgtctgaaaaggcggatttgcccgaacaacaataa

SEQ ID NO: 742 - protein, 233 aa, Neisseria meningitidis
  misc_feature (4)..(4): Xaa= any amino acid
MTEXAAEGGKAAKALKKYLITGILVWLPIAVTVWVVSYIVSASDQLVNLLPKQWRPQYVLGFNIPGLGVIVAIAVLFVTGLFAANVLGRQILAAWDSLLGRIPVVKSIYSSVKKVSESLLSDSSRSFKTPVLVPFPQPGIWTIAFVSGQVSNAVKAALPKDGDYLSVYVPTTPNPTGGYYIMVKKSDVRELDMSVDEALKYVISLGMVIPDDLPVKTLAGPMPSEKADLPEQQ

SEQ ID NO: 743 - DNA, 702 bp, Neisseria meningitidis
  misc_feature (351)..(351): N= Unknown
atgacggaacctgcggccgaaggcggcaaagctgccaaggcgttaaaaaaatatctgattacgggcattttggtctggctgccgattgcggtaacggtttgggtggtttcctatatcgtttccgcgtccgatcagctcgtcaacctgctgccgaagcaatggcggccgcaatatgttttggggtttaatatcccggggctgggcgttatcgttgccattgccgtattgtttgtaaccggattatttgccgcaaacgtattgggccggcagattcttgccgcgtgggacagcttgttggggcggattccggttgtgaagtccatctattcgagtgtgaaaaaagtatccgantcgttgctgtccgacagcagccgttcgtttaaaacaccagtactcgtgccgtttccccaatcgggtatttggacaatcgcattcgtgtccggtcaggtgtcgaatgcggttaaggccgcattgccgaaggacggcgattatctttccgtgtatgttccgaccacgccgaatccgaccggcggttactatattatggtaaagaaaagcgatgtgcgcgaactcgatatgagcgtggacgaagcgttgaaatatgtgatttcgctgggtatggtcatccctgacgacctgcccgtcaaaacattggcaggacctatgccgtctgaaaaggcggatttgcccgaacaacaataa

SEQ ID NO: 744 - protein, 233 aa, Neisseria meningitidis
  misc_feature (117)..(117): Xaa= any amino acid
MTEPAAEGGKAAKALKKYLITGILVWLPIAVTVWVVSYIVSASDQLVNLLPKQWRPQYVLGFNIPGLGVIVAIAVLFVTGLFAANVLGRQILAAWDSLLGRIPVVKSIYSSVKKVSXSLLSDSSRSFKTPVLVPFPQSGIWTIAFVSGQVSNAVKAALPKDGDYLSVYVPTTPNPTGGYYIMVKKSDVRELDMSVDEALKYVISLGMVIPDDLPVKTLAGPMPSEKADLPEQQ

SEQ ID NO: 745 - DNA, 8 bp, Neisseria gonorrhoeae
  misc_feature (1)..(8): N = Unknown
nnnnnnnn

SEQ ID NO: 746 - protein, 233 aa, Neisseria gonorrhoeae
  misc_feature (100)..(100): Xaa= any amino acid
MTEPAAEGGKAAKALKKYLITGILVWLPIAVTVWVVSYIVSASDQLVNLLPKQWRPQYVLGFNIPGLGVIVAIAVLFVTGLFAANVLGRQILAAWDSLLXRIPVVKSIYSSVKKVSESLLSDSSRSFKTPVLVPFPQSGIWTIAFVSGQVSNAVKAALPQDGDYLSVYVPTTPNPTGGYYIMVKKSDVRELDMSVDEALKYVISLGMVIPDDLPVKTLAGPMPPEKAELPEQQ

SEQ ID NO: 747 - DNA, 702 bp, Neisseria gonorrhoeae
atgacggaacctgcggccgaaggcggcaaagctgccaaggcgttaaaaaaatatctgattacaggcattttggtctggctgccgattgcggtaacggtttgggtggtttcctatatcgtttccgcgtccgaccagcttgtcaacctgctgccgaagcaatggcggccgcaatatgttttggggtttaatatccccgggctcggcgttattgttgccattgccgtattgtttgtaaccggattatttgccgcaaacgtgttgggccggcagattcttgccgcgtgggacagcctgttggggcggattccggttgtcaaatccatctattcgagtgtgaaaaaagtatccgaatcgctgctgtccgacagcagccgttcgtttaaaacgccggtactcgtgccgtttccccaatcgggtatttggacaatcgcattcgtgtccggtcaggtgtcgaatgcggttaaggccgcattgccgcaggatggcgattatctttccgtgtatgtcccgaccacgcccaacccgaccggcggttactatattatggtaaagaaaagcgatgtgcgcgaactcgatatgagcgtggacgaagcgttgaaatatgtgatttcgctgggtatggtcatccctgacgacctgcccgtcaaaacattggcaggacctatgccgcctgaaaaggcggagttgcccgaacaacaataa

SEQ ID NO: 748 - protein, 233 aa, Neisseria gonorrhoeae
MTEPAAEGGKAAKALKKYLITGILVWLPIAVTVWVVSYIVSASDQLVNLLPKQWRPQYVLGFNIPGLGVIVAIAVLFVTGLFAANVLGRQILAAWDSLLGRIPVVKSIYSSVKKVSESLLSDSSRSFKTPVLVPFPQSGIWTIAFVSGQVSNAVKAALPQDGDYLSVYVPTTPNPTGGYYIMVKKSDVRELDMSVDEALKYVISLGMVIPDDLPVKTLAGPMPPEKAELPEQQ

SEQ ID NO: 749 - DNA, 1161 bp, Neisseria meningitidis
  misc_feature (235)..(235): N= Unknown
atgaaaacggtagtctggattgtcgtcctgtttgccgccgccgtcggactggcgctggcttcgggcatttacaccggcgacgtgtatatcgtactcggacagaccatgctcagaatcaacctgcacgcctttgtgttaggttcgctgattgccgtcgtggtgtggtatttcttgtttaaattcattatcggsggtactcaatatccccgaaaagatgcagcgtttcggttcggcncgtaaaggcckcaagsscgsgcttgccttgaacaaggcgggtttggcgtattttgaagggcgttttgaaaaggcggaactagaagcctcacgcgtgttggtcaacaaagtaggccgagagacaaccggactttggcattgatgctgrgcgcgcacgccgccggacagatggaaaacatcgasstgcgcgaccgttatcttgcggaaatcgccaaactgccggaaaaacagcagctttcccgttatcttttgttggcggaatcggcgttgaaccggcgcgattacgaagcggcggaagccaatcttcatgcggcggcgaagatgaatgccaaccttacgcgcctcgtgcgtctgcaattcgttacgctttcgacaggggcgacgcgttgcaggttctggcaaaaaccgaaaaactttccaaggcgggcgcgttgggcaaatcggaaatggaacggtatcaaaattgggcatatccgtcgccagctggcggatgctgccgatgccgccgctttgaaaacctgcctgaagcggattcccgacagcctcaaaaacggggaattgagcgtatcggttgcggaaaagtacgaacgtttgggactgtatgccgatgcggtcaaatgggtcaaacagcattatccgcasaaccgccgccccgagcttttggaagcctttgtcgaaagcgtgcgctttttgggcgagcgcgaacagcagaaagccatcgattttgccgatgcttggctgaaagaacagcccgataacgcgcttctgctgatgtatctcggtcggctcgccttcggccgcaaactttggggcaaggcaaaaggctaccttgaagcgagcattgcattaaagccgagtatttccgcgcgtttggttctaacaaaggttttcgacgaaatcggagaaccgcagaaggcggaggcgcac

SEQ ID NO: 750 - protein, 386 aa, Neisseria meningitidis
  misc_feature (82)..(82): Xaa= any amino acid
  misc_feature (84)..(85): Xaa= any amino acid
  misc_feature (127)..(127): Xaa= any amino acid
  misc_feature (138)..(139): Xaa= any amino acid
  misc_feature (196)..(196): Xaa= any amino acid
  misc_feature (291)..(291): Xaa= any amino acid
MKTVVWIVVLFAAAVGLALASGIYTGDVYIVLGQTMLRINLHAFVLGSLIAVVVWYFLFKFIIGVLNIPEKMQRFGSARKGXKXXLALNKAGLAYFEGRFEKAELEASRVLVNKVGRDNRTLALMLXAHAAGQMENIXXRDRYLAEIAKLPEKQQLSRYLLLAESALNRRDYEAAEANLHAAAKMNANLTRLVRLXIRYAFDRGDALQVLAKTEKLSKAGALGKSEMERYQNWAYRRQLADAADAAALKTCLKRIPDSLKNGELSVSVAEKYERLGLYADAVKWVKQHYPXNRRPELLEAFVESVRFLGEREQQKAIDFADAWLKEQPDNALLLMYLGRLAFGRKLWGKAKGYLEASIALKPSISARLVLTKVFDEIGEPQKAEAH

SEQ ID NO: 751 - DNA, 1224 bp, Neisseria meningitidis
atgaaaacggtagtctggattgtcgtcctgtttgccgccgccgtcggactggcgctggcttcgggcatttacaccggcgacgtgtatatcgtactcggacagaccatgctcagaatcaacctgcacgcctttgtgttaggttcgctgattgccgtcgtggtgtggtatttcttgtttaaattcattatcggcgtactcaatatccccgaaaagatgcagcgtttcggttcggcgcgtaaaggccgcaaggccgcgcttgccttgaacaaggcgggtttggcgtattttgaagggcgttttgaaaaggcggaactagaagcctcacgcgtgttggtcaacaaagaggccggagacaaccggactttggcattgatgctgggcgcgcacgccgccggacagatggaaaacatcgagctgcgcgaccgttatcttgcggaaatcgccaaactgccggaaaaacagcagctttcccgttatcttttgttggcggaatcggcgttgaaccggcgcgattacgaagcggcggaagccaatcttcatgcggcggcgaagatgaatgccaaccttacgcgcctcgtgcgtctgcaacttcgttacgctttcgacaggggcgacgcgttgcaggttctggcaaaaaccgaaaaactttccaaggcgggcgcgttgggcaaatcggaaatggaacggtatcaaaattgggcataccgccgccagctggcggatgctgccgatgccgccgctttgaaaacctgcctgaagcggattcccgacagcctcaaaaacggggaattgagcgtatcggttgcggaaaagtacgaacgtttgggactgtatgccgatgcggtcaaatgggtcaaacagcattatccgcacaaccgccgccccgagcttttggaagcctttgtcgaaagcgtgcgctttttgggcgagcgcgaacagcagaaagccatcgattttgccgatgcttggctgaaagaacagcccgataacgcgcttctgctgatgtatctcggtcggctcgcctacggccgcaaactttggggcaaggcaaaaggctaccttgaagcgagcattgcattaaagccgagtatttccgcgcgtttggttctagcaaaggttttcgacgaaatcggagaaccgcagaaggcggaggcgcagcgcaacttggttttggaagccgtctccgatgacgaacgtcacgcagcgttagagcagcatagctga

SEQ ID NO: 752 - protein, 407 aa, Neisseria meningitidis
MKTVVWIVVLFAAAVGLALASGIYTGDVYIVLGQTMLRINLHAFVLGSLIAVVVWYFLFKFIIGVLNIPEKMQRFGSARKGRKAALALNKAGLAYFEGRFEKAELEASRVLVNKEAGDNRTLALMLGAHAAGQMENIELRDRYLAEIAKLPEKQQLSRYLLLAESALNRRDYEAAEANLHAAAKMNANLTRLVRLQLRYAFDRGDALQVLAKTEKLSKAGALGKSEMERYQNWAYRRQLADAADAAALKTCLKRIPDSLKNGELSVSVAEKYERLGLYADAVKWVKQHYPHNRRPELLEAFVESVRFLGEREQQKAIDFADAWLKEQPDNALLLMYLGRLAYGRKLWGKAKGYLEASIALKPSISARLVLAKVFDEIGEPQKAEAQRNLVLEAVSDDERHAALEQHS

SEQ ID NO: 753 - DNA, 1218 bp, Neisseria meningitidis
  misc_feature (42)..(43): N= Unknown
  misc_feature (70)..(70): N= Unknown
  misc_feature (203)..(203): N= Unknown
  misc_feature (646)..(646): N= Unknown
  misc_feature (665)..(665): N= Unknown
  misc_feature (718)..(718): N= Unknown
  misc_feature (900)..(900): N= Unknown
  misc_feature (1004)..(1004): N= Unknown
  misc_feature (1197)..(1197): N= Unknown
atgaaaacggtagtctggattgtcgtcctgtttgccgccgcnntcgggctggcattggcgtcgggcattnacaccggcgacgtgtatatcgtactcggacagaccatgctcagaatcaacctgcacgcctttgtgttaggttcgctgattgccgtcgtggtgtggtatttcctgttcaaattcatcatcggcgtactcaatanccccgaaaagatgcagcgtttcggttcggcgcgtaaaggccgcaaggccgcgcttgctttgaacaaggcgggtttggcgtattttgaagggcgttttgaaaaggcggaacttgaagcctcgcgcgtattgggaaacaaagaggcgggggataaccggactttggcattgatgttgggcgcacatgccgccgggcagatggaaaacatcgagctgcgcgaccgttatcttgcggaaatcgccaaactgccggaaaagcagcagctttcccgttatcttttgttggcggaatcggcgttgaaccggcgcgattacgaagcggcggaagccaatcttcatgcggcggcgaagatgaatgccaaccttacgcgcctcgtgcgtctgcaacttcgttacgctttcgacaggggcgacgcgttgcaggttctggcaaaaaccgaaaaantttccaaggcgggcgcgtngggcaaatcggaaatggaacggtatcaaaattgggcataccgccgccagctgncggatgctgccgatgccgccgctttgaaaacctgcctgaagcggattcccgacagcctcaaaaacggggaattgagcgtatcggttgcggaaaagtacgaacgtttgggactgtatgccgatgcggtcaaatgggtcaaacagcattatccgcacaaccgccgacccgaacttttggaagcntttgtcgaaagcgtgcgctttttgggcgaacgcgatcagcagaaagccatcgattttgccgatgcttggctgaaagaacagcccgataatgcgcttctgctgangtatctcggtcggctcgcctacggccgcaaactttggggcaaggcaaaaggctaccttgaagcgagcattgcattaaagccgagtatttccgcgcgtttggttctggcaaaggtttttgacgaaaccggagaaccgcagaaggcggaggcgcagcgcaacttggttttggcaagcgttgccgaggaaaaccgnccttccgccgaaacccattga

SEQ ID NO: 754 - protein, 405 aa, Neisseria meningitidis
  misc_feature (15)..(15): Xaa= any amino acid
  misc_feature (24)..(24): Xaa= any amino acid
  misc_feature (68)..(68): Xaa= any amino acid
  misc_feature (216)..(216): Xaa= any amino acid
  misc_feature (222)..(222): Xaa= any amino acid
  misc_feature (240)..(240): Xaa= any amino acid
  misc_feature (335)..(335): Xaa= any amino acid
MKTVVWIVVLFAAAXGLALASGIXTGDVYIVLGQTMLRINLHAFVLGSLIAVVVWYFLFKFIIGVLNXPEKMQRFGSARKGRKAALALNKAGLAYFEGRFEKAELEASRVLGNKEAGDNRTLALMLGAHAAGQMENIELRDRYLAEIAKLPEKQQLSRYLLLAESALNRRDYEAAEANLHAAAKMNANLTRLVRLQLRYAFDRGDALQVLAKTEKXSKAGAXGKSEMERYQNWAYRRQLXDAADAAALKTCLKRIPDSLKNGELSVSVAEKYERLGLYADAVKWVKQHYPHNRRPELLEAFVESVRFLGERDQQKAIDFADAWLKEQPDNALLLXYLGRLAYGRKLWGKAKGYLEASIALKPSISARLVLAKVFDETGEPQKAEAQRNLVLASVAEENRPSAETH

SEQ ID NO: 755 - DNA, 1218 bp, Neisseria gonorrhoeae
atgaaaacggtagtctggattgttgtcctgtttgccgccgccgtcggactggcgctggcttcgggcatttacaccggcgacgtgtatatcgtactcggacagaccatgctcagaatcaacctgcacgcctttgtgttaggttcgctgattgccgtcgtggtgtggtatttcctgtttaaattcatcatcggcgtactcaatatccccgaaaatatgcggcgttccggttcggcgcggaaaggccgcaaggccgcgcttgccttgaataaggcgggtttggcgtatttcgaagggcgttttgaaaaggcggaactcgaagcctctcgagtgttgggcaacaaagaggccggagacaaccggactttggcattgatgctgggcgcgcacgcggcaggacagatggaaaatatcgagctgcgcgaccgttatcttgcggaaatcgccaaactgccggaaaaacagcagctttcccgctatcttctgctggcggaatcggcgttaaaccggcgcgattacgaagcggcggaagccaatcttcatgcggcggcgaagatgaatgccaaccttacgcgcctcgtgcgtctgcaacttcgttacgccttcgatcggggcgatgcgttgcaggttctggcaaaaaccgaaaaactttccaaggcgggcgcgttgggcaaatcggaaatggaacggtatcaaaattgggcataccgccgccagatggcggatgctgccgatgccgccgctttgaaaacctgcctgaagcggattcccgacagcctcaaaaacggggaattgagcgtatcggttgcggaaaagtacgaacgtttgggactgtatgccgatgcggtcaaatgggtcaaacagcattatccgcacaaccgccgccccgagcttttggaagcctttgtcgaaagcgtgcgctttttgggcgagcgcgaacagcagaaagccatcgattttgccgattcttggctgaaagaacagcccgataacgcgcttctgctgatgtatctcggccggctcgcctacggccgcaaactttggggtaaggcaaaaggctaccttgaagcgagtattgcactgaagccgagtattccggcgcgtttggtgttggcaaaggtttttgacgaaaccgcacagtcgcaaaaagccgaagcacagcgcaacttggttttggcaagcgttgccggggaaaaccgcccttccgccgaaacccgttga

SEQ ID NO: 756 - protein, 405 aa, Neisseria gonorrhoeae
MKTVVWIVVLFAAAVGLALASGIYTGDVYIVLGQTMLRINLHAFVLGSLIAVVVWYFLFKFIIGVLNIPENMRRSGSARKGRKAALALNKAGLAYFEGRFEKAELEASRVLGNKEAGDNRTLALMLGAHAAGQMENIELRDRYLAEIAKLPEKQQLSRYLLLAESALNRRDYEAAEANLHAAAKMNANLTRLVRLQLRYAFDRGDALQVLAKTEKLSKAGALGKSEMERYQNWAYRRQMADAADAAALKTCLKRIPDSLKNGELSVSVAEKYERLGLYADAVKWVKQHYPHNRRPELLEAFVESVRFLGEREQQKAIDFADSWLKEQPDNALLLMYLGRLAYGRKLWGKAKGYLEASIALKPSIPARLVLAKVFDETAQSQKAEAQRNLVLASVAGENRPSAETR

SEQ ID NO: 757 - DNA, 429 bp, Neisseria meningitidis
atgatgttttcttggttcaagctgtttcacttgttttttgtcatttcgtggtttgcagggctgttttacctgccgaggattttcgtcaatatggcgatgattgatgtgccgcgcggcaatcccgagtatgtgcgtctgtcgggcatggcggtgcggctgtaccgttttatgtcgccgttgggcttcggcgcggtcgtgttcggcgcggcgataccgtttgccgccggctggtggggcagcggctgggtacacgtcaaactgtgtttgggcttgatgctcttggcttaccagttgtattgcggcgtgctgctgcgccgttttcaggattacagcaatgctttttcacaccgctggtaccgcgtgttcaacgaaatccccgtgctgctgatggttgccgcgctgtatstggtcgtgttcaaaccgttttga

SEQ ID NO: 758 - protein, 142 aa, Neisseria meningitidis
  misc_feature (136)..(136): Xaa= any amino acid
MMFSWFKLFHLFFVISWFAGLFYLPRIFVNMAMIDVPRGNPEYVRLSGMAVRLYRFMSPLGFGAVVFGAAIPFAAGWWGSGWVHVKLCLGLMLLAYQLYCGVLLRRFQDYSNAFSHRWYRVFNEIPVLLMVAALYXVVFKPF

SEQ ID NO: 759 - DNA, 429 bp, Neisseria meningitidis
atgatgttttcttggttcaagctgtttcacttgttttttgtcatttcgtggtttgcagggctgttttacctgccgaggattttcgtcaatatggcgatgattgatgtgccgcgcggcaatcccgagtatgtgcgtctgtcgggcatggcggtgcggctgtaccgttttatgtcgccgttgggcttcggcgcggtcgtgttcggcgcggcgataccgtttgccgccggctggtggggcagcggctgggtacacgtcaaactgtgtttgggcttgatgctcttggcttaccagttgtattgcggcgtgctgctgcgccgttttcaggattacagcaatgctttttcacaccgctggtaccgcgtgttcaacgaaatccccgtgctgctgatggttgccgcgctgtatctggtcgtgttcaaaccgttttga

SEQ ID NO: 760 - protein, 142 aa, Neisseria meningitidis
MMFSWFKLFHLFFVISWFAGLFYLPRIFVNMAMIDVPRGNPEYVRLSGMAVRLYRFMSPLGFGAVVFGAAIPFAAGWWGSGWVHVKLCLGLMLLAYQLYCGVLLRRFQDYSNAFSHRWYRVFNEIPVLLMVAALYLVVFKPF

SEQ ID NO: 761 - DNA, 429 bp, Neisseria meningitidis; identical to SEQ ID NO: 759

SEQ ID NO: 762 - protein, 142 aa, Neisseria meningitidis; identical to SEQ ID NO: 760

SEQ ID NO: 763 - DNA, 429 bp, Neisseria gonorrhoeae
atgatgttttcttggttcaagctgtttcacttgttttttgtcatttcgtggtttgcagggctgttttacctgccgaggattttcgtcaatatggcgatgattgatgcgccgcgcggcaatcccgagtatgtgcgcctgtcggggatggcggtgcggttgtaccgttttatgtcgcctttgggtttcggcgcggtcgtgttcggcgcggcgataccgtttgccgccggccggtggggcagcggctgggttcacgtcaaactgtgtttgggcttgatgctcttggcttatcagttgtattgcggcgtgctgctgcgccgttttcaggattacagcaatgctttttcacaccgctggtaccgcgtgttcaacgaaatccccgtgctgctgatggttgccgcgctgtatctggtcgtgttcaaaccgttttga

SEQ ID NO: 764 - protein, 142 aa, Neisseria gonorrhoeae
MMFSWFKLFHLFFVISWFAGLFYLPRIFVNMAMIDAPRGNPEYVRLSGMAVRLYRFMSPLGFGAVVFGAAIPFAAGRWGSGWVHVKLCLGLMLLAYQLYCGVLLRRFQDYSNAFSHRWYRVFNEIPVLLMVAALYLVVFKPF

SEQ ID NO: 765 - DNA, 592 bp, Artificial Sequence
  Novel Sequence
  misc_feature (24)..(30): N= Unknown
atggcaaaaatgatgaaatgggcnnnnnnnggctgttgcggcggtcgcggcggcagcggtttggggcggatggtcttaactgaagcccgagccgcacgtgcttgatattacggaaacggtcaggcgcggcatttcgtttacgattttgtccgaaccggatacgccgattaaggcgaagctcgacagcgtcgaccccgggctgaccacgatgtcgtcgggcggttacaacagcagtacggatacggcttccaatgcggtctactattatgcccgttcgtttgtgccgaatccggacggcaaactcgccacggggatgacgacgcagaatacggttgaaatcgacggcgtgaaaaatgtgctgattattccgtcgctgaccgtgaaaaatcgcggcggcaaggcgtttgtgcgcgtgttgggtgcggacggcaaggcggcggaacgcgaaatccggaccggtatgagagacagtatgaataccgaagtaaaaagcgggttgaaagagggggacaaagtggtcatctccgaaataaccgccgccgagcaacaggaaagcggcgaacgcgccctaggcggcccgccgcgccgataa

SEQ ID NO: 766 - protein, 392 aa, Neisseria meningitidis
  misc_feature (24)..(24): Xaa= any amino acid
  misc_feature (42)..(239): Xaa= any amino acid
MAKMMKWAAVAAVAAAAVWGGWSXLKPEPHVLDITETVRRGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXISFTILSEPDTPIKAKLDSVDPGLTTMSSGGYNSSTDTASNAVYYYARSFVPNPDGKLATGMTTQNTVEIDGVKNVLIIPSLTVKNRGGKAFVRVLGADGKAAEREIRTGMRDSMNTEVKSGLKEGDKVVISEITAAEQQESGERALGGPPRR

SEQ ID NO: 767 - DNA, 1005 bp, Neisseria meningitidis
gtatcggtcggcgcgcaggcatcggggcagattaagatactttatgtcaaactcgggcaacaggttaaaaagggcgatttgattgcggaaatcaattcgacctcgcagaccaatacgctcaatacggaaaaatccaagttggaaacgtatcaggcgaagctggtgtcggcacagattgcattgggcagcgcggagaagaaatataagcgtcaggcggcgttatggaaggaaaacgcgacttccaaagaggatttggaaagcgcgcaggatgcgtttgccgccgccaaagccaatgttgccgagctgaaggctttaatcagacagagcaaaatttccatcaataccgccgagtcggaattgggctacacgcgcattaccgcaacgatggacggcacggtggtggcgattctcgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggttacaacagcagtacggatacggcttccaatgcggtctactattatgcccgttcgtttgtgccgaatccggacggcaaactcgccacggggatgacgacgcagaatacggttgaaatcgacggcgtgaaaaatgtgctgattattccgtcgctgaccgtgaaaaatcgcggcggcaaggcgtttgtgcgcgtgttgggtgcggacggcaaggcggcggaacgcgaaatccggaccggtatgagagacagtatgaataccgaagtaaaaagcgggttgaaagagggggacaaagtggtcatctccgaaataaccgccgccgagcaacaggaaagcggcgaacgcgccctaggcggcccgccgcgccgataa

SEQ ID NO: 768 - protein, 334 aa, Neisseria meningitidis
VSVGAQASGQIKILYVKLGQQVKKGDLIAEINSTSQTNTLNTEKSKLETYQAKLVSAQIALGSAEKKYKRQAALWKENATSKEDLESAQDAFAAAKANVAELKALIRQSKISINTAESELGYTRITATMDGTVVAILVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLIIPSLTVKNRGGKAFVRVLGADGKAAEREIRTGMRDSMNTEVKSGLKEGDKVVISEITAAEQQESGERALGGPPRR

SEQ ID NO: 769 - DNA, 1179 bp, Neisseria meningitidis
atggcaaaaatgatgaaatgggcggctgttgcggcggtcgcggcggcagcggtttggggcggatggtcttatctgaagcccgagccgcaggctgcttatattacggaaacggtcaggcgcggcgacatcagccggacggtttctgcaacaggggagatttcgccgtccaacctggtatcggtcggcgcgcaggcatcggggcagattaagaaactttatgtcaaactcgggcaacaggttaaaaagggcgatttgattgcggaaatcaattcgacctcgcagaccaatacgctcaatacggaaaaatccaaattggaaacgtatcaggcgaagctggtgtcggcacagattgcattgggcagcgcggagaagaaatataagcgtcaggcggcgttgtggaaggatgatgcgaccgctaaagaagatttggaaagcgcacaggatgcgcttgccgccgccaaagccaatgttgccgagctgaaggctctaatcagacagagcaaaatttccatcaataccgccgagtcggaattgggctacacgcgcattaccgcaacgatggacggcacggtggtggcgattctcgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggctacaacagcagtacggatacggcttccaatgcggtctactattatgcccgttcgtttgtgccgaatccggacggcaaactcgccacggggatgacgacgcagaatacggttgaaatcgacggtgtgaaaaatgtgctgattattccgtcgctgaccgtgaaaaatcgcggcggcagggcgtttgtgcgcgtgttgggtgcagacggcaaggcggcggaacgcgaaatccggaccggtatgagagacagtatgaataccgaagtaaaaagcgggttgaaagagggggacaaagtggtcatctccgaaataaccgccgccgagcagcaggaaagcggcgaacgcgccctaggcggcccgccgcgccgataa

SEQ ID NO: 770 - protein, 392 aa, Neisseria meningitidis
MAKMMKWAAVAAVAAAAVWGGWSYLKPEPQAAYITETVRRGDISRTVSATGEISPSNLVSVGAQASGQIKKLYVKLGQQVKKGDLIAEINSTSQTNTLNTEKSKLETYQAKLVSAQIALGSAEKKYKRQAALWKDDATAKEDLESAQDALAAAKANVAELKALIRQSKISINTAESELGYTRITATMDGTVVAILVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLIIPSLTVKNRGGRAFVRVLGADGKAAEREIRTGMRDSMNTEVKSGLKEGDKVVISEITAAEQQESGERALGGPPRR

SEQ ID NO: 771 - DNA, 1179 bp, Neisseria gonorrhoeae
atggcaaaaatgatgaaatgggcggctgttgcggcggtcgcggcggcaacggtttggggcggatggtcttatctgaagcccgaaccgcaggctgcttatattacggaaacggtcaggcgcggcgatatcagccggacggtttccgcgacgggcgagatttcgccgtccaacctggtatcggtcggcgcgcaggcttcggggcagattaaaaagctttatgtcaaactcgggcaacaggtcaaaaagggcgatttgattgcggaaatcaattcgaccacgcagaccaacacgatcgatatggaaaaatccaaattggaaacgtatcaggcgaagctggtgtcggcacagattgcattgggcagcgcggagaagaaatataagcgtcaggcggcgttgtggaaggatgatgcgacctctaaagaagatttggaaagcgcgcaggatgcgcttgccgccgccaaagccaatgttgccgagttgaaggctttaatcagacagagcaaaatttccatcaataccgccgagtcggatttgggctacacgcgcattaccgcgacgatggacggcacggtggtggcgattcccgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggctacaacagcagtacggatacggcttccaatgcggtctattattatgcccgttcgtttgtgccgaatccggacggcaaactcgccacggggatgacgacgcagaatacggttgaaatcgacggtgtgaaaaatgtgttgcttattccgtcgctgaccgtgaaaaatcgcggcggcaaggcgttcgtacgcgtgttgggtgcggacggcaaggcagtggaacgcgaaatccggaccggtatgaaagacagtatgaataccgaagtgaaaagcgggttgaaagagggggacaaagtggtcatctccgaaataaccgccgccgagcagcaggaaagcggcgaacgcgccctaggcggcccgccgcgccgataa

SEQ ID NO: 772 - protein, 392 aa, Neisseria gonorrhoeae
MAKMMKWAAVAAVAAAAVWGGWSYLKPEPQAAYITEAVRRGDISRTVSATGEISPSNLVSVGAQASGQIKKLYVKLGQQVKKGDLIAEINSTTQTNTIDMEKSKLETYQAKLVSAQIALGSAEKKYKRQAALWKDDATSKEDLESAQDALAAAKANVAELKALIRQSKISINTAESDLGYTRITATMDGTVVAIPVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLLIPSLTVKNRGGKAFVRVLGADGKAVEREIRTGMKDSMNTEVKSGLKEGDKVVISEITAAEQQESGERALGGPPRR

SEQ ID NO: 773 - DNA, 555 bp, Neisseria meningitidis
attcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacttacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccgtaa

SEQ ID NO: 774 - protein, 184 aa, Neisseria meningitidis
IPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 775 - DNA, 672 bp, Neisseria meningitidis
atgatgaagacttttaaaaatatattttccgccgccattttgtccgccgccctgccgtgcgcgtatgcggcagggctgccccaatccgccgtgctgcactattccggcagctacggcattcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacttacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccgtaa

SEQ ID NO: 776 - protein, 223 aa, Neisseria meningitidis
MMKTFKNIFSAAILSAALPCAYAAGLPQSAVLHYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 777 - DNA, 672 bp, Neisseria meningitidis
  misc_feature (82)..(82): N= Unknown
  misc_feature (129)..(129): N= Unknown
  misc_feature (131)..(132): N= Unknown
  misc_feature (134)..(135): N= Unknown
  misc_feature (137)..(138): N= Unknown
  misc_feature (140)..(140): N= Unknown
  misc_feature (143)..(145): N= Unknown
  misc_feature (147)..(147): N= Unknown
  misc_feature (149)..(149): N= Unknown
  misc_feature (158)..(158): N= Unknown
  misc_feature (326)..(330): N= Unknown
  misc_feature (332)..(332): N= Unknown
  misc_feature (334)..(339): N= Unknown
  misc_feature (341)..(341): N= Unknown
  misc_feature (378)..(378): N= Unknown
atgatgaagacttttaaaaatatattttccgccgccattttgtccgccgccctgccgtgcgcgtatgcggcagggctgcccnaatccgccgtgctgcactattccggcagctacggcattcccgccacnannanntnngnacnnngngncaatgcttncaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacctacggcaaagcggnnnnnancnnnnnngngcaaagccccaaggctatggatttgttcacgcttgcntggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccgtaa

SEQ ID NO: 778 - protein, 223 aa, Neisseria meningitidis
  misc_feature (28)..(28): Xaa= any amino acid
  misc_feature (44)..(50): Xaa= any amino acid
  misc_feature (53)..(53): Xaa= any amino acid
  misc_feature (109)..(114): Xaa= any amino acid
MMKTFKNIFSAAILSAALPCAYAAGLPXSAVLHYSGSYGIPATXXXXXXXNAXKIVSTIKVPLYNIRFESGGTVVGNTLHPTYYRDIRRGKLYAEAKFADGSVTYGKAXXXXXXQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 779 - DNA, 672 bp, Neisseria gonorrhoeae
atgatgaagacttttaaaaatatattttccgccgccattttgtccgccgccctgccgtgcgcgtatgcggcaaggctaccccaatccgccgtgctgcactattccggcagctacggcattcccgccacgatgacatttgaacgcagcggcaatgcttacaaaatcgtttcgacgattaaagtgccgctatacaatatccgtttcgaatccggcggtacggttgtcggcaataccctgcaccctgcctactataaagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccgggtctgaaaatcaccaacggcaaaaaactttattccgtcggcggcctgaataaggcgggtacgggaaaatacagcataggcggcgtggaaaccgaagtcgtcaaatatcgggtgcggcgcggcgacgatacggtaacgtatttcttcgcaccgtccctgaacaatattccggcacaaatcggctataccgacgacggcaaaacctatacgctgaagctcaaatcggtgcagatcaacggacaggccgccaaaccgtaa

SEQ ID NO: 780 - protein, 223 aa, Neisseria gonorrhoeae
MMKTFKNIFSAAILSAALPCAYAARLPQSAVLHYSGSYGIPATMTFERSGNAYKIVSTIKVPLYNIRFESGGTVVGNTLHPAYYKDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDTVTYFFAPSLNNIPAQIGYTDDGKTYTLKLKSVQINGQAAKP

SEQ ID NO: 781 - DNA, 468 bp, Neisseria meningitidis
  misc_feature (51)..(51): N= Unknown
atgtatcggaggaaagggcggggcatcaagccgtggatgggtgccggtgcngcgtttgccgccttggtctggctggttttcgcgctcggcgatactttgactccgtttgcggttgcggcggtgctggcgtatgtattggaccctttggtcgaatggttgcagaaaaagggtttgaaccgtgcatccgcttcgatgtctgtgatggtgttttccttgattttgttgttggcattattgttgattatcgtccctatgctggtcgggcagttcaacaatttggcatcgcgcctgccccaattaatcggttttatgcagaacacgctgctgccgtggttgaaaaatacaatcggcggatatgtggaaatcgatcaggcatctattattgcgtggcttcaggcgcatacgggagagttgagcaacgcgcttaaggcgtggtttcccgttttgatgaggcagggcggcaatatt

SEQ ID NO: 782 - protein, 156 aa, Neisseria meningitidis
  misc_feature (17)..(17): Xaa= any amino acid
MYRRKGRGIKPWMGAGXAFAALVWLVFALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWLQAHTGELSNALKAWFPVLMRQGGNI

SEQ ID NO: 783 - DNA, 1071 bp, Neisseria meningitidis
atgtatcggaggaaagggcggggcatcaagccgtggatgggtgccggtgcggcgtttgccgccttggtctggctggttttcgcgctcggcgatactttgactccgtttgcggttgcggcggtgctggcgtatgtattggaccctttggtcgaatggttgcagaaaaagggtttgaaccgtgcatccgcttcgatgtctgtgatggtgttttccttgattttgttgttggcattattgttgattatcgtccctatgctggtcgggcagttcaacaatttggcatcgcgcctgccccaattaatcggttttatgcagaacacgctgctgccgtggttgaaaaatacaatcggcggatatgtggaaatcgatcaggcatctattattgcgtggcttcaggcgcatacgggagagttgagcaacgcgcttaaggcgtggtttcccgttttgatgaggcagggcggcaatattgtcagcagtatcggcaacctgctgctgcttcccttgctgctttactatttcctgctggattggcagcggtggtcgtgcggcattgccaaactggttccgaggcgttttgccggtgcttatacgcgcattacaggcaatttgaacgaggtattgggcgaatttttgcgcgggcagcttctggtaatgctgattatgggcttggtttacggtttgggattggtgctggtcgggctggattcggggtttgccatcggtatgcttgccggtattttggtgtttgtcccttatctcggggcgtttacgggattgctgcttgccaccgtcgccgccttgctccagttcggttcgtggaacggcatcctatcggtttgggcggtttttgccgtaggacagtttctcgaaagttttttcattacgccgaaaatcgtgggagaccgtatcgggctgtcgccgttttgggttatcttttcgctgatggcgttcgggcagctgatgggctttgtcggaatgttggcgggattgcctttggccgccgtaaccttggtcttgcttcgcgagggcgtgcagaaatattttgccggcagtttttaccggggcaggtag

SEQ ID NO: 784 - protein, 356 aa, Neisseria meningitidis
MYRRKGRGIKPWMGAGAAFAALVWLVFALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWLQAHTGELSNALKAWFPVLMRQGGNIVSSIGNLLLLPLLLYYFLLDWQRWSCGIAKLVPRRFAGAYTRITGNLNEVLGEFLRGQLLVMLIMGLVYGLGLVLVGLDSGFAIGMLAGILVFVPYLGAFTGLLLATVAALLQFGSWNGILSVWAVFAVGQFLESFFITPKIVGDRIGLSPFWVIFSLMAFGQLMGFVGMLAGLPLAAVTLVLLREGVQKYFAGSFYRGR

SEQ ID NO: 785 - DNA, 1071 bp, Neisseria meningitidis
atgtatcggaggaaagggcggggcatcaagccgtggatggatgccggtgcggcgtttgccgccttggtctggctggttttcgcgctcggcgatactttgactccgtttgcggttgcggcggtgctggcgtatgtattggaccctttggtcgaatggttgcagaaaaagggtttgaaccgtgcatccgcttcgatgtctgtgatggtgttttccttgattttgttgttggcattattgttgattattgtccctatgctggtcgggcagttcaacaatttggcatcgcgcctgccccaattaatcggttttatgcagaacacgctgctgccgtggttgaaaaatacaatcggcggatatgtggaaatcgatcaggcatctattattgcgtggcttcaggcgcatacgggcgagttgagcaacgcgcttaaggcgtggtttcccgttttgatgaggcagggcggcaatattgtcagcagtatcggcaacctgctgctgcttcccttgctgctttactatttcctgctggattggcagcggtggtcgtgcggcattgccaaactggttccgaggcgttttgccggtgcttatacgcgcattacaggcaatttgaacgaggtattgggcgaatttttgcgcgggcagcttctggtgatgctgattatgggtttggtttacggcttggggttggtgctggtcgggctggattcggggtttgcaatcggtatggttgccggtattttggtttttgttccctatttgggcgcgtttacaggactgctgctggcaaccgtcgccgccttgctccagttcggttcgtggaacggcatcttggctgtttgggcggtttttgccgtaggacagtttctcgaaagttttttcattacgccgaaaatcgtgggagaccgtatcggcctgtcgccgttttgggttatcttttcgctgatggcgttcgggcagctgatgggctttgtcggaatgttggccggattgcctttggccgccgtaaccttggtcttgcttcgcgagggcgtgcagaaatattttgccggcagtttttaccggggcaggtag

SEQ ID NO: 786 - protein, 356 aa, Neisseria meningitidis
MYRRKGRGIKPWMDAGAAFAALVWLVFALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWLQAHTGELSNALKAWFPVLMRQGGNIVSSIGNLLLLPLLLYYFLLDWQRWSCGIAKLVPRRFAGAYTRITGNLNEVLGEFLRGQLLVMLIMGLVYGLGLVLVGLDSGFAIGMVAGILVFVPYLGAFTGLLLATVAALLQFGSWNGILAVWAVFAVGQFLESFFITPKIVGDRIGLSPFWVIFSLMAFGQLMGFVGMLAGLPLAAVTLVLLREGVQKYFAGSFYRGR

SEQ ID NO: 787 - DNA, 8 bp, Neisseria gonorrhoeae
  misc_feature (1)..(8): N = Unknown
nnnnnnnn

SEQ ID NO: 788 - protein, 253 aa, Neisseria gonorrhoeae
MYRRKGRGIKPWMGAGAAFAALVWLVYALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWFQAHTGELSNALKAWFPVLMKQGGNIVSTIGNLLLPPLLLYYFLLDWHRWSCGIPKLVPRRFAGAYTRITGNLNKVWGKFLRGQLLGETERGAVVCRVGRECWEGGGARSRPSDDGWPRWGGG

SEQ ID NO: 789 - DNA, 1071 bp, Neisseria gonorrhoeae
atgtatcggagaaaaggacggggcatcaagccgtggatgggtgccggcgcggcgtttgccgccttggtctggctggtttacgcgctcggcgatactttgactccgtttgcggttgcggcggtgctggcgtatgtgttggaccctttggtcgaatggttgcagaaaaagggtttgaaccgtgcatccgcttcgatgtctgtgatggtgttttccttgattttgttgttggcattattgttgattattgtccctatgctggtcgggcagttcaataatttggcatctcgcctgccccaattaatcggttttatgcagaacacgctgctgccgtggttgaaaaatacaatcggcggatatgtggaaatcgatcaggcatctattattgcgtggtttcaggcgcatacgggcgagttgagcaacgcgcttaaggcgtggtttcccgttttgatgaaacagggcggcaatattgtcagcagtatcggcaacctgctgctgccgcccttgctgctttactatttcctgctggattggcagcggtggtcgtgcggcatcgccaaactggttccgaggcgttttgccggtgcttatacgcgcattacgggtaatttgaacgaggtattgggcgaatttttgcgcggtcagcttctggtgatgctgattatgggcttggtttacggtttgggattgatgctagtcggactggattcgggatttgccatcggtatggttgccggtattttggtgtttgtcccctatttgggtgcgtttacgggattgctgcttgccactgttgcagccttgctccagttcggttcgtggaacggaatcttggctgtttgggcggtttttgccgtcggtcagtttctcgaaagttttttcattacgccgaaaattgtaggagaccgtatcggcctgtcgccgttttgggttatcttttcgctgatggcgttcggagagctgatgggctttgtcggaatgttggccggattgcctttggccgccgtaaccttggtcttgcttcgcgagggcgcgcagaaatattttgccggcagtttttaccggggcaggtag

SEQ ID NO: 790 - protein, 356 aa, Neisseria gonorrhoeae
MYRRKGRGIKPWMGAGAAFAALVWLVYALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWFQAHTGELSNALKAWFPVLMKQGGNIVSSIGNLLLPPLLLYYFLLDWQRWSCGIAKLVPRRFAGAYTRITGNLNEVLGEFLRGQLLVMLIMGLVYGLGLMLVGLDSGFAIGMVAGILVFVPYLGAFTGLLLATVAALLQFGSWNGILAVWAVFAVGQFLESFFITPKIVGDRIGLSPFWVIFSLMAFGELMGFVGMLAGLPLAAVTLVLLREGAQKYFAGSFYRGR

SEQ ID NO: 791 - DNA, 546 bp, Neisseria meningitidis
actgctttttcggcggcgctgcgcttgagtccatcatgactcgtcatatttttgtcctttgggaaaccgtatcaacaaacagccgccatcttaacatttttttgcacgtcctgcccgccgcgttcaaatgcgtaccagcaataccgccgcctgcgcctctatgccttccatccgcccgagatagccgagtttttcgttggttttgcctttgatgttgacgcacgaaatgtctatgcccaaatcggcggcgatgttggcacgcatttgcggaatgtgcggcgcgagtgtgggtttctgtgcaatcacggtcgtatcgacattgaccgcctgccaaccctgcgcctgaacgctttgatacgccgcacgcaaaaggacgcggctgtccgcatctttgaactctgcggcggtgtcggggaaatggctgccgatatcgcccaaacctgccgcaccgagcagcgcgtcggtaacggcgtgcagcagcgcatcggcatcggagtgtccgagcagccctttttcaaatgggatttcaactccgccaagtatcag

SEQ ID NO: 792 - protein, 182 aa, Neisseria meningitidis
  misc_feature (13)..(13): Xaa= any amino acid
TAFSAALRLSPSXLVIFLSFGKPYQQTAAILTFFCTSCPPRSNAYQQYRRLRLYAFHPPEIAEFFVGFAFDVDARNVYAQIGGDVGTHLRNVRRECGFLCNHGRIDIDRLPTLRLNALIRRTQKDAAVRIFELCGGVGEMAADIAQTCRTEQRVGNGVQQRIGIGVSEQPFFKWDFNSAKYQ

SEQ ID NO: 793 - DNA, 771 bp, Neisseria meningitidis
atatcgtactgggcaagcagttcgccggattttttggaagtagataccgcgcctttgatttttttgccgctcttacccaaggcttcgatgaaaaagttgatggtcgagccggtaccgatgccgatatattcattttcgggtacgaattcgactgctttttcggcggcgatgcgcttgagttcgtcttgtgtcgtcatatttttgtcctttgggaaaccgtatcaacaaacagccgccatcttaacatttttttgcacgtcctgcccgccgcgttcaaatgcgtaccagcaataccgccgcctgcgcctctatgccttccatccgcccgagatagccgagtttttcgttggttttgcctttgatgttgacgcacgaaatgtctatgcccaaatcggcggcgatgttggcacgcatttgcggaatgtgcggcgcgagtttgggtttctgtgcaatcacggtcgtatcgacattgaccgcctgccaaccctgcgcctgaacgctttgatacgccgcacgcaaaaggacgcggctgtccgcatctttgaactctgcggcggtgtcggggaaatggctgccgatatcgcccaaacctgccgcaccgagcagcgcgtcggtaacggcgtgcagcagcgcatcggcatcggagtgtccgagcagccctttttcaaatgggatttcaactccgccaagtatcagctttctgccttcggtcagttggtggacatcgtagccctgtccgatacggatgttcgtcatcgtttgtgttcctga

SEQ ID NO: 794 - protein, 256 aa, Neisseria meningitidis
ISYWASSSPDFLEVDTAPLIFLPLLPKASMKKLMVEPVPMPIYSFSGTNSTAFSAAMRLSSSCVVIFLSFGKPYQQTAAILTFFCTSCPPRSNAYQQYRRLRLYAFHPPEIAEFFVGFAFDVDARNVYAQIGGDVGTHLRNVRREFGFLCNHGRIDIDRLPTLRLNALIRRTQKDAAVRIFELCGGVGEMAADIAQTCRTEQRVGNGVQQRIGIGVSEQPFFKWDFNSAKYQLSAFGQLVDIVALSDTDVRHRLCS

SEQ ID NO: 795 - DNA, 771 bp, Neisseria meningitidis
  misc_feature (156)..(156): N= Unknown
  misc_feature (253)..(255): N= Unknown
  misc_feature (363)..(363): N= Unknown
atatcatattgggcaagcagttcactggattttttggaagtagataccgcgcctttgatttttttgccgctcttacccaaggcttcgatgaaaaagttgatggtcgaaccggtaccgatgccgatgtattcgttttcgggtacgaattcgactgcnttttcggcggcgatgcgcttgagttcgtcttgtgtcgtcatatttttgtcctttgggaaaccgtatcaacaaacagccgccatcttaacattttttnnnacgtcctgcccgccgcgttcaaatccttaccagcaataccgccgcctgcgactctatgccttccatgcgcccgagataaccgagtttttcgttggttttgcctttgangttgacgcacgaaatgtctatgcccaaatcggcggcgatgttggcacgcatttgcggaatatgcggcgcgagtttgggtttctgtgcaatcacggtcgtatcgacattgaccgcctgccaaccctgcgcctgaacgctttgatacgccgcacgcaaaaggacgcggctgtccgcatctttgaactctgcggcggtgtcggggaaatggctgccgatatcgcccaaacctgccgcaccgagcagcgcgtcggtaacggcgtgcagcagcgcatcggcatcggagtgtccgagcagccctttttcaaatgggatttcaactccgccaagtatcagctttctgccttcggtcagttggtggacatcgtagccctgtccgatacggatgttcgtcatcgtttgtgttcctga

SEQ ID NO: 796 - protein, 256 aa, Neisseria meningitidis
  misc_feature (85)..(85): Xaa= any amino acid
  misc_feature (121)..(121): Xaa= any amino acid
ISYWASSSLDFLEVDTAPLIFLPLLPKASMKKLMVEPVPMPMYSFSGTNSTAFSAAMRLSSSCVVIFLSFGKPYQQTAAILTFFXTSCPPRSNPYQQYRRLRLYAFHAPEITEFFVGFAFXVDARNVYAQIGGDVGTHLRNMRREFGFLCNHGRIDIDRLPTLRLNALIRRTQKDAAVRIFELCGGVGEMAADIAQTCRTEQRVGNGVQQRIGIGVSEQPFFKWDFNSAKYQLSAFGQLVDIVALSDTDVRHRLCS

SEQ ID NO: 797 - DNA, 771 bp, Neisseria gonorrhoeae
atgtcgtaccgggcaagcagttcgccggattttttggaggttgaaaccgcgcctttgatttttttaccgcttttgcccaaggcttcgatgaagaaattgatggtcgaaccggtaccgatgccgatgtattcgttttcgggtacgaattcgactgctttttcggcggcgatgcgcttgagttcgtcttgcgtcgtcatatttttatcctttgggaaaccctatcaacaaacagccgccatcttaacatttttttgcacgtcctggccgccgcgttcaaatccgtaccagcaataccgccgcctgcgcctctatgccttccatccgcccgagatagccgagtttttcgttggttttgcctttgatattgacgcacgaaatatcgatacccaaatcggcggcgatgttggcacgcatttgcggaatgtgcggtgcgagtttgggtttctgtgcaatcacggtcgtatcgacattgaccacctgccaaccctgcgcctgaacgctttgatacgccgcacgcaaaaggacgcggctgtccgcatctttgaactctgcggcggtgtcgggaaaatggctgccgatgtcgcccaaacctgccgcaccgagcagcgcgtcggtaacggcgtgcagcagcgcgtcggcatccgaatgcccgagcagccctttttcaaatgggatttcaactccgccaagtatcagctttctgccttcggtcaattggtggacatcgtagccctgtccgatacggatattcgtcatcgtttgtgttcctga

SEQ ID NO: 798 - protein, 256 aa, Neisseria gonorrhoeae
MSYRASSSPDFLEVETAPLIFLPLLPKASMKKLMVEPVPMPMYSFSGTNSTAFSAAMRLSSSCVVIFLSFGKPYQQTAAILTFFCTSWPPRSNPYQQYRRLRLYAFHPPEIAEFFVGFAFDIDARNIDTQIGGDVGTHLRNVRCEFGFLCNHGRIDIDHLPTLRLNALIRRTQKDAAVRIFELCGGVGKMAADVAQTCRTEQRVGNGVQQRVGIRMPEQPFFKWDFNSAKYQLSAFGQLVDIVALSDTDIRHRLCS

SEQ ID NO: 799 - DNA, 197 bp, Neisseria meningitidis
gccggcgcgagtgcgaacaacatttccgcgcgttttgcggaaacacccgtcgctgtcagcgttaccctgatcggcacggtacttgccgtcatgctgcccgttaccgaatatgaaaacttcctgctgcttatcggctcggtatttgcgccgatggggcggattttgattgccgactttttcgtcttgaaacggcgtga

SEQ ID NO: 800 - protein, 64 aa, Neisseria meningitidis
AGASANNISARFAETPVAVSVTLIGTVLAVMLPVTEYENFLLLIGSVFAPMGGFDCRLFRLETA

SEQ ID NO: 801 - DNA, 1224 bp, Neisseria meningitidis
atgtcgggcaatgcctcctctccttcatcttcctccgccatcgggctgatttggttcggcgcggcggtatcgattgccgaaatcagcacgggtacgctgcttgcgcctttgggctggcagcgcggtctggcggctctacttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcctggctgccgcttgccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcaggtttgggtgcggcaggcattttggcggtcgtcctctccaccgttaccacaacgtttctcgatgcctattccgccggcgcgagtgcgaacaacatttccgcgcgttttgcggaaacacccgtcgctgtcggcgttaccctgatcggcacggtacttgccgtcatgctgcccgttaccgaatatgaaaacttcctgctgcttatcggctcggtatttgcgccgatggcggcggttttgattgccgactttttcgtcttgaaacggcgtgaggagattgaaggctttgactttgccggactggttctgtggcttgcgggcttcatcctctaccgcttcctgctctcgtccggctgggaaagcagcatcggtctgaccgcccccgtaatgtctgccgttgccattgccaccgtatcggtacgccttttctttaaaaaaacccaatctttacaaaggaacccgtcatga

SEQ ID NO: 802 - protein, 407 aa, Neisseria meningitidis
MSGNASSPSSSSAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAGLGAAGILAVVLSTVTTTFLDAYSAGASANNISARFAETPVAVGVTLIGTVLAVMLPVTEYENFLLLIGSVFAPMAAVLIADFFVLKRREEIEGFDFAGLVLWLAGFILYRFLLSSGWESSIGLTAPVMSAVAIATVSVRLFFKKTQSLQRNPS

SEQ ID NO: 803 - DNA, 1041 bp, Neisseria meningitidis
  misc_feature (23)..(23): N= Unknown
  misc_feature (132)..(132): N= Unknown
  misc_feature (206)..(206): N= Unknown
  misc_feature (209)..(209): N= Unknown
  misc_feature (499)..(499): N= Unknown
  misc_feature (501)..(501): N= Unknown
  misc_feature (529)..(530): N= Unknown
  misc_feature (534)..(535): N= Unknown
  misc_feature (579)..(579): N= Unknown
  misc_feature (825)..(825): N= Unknown
  misc_feature (879)..(879): N= Unknown
atgtcgggcaatgcctcctctcnttcatcttccgccgccatcgggctgatttggttcggcgcggcggtatcgattgccgaaatcagcacgggtacactgcttgcgcctttgggctggcagcgcggtctggcngctctgcttttgggtcatgccgtcggcggcgcgctgttttttgcggcggcgtatatcggcgcactgaccggacncanctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaantnttttccacggcaggcagcaccgccgcannggtnncagacggcatgagtttcggaacggcagtcgagctgtccgccgtnatgccgctttcttggctgccgctggccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcaggtttgggtgcggcaggcattttggcggtcgtcctgtcgaccgttaccaccacttttctcgatgcntactccgccggcgtaagtgccaacaatatttccgccaaactttcggaaataccnatcgccgttgccgtcgccgttgtcggcacactgcttgccgtcctcctgcccgttaccgaatatgaaaacttcctgctgcttatcggctcggtatttgcgccgatggcggcggttttgattgccgactttttcgtcttgaaacggcgtgaggagattgaaggc

SEQ ID NO: 804 - protein, 347 aa, Neisseria meningitidis
  misc_feature (8)..(8): Xaa= any amino acid
  misc_feature (69)..(70): Xaa= any amino acid
  misc_feature (167)..(167): Xaa= any amino acid
  misc_feature (177)..(177): Xaa= any amino acid
  misc_feature (179)..(179): Xaa= any amino acid
MSGNASSXSSSAAIGLIWFGAAVSIAEISTGTLLAPLGWQRGLAALLLGHAVGGALFFAAAYIGALTGXXSMESVRLSFGKRGSVLFSVANMLQLAGWTAVMIYAGATVSSALGKVLWDGESFVWWALANGALIVLWLVFGARKTGGLKTVSMLLMLLAVLWLSAEXFSTAGSTAAXVXDGMSFGTAVELSAVMPLSWLPLAADYTRHARRPFAATLTATLAYTLTGCWMYALGLAAALFTGETDVAKILLGAGLGAAGILAVVLSTVTTTFLDAYSAGVSANNISAKLSEIPIAVAVAVVGTLLAVLLPVTEYENFLLLIGSVFAPMAAVLIADFFVLKRREEIEG

SEQ ID NO: 805 - DNA, 8 bp, Neisseria gonorrhoeae
  misc_feature (1)..(8): N = Unknown
nnnnnnnn

SEQ ID NO: 806 - protein, 343 aa, Neisseria gonorrhoeae
MSGNASSPSSSAAIGLVWFGAAVSIAEISTGTLLAPLGWQRGLAALLLGHAVGGALFFAAAYIGALTGRSSMESVRLSFGKCGSVLFSVANMLQLAGWTAVMIYVGATVSSALGKVLWDGESFVWWALANGALIVLWLVFGARRTGGLKTVSMLLMLLAVLWLSVEVFASSGTNAAPAVSDGMTFGTAVELSAVMPLSWLPLAADYTRQARRPFAATLTATLAYTLTGCWMYALGLAAALFTGETDVAKILLGAGLGITGILAVVLSTVTTTFLDTYSAGASANNISARFAEIPVAVGVTLIRTVLAVMLPVTEYKNFLLLIRSVFGPMAGGFDCRLFCLKTA

SEQ ID NO: 807 - DNA, 1227 bp, Neisseria gonorrhoeae
atgtcgggcaatgcctcctctccttcatcttccgccgccatcgggctggtttggttcggcgcggcggtatcgattgccgaaatcagcacgggtacgctgctcgcccccttgggctggcagcgcggtctggcggccctgcttttgggtcatgccgtcggcggcgcgctgttttttgcggcggcgtatatcggcgcactgaccggacgcagctcgatggaaagtgtgcgcctgtcgttcggcaaatgcggttcagtgctgttttccgtggcgaatatgctgcaactggccggctggacggcggtgatgatttacgtcggcgcaacggtcagctccgctttgggcaaagtgttgtgggacggcgaatcctttgtctggtgggcattggcaaacggcgcactgatcgtgctgtggctggttttcggcgcacgcagaacgggcgggctgaaaaccgtttcgatgctgctgatgctgcttgccgtgttgtggttgagcgtcgaagtgttcgcttcgtccggcacaaacgccgcgcccgccgtttcagacggcatgaccttcggaacggcagtcgaactgtccgccgtcatgccgctttcctggctgccgctggccgccgactacacgcgccaagcacgccgcccgtttgcggcaaccctgacggcaacgctcgcctatacgctgacgggctgctggatgtatgccttgggtttggcggcggctctgtttaccggagaaaccgacgtggcgaaaatcctgttgggcgcgggcttgggcataacgggcattctggcagtcgtcctctccaccgttaccacaacgtttctcgatacctattccgccggcgcgagtgcgaacaacatttccgcgcgttttgcggaaatacccgtcgctgtcggcgttaccctgatcggcacggtgcttgccgtcatgctgcccgttaccgaatataaaaacttcctgctgcttatcggctcggtatttgcgccgatggcggcggttttgattgccgactttttcgtcttaaaacggcgtgaggagattgaaggctttgactttgccggactggttctgtggctggcaggcttcatcctctaccgcttcctgctctcgtccggttgggaaagcagcatcggtctgaccgcccccgtaatgtctgccgttgccattgccaccgtatcggtacgccttttctttaaaaaaacccaatctttacaaaggaacccgtcatga

SEQ ID NO: 808 - protein, 408 aa, Neisseria gonorrhoeae
MSGNASSPSSSAAIGLVWFGAAVSIAEISTGTLLAPLGWQRGLAALLLGHAVGGALFFAAAYIGALTGRSSMESVRLSFGKCGSVLFSVANMLQLAGWTAVMIYVGATVSSALGKVLWDGESFVWWALANGALIVLWLVFGARRTGGLKTVSMLLMLLAVLWLSVEVFASSGTNAAPAVSDGMTFGTAVELSAVMPLSWLPLAADYTRQARRPFAATLTATLAYTLTGCWMYALGLAAALFTGETDVAKILLGAGLGITGILAVVLSTVTTTFLDTYSAGASANNISARFAEIPVAVGVTLIGTVLAVMLPVTEYKNFLLLIGSVFAPMAAVLIADFFVLKRREEIEGFDFAGLVLWLAGFILYRFLLSSGWESSIGLTAPVMSAVAIATVSVRLFFKKTQSLQRNPS

SEQ ID NO: 809 - DNA, 549 bp, Neisseria meningitidis
  misc_feature (162)..(162): N= Unknown
  misc_feature (345)..(345): N= Unknown
  misc_feature (447)..(447): N= Unknown
atgacccgtatcgccatcctcggcggcggcctctcgggaaggctgaccgcgttgcagcttgcagaacaaggttatcagattgcacttttcgataaaagctgccgccggggcgaacacgccgccgcctatgtagccgccgccatgctcgcgcctgcagcgganacggtcgaagccacgcccgaagtggtcaggctgggcaggcagagcatcccgctttggcgcggcatccgatgccgtctgaacacgcacacgatgatgcaggaaaacggcagcctgattgtatggcacgggcaggacaagccattatccagcgagttcgtccgccatctcaaacgcggcggcgtnacggatgacgaaatcgtccgttggcgcgccgacgacatcgccgaacgcgaaccgcaactcggcggacgtttttaagacggcatctacctgccgaccgaagcncagctcgacgggcggcaattatagtctgcacttgccgacgctttggacgaactgaacgtcccctgccattgggaacacgaatgcgtccccgaagcctgcaag

SEQ ID NO: 810 - protein, 183 aa, Neisseria meningitidis
  misc_feature (54)..(54): Xaa= any amino acid
  misc_feature (115)..(115): Xaa= any amino acid
  misc_feature (140)..(140): Xaa= any amino acid
  misc_feature (149)..(149): Xaa= any amino acid
  misc_feature (157)..(157): Xaa= any amino acid
MTRIAILGGGLSGRLTALQLAEQGYQIALFDKSCRRGEHAAAYVAAAMLAPAAXTVEATPEVVRLGRQSIPLWRGIRCRLNTHTMMQENGSLIVWHGQDKPLSSEFVRHLKRGGXTDDEIVRWRADDIAEREPQLGGRFXDGIYLPTEXQLDGRQLXSALADALDELNVPCHWEHECVPEACK

SEQ ID NO: 811 - DNA, 1101 bp, Neisseria meningitidis
atgacccgtatcgccatcctcggcggcggcctctcgggaaggctgaccgcgttgcagcttgcagaacaaggttatcagattgcacttttcgataaaggctgccgccggggcgaacacgccgccgcctatgttgccgccgccatgctcgcgcctgcggcggaagcggtcgaagccacgcccgaagtggtcaggctgggcaggcagagcatcccgctttggcgcggcatccgatgccgtctgaacacgcacacgatgatgcaggaaaacggcagcctgattgtgtggcacgggcaggacaagccattatccagcgagttcgtccgccatctcaaacgcggcggcgtagcggatgacgaaatcgtccgttggcgcgccgacgacatcgccgaacgcgaaccgcaactcggcggacgtttttcagacggcatctacctgccgaccgaaggccagctcgacgggcggcaaatattgtctgcacttgccgacgctttggacgaactgaacgtcccctgccattgggaacacgaatgcgtccccgaaggcctgcaagcccaatacgactggctgatcgactgccgcggctacggcgcaaaaaccgcgtggaaccaatcccccgagcacaccagcaccctgcgcggcatacgcggcgaagtggcgcgggtttacacacccgaaatcacgctcaaccgccccgtgcgtctgctccatccgcgttatccgctctacatcgccccgaaagaaaaccacgtcttcgtcatcggcgcgacccaaatcgaaagcgaaagccaagcccccgccagcgtgcgttcagggttggaactcttgtccgcactctatgccatccaccccgccttcggcgaagccgacatcctcgaaatcgccaccggcctgcgccccacgctcaaccaccacaaccccgaaatccgttacaaccgcgcccgacgcctgattgaaatcaacggccttttccgccacggtttcatgatctcccccgccgtaaccgccgccgccgccagattggcagtggcactgtttgacggaaaagacgcgcccgaacgcgataaagaaagcggtttggcgtatatccgaagacaagattaa

SEQ ID NO: 812 - protein, 366 aa, Neisseria meningitidis
MTRIAILGGGLSGRLTALQLAEQGYQIALFDKGCRRGEHAAAYVAAAMLAPAAEAVEATPEVVRLGRQSIPLWRGIRCRLNTHTMMQENGSLIVWHGQDKPLSSEFVRHLKRGGVADDEIVRWRADDIAEREPQLGGRFSDGIYLPTEGQLDGRQILSALADALDELNVPCHWEHECVPEGLQAQYDWLIDCRGYGAKTAWNQSPEHTSTLRGIRGEVARVYTPEITLNRPVRLLHPRYPLYIAPKENHVFVIGATQIESESQAPASVRSGLELLSALYAIHPAFGEADILEIATGLRPTLNHHNPEIRYNRARRLIEINGLFRHGFMISPAVTAAAARLAVALFDGKDAPERDKESGLAYIRRQD

SEQ ID NO: 813 - DNA, 1101 bp, Neisseria meningitidis
  misc_feature (36)..(36): N= Unknown
  misc_feature (206)..(206): N= Unknown
  misc_feature (261)..(261): N= Unknown
  misc_feature (355)..(355): N= Unknown
  misc_feature (618)..(619): N= Unknown
  misc_feature (621)..(621): N= Unknown
  misc_feature (723)..(723): N= Unknown
  misc_feature (746)..(746): N= Unknown
  misc_feature (1047)..(1047): N= Unknown
atgacccgtatcgccatcctcggcggcggcctctcnggaaggctgaccgcactgcagcttgcagaacaaggttatcagattgcacttttcgataaaggctgccgccggggcgaacacgccgccgcctatgttgccgccgccatgctcgcgcctgcggcggaagcggtcgaagccacgcctgaagtggtcaggctgggcaggcagancatcccgctttggcgcggcatccgatgccatctgaaaacgcctgccatgatgcangaaaacggcagcctgattgtgtggcacgggcaggacaaacctttatccaacgagttcgtccgccatctcaaacgcggcggcgtagcggatgacnaaatcgtccgttggcgcgccgacgacatcgccgaacgcgaaccgcaactcggcggacgtttttcagacggcatctacctgccgaccgaaggccagctcgacgggcggcaaatattgtctgcacttgccgacgctttggacgaactgaacgtcccctgccattgggaacacgaatgtgcccccgaagacttgcaagcccaatacgactggctgatcgactgccgcggctacggcgcaaaaaccgcgtggaaccaatcccccgannanaccagcaccctgcgcggcatacgcggcgaagtggcgcgggtttacacacccgaaatcacgctcaaccgccccgtgcgcctgctacacccgcgctatccgctntacatcgccccgaaagaaaaccncgtcttcgtcatcggcgcgacccaaatcgaaagcgaaagccaagcacctgccagcgtgcgttccgggctggaactcttatccgcactctatgccgtccaccccgccttcggcgaagccgacatcctcgaaatcgccaccggcctgcgccccacgctcaatcaccacaaccccgaaatccgttacaaccgcgcccgacgcctgattgaaatcaacggccttttccgccacggtttcatgatctcccccgccgtaaccgccgccgccgtcagattggcagtggcactgtttgacggaaaagangcgcccgaacgcgatgaagaaagcggtttggcgtatatccgaagacaagattaa

SEQ ID NO: 814 - protein, 366 aa, Neisseria meningitidis
  misc_feature (69)..(69): Xaa= any amino acid
  misc_feature (87)..(87): Xaa= any amino acid
  misc_feature (119)..(119): Xaa= any amino acid
  misc_feature (206)..(207): Xaa= any amino acid
  misc_feature (249)..(249): Xaa= any amino acid
  misc_feature (349)..(349): Xaa= any amino acid
MTRIAILGGGLSGRLTALQLAEQGYQIALFDKGCRRGEHAAAYVAAAMLAPAAEAVEATPEVVRLGRQXIPLWRGIRCHLKTPAMMXENGSLIVWHGQDKPLSNEFVRHLKRGGVADDXIVRWRADDIAEREPQLGGRFSDGIYLPTEGQLDGRQILSALADALDELNVPCHWEHECAPEDLQAQYDWLIDCRGYGAKTAWNQSPXXTSTLRGIRGEVARVYTPEITLNRPVRLLHPRYPLYIAPKENXVFVIGATQIESESQAPASVRSGLELLSALYAVHPAFGEADILEIATGLRPTLNHHNPEIRYNRARRLIEINGLFRHGFMISPAVTAAAVRLAVALFDGKXAPERDEESGLAYIRRQD

SEQ ID NO: 815 - DNA, 8 bp, Neisseria gonorrhoeae
  misc_feature (1)..(8): N = Unknown
nnnnnnnn

SEQ ID NO: 816 - protein, 366 aa, Neisseria gonorrhoeae
MTRIAVLGGGLSGRLTALQLAEQGYQIELFDKGTRQGEHAAAYVAAAMLAPAAEAVEATPEVIRLGRQSIPLWRGIRCRLNTLTMMQENGSLIVWHGQDKPLSSEFVRHLKRGGVADDEIVRWRADEIAEREPQLGGRFSDGIYLPTEGQLDGRQILSALADALDELNVPCHWEHECAPQDLQAQYDWVIDCRGYGAKTAWNQSPEHTSTLRGIRGEVRGFTRPKSRSTAPCACCTRAIRSTSPRKKTTSSSSARPKSKAKAKPPPAYVPGWNSYPRSMPSTPPSAKPTSSKWRPGLRPTLNHHNPEIRYSRERRLIEINGLFRHGFMISPAVTAAAVRLAVALFDGKDAPERDEESGLAYIGRQD

SEQ ID NO: 817 - DNA, 1101 bp, Neisseria gonorrhoeae
atgacccgtatcgccgtcctcggaggcggcctttccggaaggctgaccgcattgcagcttgcagaacaaggttatcagattgaacttttcgacaagggcacccgccaaggcgaacacgccgccgcctatgttgccgccgcgatgctcgcgcctgcggcggaagcggtcgaggcaacgcccgaagtcatcaggctgggcaggcagagcattccgctttggcgcggcatccgatgccgtctgaacacgctcacgatgatgcaggaaaacggcagcctgattgtgtggcacgggcaggacaagccattatccagcgagttcgtccgccatctcaaacgcggcggcgtagcggatgacgaaatcgtccgttggcgcgccgatgaaatcgccgaacgcgaaccgcaactcggcggacgtttttcagacggcatctacctgccgaccgaaggccagctcgacgggcggcaaatattgtctgcacttgccgacgctttggacgaactgaacgtcccttgccattgggaacacgaatgcgccccccaagacctgcaagcccaatacgactgggtaatcgactgccggggctacggcgcgaaaaccgcgtggaaccaatcccccgagcacaccagcaccttgcgcggcatacgcggcgaagtggcgcgggtttacacgcccgaaatcacgctcaaccgccccgtgcgcctgctgcacccgcgctatccgctctacatcgccccgaaagaaaaccacgtcttcgtcatcggcgcgacccaaatcgaaagcgaaagccaagcccccgccagcgtacgttccgggctggaactcttatccgcgctctatgccgtccaccccgccttcggcgaagccgacatcctcgaaatcgccgccggcctgcgccccacgctcaaccaccacaaccccgaaatccgctacagccgcgaacgccgcctcatcgaaatcaacggccttttccggcacggctttatgatttcccccgccgtaaccgccgccgccgtcagattggcagtggcactgtttgacggaaaagacgcgcccgaacgtgatgaagaaagcggtttggcgtatatcggaagacaagattaa

SEQ ID NO: 818 - protein, 366 aa, Neisseria gonorrhoeae
MTRIAVLGGGLSGRLTALQLAEQGYQIELFDKGTRQGEHAAAYVAAAMLAPAAEAVEATPEVIRLGRQSIPLWRGIRCRLNTLTMMQENGSLIVWHGQDKPLSSEFVRHLKRGGVADDEIVRWRADEIAEREPQLGGRFSDGIYLPTEGQLDGRQILSALADALDELNVPCHWEHECAPQDLQAQYDWVIDCRGYGAKTAWNQSPEHTSTLRGIRGEVARVYTPEITLNRPVRLLHPRYPLYIAPKENHVFVIGATQIESESQAPASVRSGLELLSALYAVHPAFGEADILEIAAGLRPTLNHHNPEIRYSRERRLIEINGLFRHGFMISPAVTAAAVRLAVALFDGKDAPERDEESGLAYIGRQD

SEQ ID NO: 819 - DNA, 452 bp, Neisseria meningitidis
atgactgataatcgggggtttacgctggttgaattaatatcagtggtcttgatattgtctgtacttgctttaattgtttatccgagctatcgcaattatgttgagaaagcaaagataaatgcagtgcgggcagccttgttagaaaatgcacattttatggaaaagttttatctgcagaatgggaggtttaaacaaacatctaccaagtggccaagtttgccgattaaagaggcagaaggcttttgtatccgtttgaatggaatcgtcgcgcggggctttagacagtaaattcatgttgaaggcggtagccatagataaagataaaaatccttttattattaagatgaatgaaaatctagtaacctttaatttgcaagaagtccgccagttcgtgtagtgacgggctggattattttaaaggaaatgataaggactgcaagttacttaagtag

SEQ ID NO: 820 - protein, 150 aa, Neisseria meningitidis
  misc_feature (92)..(92): Xaa= any amino acid
MTDNRGFTLVELISVVLILSVLALIVYPSYRNYVEKAKINAVRAALLENAHFMEKFYLQNGRFKQTSTKWPSLPIKEAEGFCIRLNGIVARXALDSKFMLKAVAIDKDKNPFIIKMNENLVTFICKKSASSCSDGLDYFKGNDKDCKLLK

SEQ ID NO: 821 - DNA, 450 bp, Neisseria meningitidis
atgactgataatcgggggtttacgctggttgaattaatatcagtggtcttgatattgtctgtacttgctttaattgtttatccgagctatcgcaattatgttgagaaagcaaagataaatgcagtgcgggcagccttgttagaaaatgcacattttatggaaaagttttatctgcagaatgggaggtttaaacaaacatctaccaagtggccaagtttgccgattaaagaggcagaaggcttttgtatccgtttgaatggaatcgcgcgcggggctttagacagtaaattcatgttgaaggcggtagccatagataaagataaaaatccttttattattaagatgaatgaaaatctagtaacctttatttgcaagaagtccgccagttcgtgtagtgacgggctggattattttaaaggaaatgataaggactgcaagttacttaagtag

SEQ ID NO: 822 - protein, 149 aa, Neisseria meningitidis
MTDNRGFTLVELISVVLILSVLALIVYPSYRNYVEKAKINAVRAALLENAHFMEKFYLQNGRFKQTSTKWPSLPIKEAEGFCIRLNGIARGALDSKFMLKAVAIDKDKNPFIIKMNENLVTFICKKSASSCSDGLDYFKGNDKDCKLLK

SEQ ID NO: 823 - DNA, 450 bp, Neisseria meningitidis
atgactgataatcgggggtttacgctggttgaattaatatcagtggtcttgatattgtctgtacttgctttaattgtttatccgagctatcgcaattatgttgagaaagcaaagataaatacagtgcgggcagccttgttagaaaatgcacattttatggaaaagttttatctgcagaatgggagatttaaacaaacatctaccaaatggccaagtttgccgattaaagaggcagaaggcttttgtatccgtttgaatggaatcgcgcgcggggccttagacagtaaattcatgttgaaggcggtagccatagataaagataaaaatccttttattattaagatgaatgaaaatctagtaacctttatttgcaagaagtccgccagttcgtgtagtgacgggctggattattttaaaggaaatgataaggactgcaagttacttaagtag

SEQ ID NO: 824 - protein, 149 aa, Neisseria meningitidis
MTDNRGFTLVELISVVLILSVLALIVYPSYRNYVEKAKINTVRAALLENAHFMEKFYLQNGRFKQTSTKWPSLPIKEAEGFCIRLNGIARGALDSKFMLKAVAIDKDKNPFIIKMNENLVTFICKKSASSCSDGLDYFKGNDKDCKLLK

SEQ ID NO: 825 - DNA, 450 bp, Neisseria gonorrhoeae
atgactgataatcgggggtttacactggttgaattaatatcagtggtcttgatattgtctgtacttgctttaattgtttatccgagctatcgcaattatgttgagaaagcaaagataaatgcagtgcgggcagccttgttagaaaatgcacattttatggaaaagttttatctgcagaatgggagatttaaacaaacatctaccaaatggccaagtttgccgattaaagaggcagaaggcttttgtatccgtttgaatggaatcgcgcgcggggctttagacagtaaattcatgttgaaggcggtagccatagataaagataaaaatccttttattattaagatgaatgaaaatctagtaacctttatttgcaagaagtccgccagttcgtgtagtgacgggctggattattttaaaggaaatgataaggactgcaagttacttaagtag

SEQ ID NO: 826 - protein, 149 aa, Neisseria gonorrhoeae
MTDNRGFTLVELISVVLILSVLALIVYPSYRNYVEKAKINAVRAAFLENAHFMEKFYLQNGRFKQTSTKWPSLPIKEAEGFCIRLNGIARGALDSKFMLKAVAIDKDKNPFIIKMNENLVTFICKKSASSCSDRLDYFKGNDKDCKLLK

SEQ ID NO: 827 - DNA, 734 bp, Neisseria meningitidis
gtgtcgctggcttcggtgattgcctctcaaatcttcctttacgaagatttcaaccaaatgcggaaaacccgtggagctatctgcggttttcttgtccaatatttatctggggtttcagcaggggtatttcgatttgagtgccgacgagaaccccgtactgcatatctggtctttggcagtagaggaacagtattacctcctgtatccccttttgctgatattttgctgcaaaaaaaccaaatcgctacgggtgctgcgtaacatcagcatcatcctgtttttgattttgactgcctcatcgtttttgccaagcgggttttataccgacatcctcaaccaacccaatacttattacctttcgacactgaggtttcccgagctgttggcaggttcgctgctggcggtttacgggcaaacgcaaaacggcagacggcaaacagcaaatggaaaacggcagttgctttcatcactctgcttcggcgcattgcttgcctgcctgttcgtgattgacaaacacaatccgtttatcccgggaatgaccctgctccttccctgcctgctgacggcactgcttatccggagtatgcaatacgggacacttccgacccgcatcctgtcggcaagccccatcgtatttgtcggcaaaatctcttattccctatacctgtaccattggatttttattgctttcgctccgctcattagaggcgggaaacagctcggactgcctgccg

SEQ ID NO: 828 - protein, 244 aa, Neisseria meningitidis
VSLASVIASQIFLYEDFNQMRKTVELSAVFLSNIYLGFQQGYFDLSADENPVLHIWSLAVEEQYYLLYPLLLIFCCKKTKSLRVLRNISIILFLILTASSFLPSGFYTDILNQPNTYYLSTLRFPELLAGSLLAVYGQTQNGRRQTANGKRQLLSSLCFGALLACLFVIDKHNPFIPGMTLLLPCLLTALLIRSMQYGTLPTRILSASPIVFVGKISYSLYLYHWIFIAFAPLIRGGKQLGLPA

SEQ ID NO: 829 - DNA, 1869 bp, Neisseria meningitidis
atgcaagctgtccgatacagaccggaaattgacggattgcgggccgtcgccgtgctatccgtcatgattttccacctgaataaccgctggctgcccggaggattcctgggggtggacattttctttgtcatctcaggattcctcattaccggcatcattctttctgaaatacagaacggttctttttctttccgggatttttatacccgcaggattaagcggatttatcctgcctttattgcggccgtgtcgctggcttcggtgattgcctctcaaatcttcctttacgaagatttcaaccaaatgcggaaaaccgtggagctttctgcggttttcttgtccaatatttatctggggtttcagcaggggtatttcgatttgagtgccgacgagaaccccgtactgcatatctggtctttggcagtagaggaacagtattacctcctgtatccccttttgctgatattttgctgcaaaaaaaccaaatcgctacgggtgctgcgtaacatcagcatcatcctgtttttgattttgactgcctcatcgtttttgccaagcgggttttataccgacatcctcaaccaacccaatacttattacctttcgacactgaggtttcccgagctgttggcaggttcgctgctggcggtttacgggcaaacgcaaaacggcagacggcaaacagcaaatggaaaacggcagttgctttcatcactctgcttcggcgcattgcttgcctgcctgttcgtgattgacaaacacaatccgtttatcccgggaatgaccctgctccttccctgcctgctgacggcactgcttatccggagtatgcaatacgggacacttccgacccgcatcctgtcggcaagccccatcgtatttgtcggcaaaatctcttattccctatacctgtaccattggatttttattgctttcgcccattacattacaggcgacaaacagctcggactgcctgccgtatcggcggttgccgcgttgacggccggattttccctgttgagttattatttgattgaacagccgcttagaaaacggaagatgaccttcaaaaaggcatttttctgcctctatctcgccccgtccctgatacttgtcggttacaacctgtacgcaagggggatattgaaacaggaacacctccgcccgttgcccggcgcgccccttgctgcggaaaatcattttccggaaaccgtcctgaccctcggcgactcgcacgccggacacctgagggggtttctggattatgtcggcagccgggaagggtggaaagccaaaatcctgtccctcgattcggagtgtttggtttgggtagatgagaagctggcagacaacccgttatgtcgaaaataccgggatgaagttgaaaaagccgaagccgttttcattgcccaattctatgatttgaggatgggcggccagcctgtgccgagatttgaagcgcaatccttcctaatacccgggttcccagcccgattcagggaaaccgtcaaaaggatagccgccgtcaaacccgtctatgtttttgcaaacaacacatcaatcagccgttcgcccctgagggaggaaaaattgaaaagatttgccgcaaaccaatatctccgccccattcaggctatgggcgacatcggcaagagcaatcaggcggtctttgatttgattaaagatattcccaatgtgcattgggtggacgcacaaaaatacctgcccaaaaacacggtcgaaatatacggccgctatctttacggcgaccaagaccacctgacctatttcggttcttattatatggggcgggaattccacaaacacgaacgcctgcttaaatcttcccacggcggcgcattgcagtag

SEQ ID NO: 830 - protein, 622 aa, Neisseria meningitidis
MQAVRYRPEIDGLRAVAVLSVMIFHLNNRWLPGGFLGVDIFFVISGFLITGIILSEIQNGSFSFRDFYTRRIKRIYPAFIAAVSLASVIASQIFLYEDFNQMRKTVELSAVFLSNIYLGFQQGYFDLSADENPVLHIWSLAVEEQYYLLYPLLLIFCCKKTKSLRVLRNISIILFLILTASSFLPSGFYTDILNQPNTYYLSTLRFPELLAGSLLAVYGQTQNGRRQTANGKRQLLSSLCFGALLACLFVIDKHNPFIPGMTLLLPCLLTALLIRSMQYGTLPTRILSASPIVFVGKISYSLYLYHWIFIAFAHYITGDKQLGLPAVSAVAALTAGFSLLSYYLIEQPLRKRKMTFKKAFFCLYLAPSLILVGYNLYARGILKQEHLRPLPGAPLAAENHFPETVLTLGDSHAGHLRGFLDYVGSREGWKAKILSLDSECLVWVDEKLADNPLCRKYRDEVEKAEAVFIAQFYDLRMGGQPVPRFEAQSFLIPGFPARFRETVKRIAAVKPVYVFANNTSISRSPLREEKLKRFAANQYLRPIQAMGDIGKSNQAVFDLIKDIPNVHWVDAQKYLPKNTVEIYGRYLYGDQDHLTYFGSYYMGREFHKHERLLKSSHGGALQ

SEQ ID NO: 831 - DNA, 1869 bp, Neisseria meningitidis
atgcaagctgtccgatacagaccggaaattgacggattgcgggccgtcgccgtgctatccgtcatgattttccacctgaataaccgctggctgcccggaggattcctgggggtggacattttctttgtcatctcaggattcctcattaccggcatcattctttctgaaatacagaacggttctttttctttccgggatttttatacccgcaggattaagcggatttatcctgcttttattgcggccgtgtcgctggcttcggtgattgcctctcaaatcttcctttacgaagatttcaaccaaatgcggaaaaccgtggagctttctgcggttttcttgtccaatatttatctggggtttcagcaggggtatttcgatttgagtgccgacgagaaccccgtactgcatatctggtctttggcagtagaggaacagtattacctcctgtatcctcttttgctgatattttgctgcaaaaaaacaaaatcgctacgggtgctgcgtaacatcagcatcatcctatttctgattttgactgccacatcgtttttgccaagcgggttttataccgatattctcaaccaacccaatacttattacctttcgacactgaggtttcccgagctgttggcaggttcgctgctggcggtttacgggcaaacgcaaaacggcagacggcaaacagcaaatggaaaacggcagttgctttcatcactctgcttcggcgcattgcttgcctgcctgttcgtgattgacaaacacaatccgtttatcccgggaatgaccctgctccttccctgcctgctgacggcactgcttatccggagtatgcaatacgggacacttccgacccgcatcctgtcggcaagccccatcgtatttgtcggcaaaatctcttattccctatacctgtaccattggatttttattgctttcgcccattacattacaggcgacaaacagctcggactgcctgccgtatcggcggttgccgcgttgacggccggattttccctgttgagttattatttgattgaacagccgcttagaaaacggaagatgaccttcaaaaaggcatttttctgcctctatctcgccccgtccctgatacttgtcggttacaacctgtacgcaagggggatattgaaacaggaacacctccgcccgttgcccggcgcgccccttgctgcggaaaatcattttccggaaaccgtcctgaccctcggcgactcgcacgccggacacctgcgggggtttctggattatgtcggcagccgggaagggtggaaagccaaaatcctgtccctcgattcggagtgtttggtttgggtagatgagaagctggcagacaacccgttatgtcgaaaataccgggatgaagttgaaaaagccgaagccgttttcattgcccaattctatgatttgaggatgggcggccagcccgtgccgagatttgaagcgcaatccttcctaatacccgggttcccagcccgattcagggaaaccgtcaaaaggatagccgccgtcaaacccgtctatgtttttgcaaacaacacatcaatcagccgttcgcccctgagggaggaaaaattgaaaagatttgccgcaaaccaatatctccgccccattcaggctatgggcgacatcggcaagagcaatcaggcggtctttgatttgattaaagatattcccaatgtgcattgggtggacgcacaaaaatacctgcccaaaaacacggtcgaaatatacggccgctatctttacggcgaccaagaccacctgacctatttcggttcttattatatggggcgggaatttcacaaacacgaacgcctgcttaaatcttctcgcgacggcgcattgcagtag

SEQ ID NO: 832 - protein, 622 aa, Neisseria meningitidis
MQAVRYRPEIDGLRAVAVLSVMIFHLNNRWLPGGFLGVDIFFVISGFLITGIILSEIQNGSFSFRDFYTRRIKRIYPAFIAAVSLASVIASQIFLYEDFNQMRKTVELSAVFLSNIYLGFQQGYFDLSADENPVLHIWSLAVEEQYYLLYPLLLIFCCKKTKSLRVLRNISIILFLILTATSFLPSGFYTDILNQPNTYYLSTLRFPELLAGSLLAVYGQTQNGRRQTANGKRQLLSSLCFGALLACLFVIDKHNPFIPGMTLLLPCLLTALLIRSMQYGTLPTRILSASPIVFVGKISYSLYLYHWIFIAFAHYITGDKQLGLPAVSAVAALTAGFSLLSYYLIEQPLRKRKMTFKKAFFCLYLAPSLILVGYNLYARGILKQEHLRPLPGAPLAAENHFPETVLTLGDSHAGHLRGFLDYVGSREGWKAKILSLDSECLVWVDEKLADNPLCRKYRDEVEKAEAVFIAQFYDLRMGGQPVPRFEAQSFLIPGFPARFRETVKRIAAVKPVYVFANNTSISRSPLREEKLKRFAANQYLRPIQAMGDIGKSNQAVFDLIKDIPNVHWVDAQKYLPKNTVEIYGRYLYGDQDHLTYFGSYYMGREFHKHERLLKSSRDGALQ

SEQ ID NO: 833 - DNA, 1869 bp, Neisseria gonorrhoeae
atgcaagctgtccgatacaggcctgaaattgacggattgcgggccgtcgccgtgctatccgtcattattttccacctgaataaccgctggctgcccggaggattcctgggggtggacattttctttgtcatctcgggattcctcattaccaacatcattctttctgaaatacagaacggttctttttctttccgggatttttatacccgcaggattaagcggatttatcctgcttttattgcggccgtgtccctggcttcggtgattgcttctcaaatcttcctttacgaagatttcaaccaaatgaggaaaaccatagagctttctacggtttttttgtccaatatttatttggggttccgattggggtatttcgatttgagtgccgacgagaaccccgtactgcatatctggtctttggcggtagaggaacagtattacctcctgtatcctcttttgctgatattctgttacaaaaaaaccaaatcactacgggtgctgcgtaatatcagcatcatcctgtttctgattttgaccgcatcatcgtttttgccggccgggttttataccgacatcctcaaccaacccaatacttattacctttcgacactgaggtttcccgagctgttggtgggttcgctgttggcggtttacgggcaaacgcaaaacggcagacggcaaacagaaaatggaaaacggcagttgctttcattactctgtttcggcgcattgcttgtctgcctgttcgtgatcgacaaacacgatccgtttatcccgggaataaccctgctccttccctgcctgctgacggcgctgcttatccggagtatgcaatacgggacacttccgacccgcatcctgtcggcaagccccatcgtatttgtcggcaaaatctcttattccctatacctgtaccattggatttttattgccttcgcccattacattacaggcgacaaacagctcggactgcctgccgtatcggcggttgccgcgttgacggccggattttccctgttgagctattatttgattgaacagccgcttagaaaacggaagatgaccttcaaaaaggcatttttctgcctttatctcgccccgtccctgatgcttgtcggttacaacctgtattcaagagggatattgaaacaggaacacctccgcccgctgcccggcacgcccgttgctgcggaaaataattttccggaaaccgtcttgaccctcggcgactcgcacgccggacacctgcgggggtttctggattatgtcggcggcagggaagggtggaaagctaaaatcctgtccctcgattcggagtgtttggtttgggtggatgagaagctggcagacaacccgttgtgccgaaaataccgggatgaagttgaaaaagccgaagctgttttcattgcccaattctatgatttgaggatgggcggccagcccgtgccgagatttgaagcgcaatccttcctgatacccgggttcaaagcccgattcagggaaaccgtcaagaggatagccgccgtcaaacctgtatatgtttttgcaaacaatacatcaatcagccgttctcccttgagggaggaaaaattgaaaagatttgctataaaccaatacctccggcctattcgggctatgggcgacatcggcaagagcaatcaggcggtctttgatttggttaaagatattcccaatgtgcattgggtggacgcacaaaaatacctgcccaaaaacacggtcgaaatacacggacgctatctttacggcgaccaagaccacctgacctatttcggttcttattatatggggcgggaatttcacaaacacgaacgcctgctcaagcattcccgaggcggcgcattgcagtag

SEQ ID NO: 834 - protein, 622 aa, Neisseria gonorrhoeae
MQAVRYRPEIDGLRAVAVLSVIIFHLNNRWLPGGFLGVDIFFVISGFLITNIILSEIQNGSFSFRDFYTRRIKRIYPAFIAAVSLASVIASQIFLYEDFNQMRKTIELSTVFLSNIYLGFRLGYFDLSADENPVLHIWSLAVEEQYYLLYPLLLIFCYKKTKSLRVLRNISIILFLILTASSFLPAGFYTDILNQPNTYYLSTLRFPELLVGSLLAVYGQTQNGRRQTENGKRQLLSLLCFGALLVCLFVIDKHDPFIPGITLLLPCLLTALLIRSMQYGTLPTRILSASPIVFVGKISYSLYLYHWIFIAFAHYITGDKQLGLPAVSAVAALTAGFSLLSYYLIEQPLRKRKMTFKKAFFCLYLAPSLMLVGYNLYSRGILKQEHLRPLPGTPVAAENNFPETVLTLGDSHAGHLRGFLDYVGGREGWKAKILSLDSECLVWVDEKLADNPLCRKYRDEVEKAEAVFIAQFYDLRMGGQPVPRFEAQSFLIPGFKARFRETVKRIAAVKPVYVFANNTSISRSPLREEKLKRFAINQYLRPIRAMGDIGKSNQAVFDLVKDIPNVHWVDAQKYLPKNTVEIHGRYLYGDQDHLTYFGSYYMGREFHKHERLLKHSRGGALQ

SEQ ID NO: 835 - DNA, 263 bp, Neisseria meningitidis
attatttacgaataccgctggatgtttctttacggcgcactgacgaccttggggctgacggtcgtggcaacgcgggcggttcggtattgggtctgttgttggcgttggcgcgcctgattcacttggaaaaagccggtgcgccgatgcgcgtgctggcgtgggcgttgcgtaaagtttcgctgctgtatgttacgctgttccggggtacgccgctgtttgtgcagattgtgatttgggcgtatgtgtggtttccgtttttcgtc

SEQ ID NO: 836 - protein, 88 aa, Neisseria meningitidis
  misc_feature (24)..(24): Xaa= any amino acid
IIYEYRWMFLYGALTTLGLTVVAXAGGSVLGLLLALARLIHLEKAGAPMRVLAWALRKVSLLYVTLFRGTPLFVQIVIWAYVWFPFFV

SEQ ID NO: 837 - DNA, 747 bp, Neisseria meningitidis
atggattttcgttttgacattatttacgaataccgctggatgtttctttacggcgcactgacgaccttggggctgacggtcgtggcaacggcgggcggttcggtattgggtctgttgttggcgttggcgcgcctgattcacttggaaaaagccggtgcgccgatgcgcgtgctggcgtgggcgttgcgtaaagtttcgctgctgtatgttacgctgttccggggtacgccgctgtttgtgcagattgtgatttgggcgtatgtgtggtttccgtttttcgtccatccttcagacggcattttggtcagcggcgaggcggcaatcgcgctgcgtcgcggatacgggccgctgattgccggttctttggcactgatcgccaactcgggggcgtatatctgtgagattttccgcgcgggcatccagtctatagacaaaggacagatggaggcggcgcgttctttggggctgacctatccgcaggcgatgcgctatgtgattctgccgcaggcattgcgccgcatgctgccgcctttggcgagcgagttcatcacgctcttgaaagacagctcgctgctgtcggtcattgctgtggcggagttggcgtatgttcagaatacgattacgggccggtattcggtttatgaagaaccgctttacaccgtcgccctgatttatctgttgatgacgactttcttaggctggatattcctgcgtttggaaaaacgttacaatccgcaacaccgctga

SEQ ID NO: 838 - protein, 248 aa, Neisseria meningitidis
MDFRFDIIYEYRWMFLYGALTTLGLTVVATAGGSVLGLLLALARLIHLEKAGAPMRVLAWALRKVSLLYVTLFRGTPLFVQIVIWAYVWFPFFVHPSDGILVSGEAAIALRRGYGPLIAGSLALIANSGAYICEIFRAGIQSIDKGQMEAARSLGLTYPQAMRYVILPQALRRMLPPLASEFITLLKDSSLLSVIAVAELAYVQNTITGRYSVYEEPLYTVALIYLLMTTFLGWIFLRLEKRYNPQHR

SEQ ID NO: 839 - DNA, 747 bp, Neisseria meningitidis
atggattttcgttttgacattatttacgaataccgctggatgtttctttacggcgcactgacgaccttggggctgacggtcgtggcgacggcgggcggttcggtattgggtctgttgttggcgttggcgcgcctgattcacttggaaaaagccggtgcgccgatgcgcgtgctggcgtgggcgttgcgtaaggtttcgctgctgtatgttacgctgttccggggtacgccgctgtttgtgcagattgtgatttgggcgtatgtgtggtttccgtttttcgtccatccttcagacggcattttggttagcggcgaggcggcaatcgcgctgcgtcgcggatacgggccgctgattgccggttctttggcactgatcgccaactcgggggcgtatatctgtgagattttccgcgcgggcatccagtctatagacaaaggacagatggaggcggcgcgttctttggggctgacctatccgcaggcgatgcgctatgtgattctgccgcaggcattgcgccgtatgctgccgcctttggcgagcgagttcatcacgctcttgaaagacagctcgctgctgtcggtcattgctgtggcggagttggcgtatgttcagaatacgattacgggccggtattcggtttatgaagaaccgctttacaccgtcgccctgatttatctgttgatgacgactttcttaggctggatattcctgcgtttggaaaaacgttacaatccgcaacaccgctga

SEQ ID NO: 840 - protein, 248 aa, Neisseria meningitidis; identical to SEQ ID NO: 838

SEQ ID NO: 841 - DNA, 8 bp, Neisseria gonorrhoeae
  misc_feature (1)..(8): N = Unknown
nnnnnnnn

SEQ ID NO: 842 - protein, 174 aa, Neisseria gonorrhoeae
MDFRFDIIYEYRWMFLYGALTTLGLTVVATAGGSVLGLLLALARLIHLEKAGAPMRVLAWALRKVSLLYVTLFRGTPLFVQIVIWAYVWFPFFVILHTAFLGNAMRQSRRVPDKGRWIAGSLELNCQPRGRKTRGEFPPGESNLGTEPRNPLSMGQRRFPGCENWYPPQNFIKK

SEQ ID NO: 843 - DNA, 747 bp, Neisseria gonorrhoeae
atggattttcgttttgacattatttacgaataccgctggatgtttctttacggcgcactgacgaccttggggctgacggtcgtggcgacggcgggcggttcggtattgggtctgttgttggcgttggcgcgcctgattcacttggaaaaagccggtgcgccgatgcgcgtgctggcgtgggcgttgcgtaaggtttcgctgctgtacgttaccctgttccggggtacgccgctgtttgtgcagattgtgatttgggcgtatgtgtggtttccgtttttcgtccatccttcagacggcattttggtcagcggcgaggcggcaatcgcgctgcgtcgcggatacgggccgctgattgccggttctttggcactgatcgccaactcgggggcgtatatctgtgagattttccgcgcgggcatccagtctatagacaaaggacagatggaggcggcgtgttctttgggactgacctatccgcaggcgatgcgctatgtgattctgccgcaggcattgcgccgtatgctgccgcctttggcgagcgagttcatcacgctcttgaaagacagctcgctgctgtcggtcattgctgtggcggagttggcgtatgttcagaatacgattacgggccggtattcggtttatgaagaaccgctttacaccgccgccctgatttatctgttgatgacgactttcttaggctggatattcctgcgtttggaaaaacgttacaatccgcaacaccgctga

SEQ ID NO: 844 - protein, 248 aa, Neisseria gonorrhoeae; identical to SEQ ID NO: 838

SEQ ID NO: 845 - DNA, 583 bp, Neisseria meningitidis
ctgaaagaatgccgtctgaaagaccctgtttttattccaaatatcgtttataagaacatcgccattactttcctgctcttgcacgccgccgccgaactttggctgcccgcgcaaaccgccggttttaccgcgctcgccgtcggcttcatcctgctcgccaagctgcgtgagcttcaccatcacgaactcttacgtaaacactacgtccgcacttattacytgctccaactctttgccgccgcaggctagtttgtggacaggcgcggcgwaattacaaaacctgcccgcytccgcgcccctgcacctgattaccctcggcggcatgatgggcggcgtgatgatggtgtggctgaccgccggactgtggcacagcggctttaccaaactcgactaccccaaactctgccgcattgccgtccccatccttttcgccgccgccgtctcgcgcgctttcttgrtgaacgtgaacccgrtatttttcattaccgttcctgcgattctgaccgccgccgtattcgtactgtatcttttcrcgtttataccgatatttcgggcgaatgcgtttacagacgatccggartar

SEQ ID NO: 846 - protein, 193 aa, Neisseria meningitidis
  misc_feature (90)..(90): Xaa= any amino acid
  misc_feature (153)..(153): Xaa= any amino acid
  misc_feature (158)..(158): Xaa= any amino acid
  misc_feature (178)..(178): Xaa= any amino acid
LKECRLKDPVFIPNIVYKNIAITFLLLHAAAELWLPAQTAGFTALAVGFILLAKLRELHHHELLRKHYVRTYYLLQLFAAAGSLWTGAAXLQNLPASAPLHLITLGGMMGGVMMVWLTAGLWHSGFTKLDYPKLCRIAVPILFAAAVSRAFLXNVNPXFFITVPAILTAAVFVLYLFXFIPIFRANAFTDDPE

SEQ ID NO: 847 - DNA, 1074 bp, Neisseria meningitidis
atgcggccgtttttcgtcggcgcggcggtgcttgccatactcggtgcgctggtgtttttcatcaaccccggtgccatcgtcctgcaccgccaaattttcttggaacttatgctgccggcggcatacggcggttttttgactgcggctttgttggactggacgggtttttcgggtaacctgaaacctgtcgcgactttgatggcggcattattgctcgccgcatccgctatactgcccttttcgccgcaaactgcctcgtttttcgtcgccgcctattggctggtgttgctgctgttctgcgcccggctgatttggctagaccgaaacaccgacaacttcgccctgctaatgttacttgccgcgttcactgtttttcagacggcatatgccgtcagcggcgatttgaacctgttgcgcgcgcaagtgcatctaaatatggcggcggtgatgttcgtatccgtgcgcgtcagtattcttttgggcgcggaagccctgaaagaatgccgtctgaaagaccctgtttttattccaaatatcgtttataaaaacatcgccattactttcctgctcttgcacgccgccgccgaactttggctgcccgcgcaaaccgccggttttaccgcgctcgccgtcggcttcatcctgctcgccaagctgcgtgagcttcaccatcacgaactcttacgtaaacactacgtccgcacttattacctgctccaactctttgccgccgcaggctatttgtggacaggcgcggcgaaattacaaaacctgcccgcctccgcgcccctgcacctgattaccctcggcggcatgatgggcggcgtgatgatggtgtggctgaccgccggactgtggcacagcggctttaccaaactcgactaccccaaactctgccgcattgccgtccccatccttttcgccgccgccgtctcgcgcgctttcttgatgaacgtgaacccgatatttttcattaccgttcctgcgattctgaccgccgccgtattcgtactgtatcttttcacgtttataccgatatttcgggcgaatgcgtttacagacgatccggaataa

SEQ ID NO: 848 - protein, 357 aa, Neisseria meningitidis
MRPFFVGAAVLAILGALVFFINPGAIVLHRQIFLELMLPAAYGGFLTAALLDWTGFSGNLKPVATLMAALLLAASAILPFSPQTASFFVAAYWLVLLLFCARLIWLDRNTDNFALLMLLAAFTVFQTAYAVSGDLNLLRAQVHLNMAAVMFVSVRVSILLGAEALKECRLKDPVFIPNIVYKNIAITFLLLHAAAELWLPAQTAGFTALAVGFILLAKLRELHHHELLRKHYVRTYYLLQLFAAAGYLWTGAAKLQNLPASAPLHLITLGGMMGGVMMVWLTAGLWHSGFTKLDYPKLCRIAVPILFAAAVSRAFLMNVNPIFFITVPAILTAAVFVLYLFTFIPIFRANAFTDDPE

SEQ ID NO: 849 - DNA, 1074 bp, Neisseria meningitidis
  misc_feature (918)..(918): N= Unknown
atgcggccgtttttcgtcggcgcggcggtgcttgccatactcggtgcgctggtgtttttcatcaaccccggtgccatcgtcctgcaccgccaaattttcttggaacttatgctgccggcggcatacggcggttttttgactgcggctttgttggactggacgggtttttcgggtaacctgaaacctgtcgcgactttgatggcggcattattgctcgccgcatccgctatactgcccttttcgccgcaaactgcctcgtttttcgtcgccgcctattggctggtgttgctgctgttctgcgcccggctgatttggctagaccgaaacaccgacaacttcgccctgctaatgttacttgccgcgttcactgtttttcagacggcatatgccgtcagcggcgatttgaacctgttgcgcgcgcaagtgcatctaaatatggcggcggtgatgttcgtatccgtgcgcgtcagtattcttttgggcgcggaagccctgaaagaatgccgtctgaaagacccagtattcatccccaatgtcgtctataaaaacatcgccattaccttcctgctcctgcacgccgccgccgaactttggctgcctgcgcaaaccgccggttttacctcgctcgccgtcggctttatcctgcttgccaagctgcgtgagcttcaccatcacgaactcctgcgcaaacactacgtccgcacttattacctgctccaactctttgccgccgcaggctatttgtggacaggcgcggcgaaattacaaaacctgcccgcctccgcgcccctgcacctgattaccctcggtggcatgatgggcagcgtgatgatggtgtggctgactgccggactgtggcacagcggctttaccaagctcgactacccgaaactctgccgcatcgccgtccccatcctnttcgccgccgccgtttcgcgcgctgttttaatgaacgtaaacccgatattcttcatcaccgtccccgcaattctgaccgccgccgtgttcgtgctttacctgctgacattcgtaccgatctttcgggcgaacgcgtttacagacgatccggaataa

SEQ ID NO: 850 - protein, 357 aa, Neisseria meningitidis
MRPFFVGAAVLAILGALVFFINPGAIVLHRQIFLELMLPAAYGGFLTAALLDWTGFSGNLKPVATLMAALLLAASAILPFSPQTASFFVAAYWLVLLLFCARLIWLDRNTDNFALLMLLAAFTVFQTAYAVSGDLNLLRAQVHLNMAAVMFVSVRVSILLGAEALKECRLKDPVFIPNVVYKNIAITFLLLHAAAELWLPAQTAGFTSLAVGFILLAKLRELHHHELLRKHYVRTYYLLQLFAAAGYLWTGAAKLQNLPASAPLHLITLGGMMGSVMMVWLTAGLWHSGFTKLDYPKLCRIAVPILFAAAVSRAVLMNVNPIFFITVPAILTAAVFVLYLLTFVPIFRANAFTDDPE

SEQ ID NO: 851 - DNA, 8 bp, Neisseria gonorrhoeae
  misc_feature (1)..(8): N = Unknown
nnnnnnnn

SEQ ID NO: 852 - protein, 364 aa, Neisseria gonorrhoeae
MNKFFTHPMRPFFVGAAVLAILGALVFFHQPRRYHPAPPNFLGTYAAGCIRRFFDYRFVGPDGFFRQPETCRYFDGGVVACCGCFIAVFTATCRIFRRRLLAGVAAVLRLADLARRQHRTLRSVDVTAAFTVFQTAYAVSGDLNLLRAQVHLNMAAVMFVSVRVSVLLGTETLKECRLKDPVFIPNVIYKNIAITLLLHAAAELWLPAQTAGFTALAVGFILLAKLRELHHHELLRKHYVRTYYLLQLFAAAGYLWTGAAKLQNLPASAPLHLITLGGMTGGVMMVWLTAGLWHSGFTKLDYPKLCRIAVSILFASAVSRAVLMNVNPIFFITVPEILTAAVFMLYLLTFVPIFRANAFTDDPE

SEQ ID NO: 853 - DNA, 1071 bp, Neisseria gonorrhoeae
atgcgcccgtttttcgtcggtgcggcagtacttgccatactcggtgcgttggtgttttttatcaaccccggcgctatcatcctgcaccgccaaattttcttggaacttatgctgccggctgcatacggcggttttttgactaccgctttgttggaccggacgggtttttcaggcaacctgaaacctgccgctactttgatggcggtgttgttgcttgttgcggctgttttattgccgtttttaccgcaacttgccgcatttttcgtcgccgcctattggctggtgttgctgctgttctgcgcctggctgatttggctcgaccgcaacaccgacaacttcgctctgttgatgttacttgccgcatttaccgtttttcagacggcctatgccgtcagcggcgatttgaacttactgcgcgcgcaagtgcatttgaatatggcggcggtcatgttcgtatccgtccgcgtcagcgtccttttgggcacggaaaccctgaaagaatgccgtctgaaagaccccgtattcatccccaacgttatctataaaaacatcgccatcaccctgctgctgcacgccgccgccgaactttggctgcccgcgcaaaccgccggttttactgcgcttgccgtcggcttcatcctgctcgccaagctgcgcgaactgcaccatcacgaactcttacgcaaacactacgtccgcacttattacctgctccagctctttgccgccgcaggttatctgtggacaggcgcggcgaaactgcaaaacctgcccgcctccgcgcccctgcacctgattaccctcggcggcatgacgggtggcgtgatgatggtgtggctgactgccggactgtggcacagcggctttaccaaactcgactacccgaaactctgccgcatcgccgtctccatccttttcgcctccgccgtttcgcgcgctgttttaatgaacgtgaatccgatattcttcatcaccgttcccgagattctgaccgccgccgtgttcatgctttacctgctgacgttcgtaccgatttttcgagcgaacgcgtttacagacgatccggaataa

SEQ ID NO: 854 - protein, 356 aa, Neisseria gonorrhoeae
MRPFFVGAAVLAILGALVFFINPGAIILHRQIFLELMLPAAYGGFLTTALLDRTGFSGNLKPAATLMAVLLLVAAVLLPFLPQLAAFFVAAYWLVLLLFCAWLIWLDRNTDNFALLMLLAAFTVFQTAYAVSGDLNLLRAQVHLNMAAVMFVSVRVSVLLGTETLKECRLKDPVFIPNVIYKNIAITLLLHAAAELWLPAQTAGFTALAVGFILLAKLRELHHHELLRKHYVRTYYLLQLFAAAGYLWTGAAKLQNLPASAPLHLITLGGMTGGVMMVWLTAGLWHSGFTKLDYPKLCRIAVSILFASAVSRAVLMNVNPIFFITVPEILTAAVFMLYLLTFVPIFRANAFTDDPE

SEQ ID NO: 855 - DNA, 362 bp, Neisseria meningitidis
atggaaattcgggcaataaaatatacggcaatggctgcgttgcttgcatttacggttgcaggctgccggctggcggggtggtatgagtgttcgtccctcaccggctggtgtaagccgagaaaaccggctgccatcgatttttgggatattggcggcgagagtccgccgtctttaggggactacgagataccgctttcagacggcaatagttccgtcagggcaaacgaatatgaatccgcacaacaatcttacttttacaggaaaatagggaagtttgaagctgcgggctggattggcgtacgcgtgacggcaaacctttgattgagacgttcaaacagggaggatttgactgcttggaaaag

SEQ ID NO: 856 - protein, 121 aa, Neisseria meningitidis
  misc_feature (94)..(94): Xaa= any amino acid
MEIRAIKYTAMAALLAFTVAGCRLAGWYECSSLTGWCKPRKPAAIDFWDIGGESPPSLGDYEIPLSDGNSSVRANEYESAQQSYFYRKIGKFEXCGLDWRTRDGKPLIETFKQGGFDCLEK

SEQ ID NO: 857 - DNA, 408 bp, Neisseria meningitidis
atggaaattcgggcaataaaatatacggcaatggctgcgttgcttgcatttacggttgcaggctgccggctggcggggtggtatgagtgttcgtccctcaccggctggtgtaagccgagaaaaccggctgccatcgatttttgggatattggcggcgagagtccgccgtctttaggggactacgagataccgctttcagacggcaatcgttccgtcagggcaaacgaatatgaatccgcacaacaatcttacttttacaggaaaatagggaagtttgaagcctgcgggctggattggcgtacgcgtgacggcaaacctttgattgagacgttcaaacagggaggatttgactgcttggaaaagcaggggttgcggcgcaacggtctgtccgagcgcgtccgatggtaa

SEQ ID NO: 858 - protein, 135 aa, Neisseria meningitidis
MEIRAIKYTAMAALLAFTVAGCRLAGWYECSSLTGWCKPRKPAAIDFWDIGGESPPSLGDYEIPLSDGNRSVRANEYESAQQSYFYRKIGKFEACGLDWRTRDGKPLIETFKQGGFDCLEKQGLRRNGLSERVRW

SEQ ID NO: 859 - DNA, 408 bp, Neisseria meningitidis
atggaaattcgggcaataaaatatacggcaatggctgcgttgcttgcatttacggttgcaggctgccggttggcaggttggtatgagtgttcgtccctgtccggctggtgtaagccgagaaaacctgccgccatcgatttttgggatattggcggcgagagtcctccgtctttagaggactacgagataccgctttcagacggcaatcgttccgtcagggcaaacgaatatgaatccgcacaacaatcttacttttacaggaaaatagggaagtttgaagcctgcgggttggattggcgtacgcgtgacggcaaacctttgattgagacgttcaaacaggaaggttttgattgtttgaaaaagcaggggttgcggcgcaacggtctgtccgagcgcgtccgatggtaa

SEQ ID NO: 860 - protein, 135 aa, Neisseria meningitidis
MEIRAIKYTAMAALLAFTVAGCRLAGWYECSSLSGWCKPRKPAAIDFWDIGGESPPSLEDYEIPLSDGNRSVRANEYESAQQSYFYRKIGKFEACGLDWRTRDGKPLIETFKQEGFDCLKKQGLRRNGLSERVRW

SEQ ID NO: 861 - DNA, 8 bp, Neisseria gonorrhoeae
  misc_feature (1)..(8): N = Unknown
nnnnnnnn

SEQ ID NO: 862 - protein, 135 aa, Neisseria gonorrhoeae
MEIRVIKYTATAALFAFTVAGCRLAGWYECLSLSGWCKPRKPAAIDFWDIGGESPLSLEDYEIPLSDGNRSVRANEYESAQKSYFYRKIGKFEACGLDWRTRDGKPLVERFKQEGFDCLEKQGLRRNGLSERVRW

SEQ ID NO: 863 - DNA, 408 bp, Neisseria gonorrhoeae
atggaaattcgggtaataaaatatacggcaacggctgcgttgtttgcatttacggttgcaggctgccggctggcggggtggtatgagtgttcgtccttgtccggctggtgtaagccgagaaaacctgccgccatcgatttttgggatattggcggcgagagtccgctgtctttagaggactacgagataccgctttcagacggcaatcgttccgtcagggcaaacgaatatgaatccgcgcaaaaatcttacttttataggaaaatagggaagtttgaagcctgcgggttggattggcgtacgcgtgacggcaaacctttggttgagaggttcaaacaggaaggtttcgactgtttggaaaagcaggggttgcggcgcaacggcctgtccgagcgcgtccgatggtaa

SEQ ID NO: 864 - protein, 135 aa, Neisseria gonorrhoeae
MEIRVIKYTATAALFAFTVAGCRLAGWYECSSLSGWCKPRKPAAIDFWDIGGESPLSLEDYEIPLSDGNRSVRANEYESAQKSYFYRKIGKFEACGLDWRTRDGKPLVERFKQEGFDCLEKQGLRRNGLSERVRW

SEQ ID NO: 865 - DNA, 776 bp, Neisseria meningitidis
atgaaacacatccatattatcggtatcggcggcacgtttatgggcgggcttgccgccattgccaaagaagcggggtttgaagtcagcggttgcgacgcgaagatgtatccgccgatgagcacccagctcgaagccttgggtatagacgtgtatgaaggcttcgatgccgctcagttggacgaatttaaagccgacgtttacgttatcggcaatgtcgccaagcgcgggatggatgtggttgaagcgattttgaacctcggcctgccttatatttccggcccgcaatggctgtcggaaaacgtgctgcaccatcattgggtactcggtgtggcggggacgcacggcaaaacgaccaccgcctccatgctcgcatgggtcttggaatatgccggcctcgcgccgggcttccttattggcggcgtaccggaaaatttcggcgtttccgcccgcctgccgcaaacgccgcgccaagacccgaacagccaatcgccgtttttcgtcatcgaagccgacgaatacgacaccgcctttttcgacaaacgttctaaattcgtgcattaccgtccgcgtaccgccgtgttgaacaatctggaattcgaccacgccgacatctttgccgacttgggcgcgatacagacccagttccactacctcgtgcgtaccgtgccgtctgaaggcttaatcgtctgcaacggacggcagcaaagcctgcaagatactttggacaaaggctgctggacgccggtggaaaaattcggcacggaacacggctggca

SEQ ID NO: 866 - protein, 259 aa, Neisseria meningitidis
  misc_feature (142)..(142): Xaa= any amino acid
  misc_feature (183)..(183): Xaa= any amino acid
  misc_feature (225)..(225): Xaa= any amino acid
MKHIHIIGIGGTFMGGLAAIAKEAGFEVSGCDAKMYPPMSTQLEALGIDVYEGFDAAQLDEFKADVYVIGNVAKRGMDVVEAILNLGLPYISGPQWLSENVLHHHWVLGVAGTHGKTTTASMLAWVLEYAGLAPGFLIGGVXGKFRRFRPPAANAAPRPEQPIAVFRHRSRRIRHRLFRQTFXIRALPSAYRRVEQSGIRPRRHLCRLGRDTDPVPLPRAYRAVXRLNRLQRTAAKPARYFGQRLLDAGGKIRHGTRLA

SEQ ID NO: 867 - DNA, 1377 bp, Neisseria meningitidis
atgaaacacatccatattatcggtatcggcggcacgtttatgggcgggcttgccgccattgccaaagaagcggggtttgaagtcagcggttgcgacgcgaagatgtatccgccgatgagcacccagctcgaagccttgggtatagacgtgtatgaaggcttcgatgccgctcagttggacgaatttaaagccgacgtttacgttatcggcaatgtcgccaagcgcgggatggatgtggttgaagcgattttgaacctcggcctgccttatatttccggcccgcaatggctgtcggaaaacgtgctgcaccatcattgggtactcggtgtggcggggacgcacggcaaaacgaccaccgcctccatgctcgcatgggtcttggaatatgccggcctcgcgccgggcttccttattggcggcgtaccggaaaatttcggcgtttccgcccgcctgccgcaaacgccgcgccaagacccgaacagccaatcgccgtttttcgtcatcgaagccgacgaatacgacaccgcctttttcgacaaacgttctaaattcgtgcattaccgtccgcgtaccgccgtgttgaacaatctggaattcgaccacgccgacatctttgccgacttgggcgcgatacagacccagttccactacctcgtgcgtaccgtgccgtctgaaggcttaatcgtctgcaacggacggcagcaaagcctgcaagatactttggacaaaggctgctggacgccggtggaaaaattcggcacggaacacggctggcaggccggcgaagccaatgccgacggctcgttcgacgtgttgctcgacggcaaaaccgccggacgcgtcaaatgggatttgatgggcaggcacaaccgcatgaacgcgctcgccgtcattgccgccgcgcgtcatgtcggtgtcgatattcagaccgcctgcgaagccttgggcgcgtttaaaaacgtcaaacgccggatggaaatcaaaggcacggcaaacggcatcaccgtttacgacgacttcgcccaccacccgaccgccatcgaaaccacgattcaaggtttgcgccaacgcgtcggcggcgcgcgcatcctcgccgtcctcgaaccgcgttccaacacgatgaagctgggcacgatgaagtccgccctgcctgtaagcctcaaagaagccgaccaagtgttctgctacgccggcggcgtggactgggacgtcgccgaagccctcgcgcctttgggcggcaggctgaacgtcggcaaagacttcgatgccttcgttgccgaaatcgtgaaaaacgccgaagtaggcgaccatattttggtgatgagcaacggcggtttcggcggaatacacggaaagctgctggaagctttgagatag

SEQ ID NO: 868 - protein, 458 aa, Neisseria meningitidis
MKHIHIIGIGGTFMGGLAAIAKEAGFEVSGCDAKMYPPMSTQLEALGIDVYEGFDAAQLDEFKADVYVIGNVAKRGMDVVEAILNLGLPYISGPQWLSENVLHHHWVLGVAGTHGKTTTASMLAWVLEYAGLAPGFLIGGVPENFGVSARLPQTPRQDPNSQSPFFVIEADEYDTAFFDKRSKFVHYRPRTAVLNNLEFDHADIFADLGAIQTQFHYLVRTVPSEGLIVCNGRQQSLQDTLDKGCWTPVEKFGTEHGWQAGEANADGSFDVLLDGKTAGRVKWDLMGRHNRMNALAVIAAARHVGVDIQTACEALGAFKNVKRRMEIKGTANGITVYDDFAHHPTAIETTIQGLRQRVGGARILAVLEPRSNTMKLGTMKSALPVSLKEADQVFCYAGGVDWDVAEALAPLGGRLNVGKDFDAFVAEIVKNAEVGDHILVMSNGGFGGIHGKLLEALR

SEQ ID NO: 869 - DNA, 1377 bp, Neisseria meningitidis
  misc_feature (82)..(82): N= Unknown
  misc_feature (301)..(301): N= Unknown
  misc_feature (319)..(320): N= Unknown
  misc_feature (335)..(335): N= Unknown
  misc_feature (409)..(409): N= Unknown
  misc_feature (888)..(888): N= Unknown
  misc_feature (918)..(918): N= Unknown
  misc_feature (1185)..(1185): N= Unknown
atgaaacacatccacattatcggtatcggcggcacgtttatgggtgggattgccgccattgccaaagaagcagggtttgaantcagcggttgcgatgcgaagatgtatccgccgatgagcacccagctcgaagccttgggcataggcgtgtatgaaggcttcgacaccgcgcagttggacgaatttaaagccgacgtttacgttatcggcaatgtcgccaagcgcgggatggatgtggttgaagcgattttgaaccgtgggctgccttatatttccggcccgcaatggctggctgaaaacntgctgcaccatcattggnnactcggcgtggcggngacgcacggcaaaacgaccaccgcgtctatgctcgcgtgggttttggaatatgccggactcgcaccgggcttcnttatcggcggcgtaccggaaaacttcagcgtttccgcccgcctgccgcaaacgccgcgccaagacccgaacagccaatcgccgtttttcgtcattgaagccgacgaatacgacaccgcgtttttcgacaaacgctccaaattcgtgcattaccgtccgcgtaccgccgtgttgaacaatctggaattcgaccacgccgacatcttcgccgatttgggcgcgatacagacccagttccaccacctcgtgcgtaccgtgccgtctgaaggcctcatcgtctgcaacggacggcagcaaagcctgcaagacactttggacaaaggctgctggacgccggtggaaaaattcggcacggaacacggctggcaggccggcgaagccaatgccgatggctcgttcgacgtgttgcttgacggcaaaaaagccggacacgtcgcttggagtttgatgggcggacacaaccgcatgaacgcgctcgcngtcatcgccgccgcgcgtcatgccggagtngacattcagacggcctgcgaagccttgagcacgtttaaaaacgtcaaacgccgcatggaaatcaaaggcacggcaaacggtatcaccgtttacgacgacttcgcccaccatccgaccgctatcgaaaccacgattcaaggtttgcgccagcgcgtcggcggcgcgcgcatcctcgccgtcctcgaaccgcgttccaatacgatgaagctgggtacgatgaaagccgccctgcccgcaagcctcaaagaagccgaccaagtgttctgntacgccggcggcgcggactgggacgttgccgaagccctcgcgcctttgggcggcaggctgcacgtcggcaaagacttcgatgccttcgttgccgaaatcgtgaaaaacgccgaagcaggcgaccatattttggtgatgagcaacggcggtttcggcggaatacacaccaaactgctggacgctttgagatag

SEQ ID NO: 870 - protein, 458 aa, Neisseria meningitidis
  misc_feature (28)..(28): Xaa= any amino acid
  misc_feature (101)..(101): Xaa= any amino acid
  misc_feature (107)..(107): Xaa= any amino acid
  misc_feature (112)..(112): Xaa= any amino acid
  misc_feature (137)..(137): Xaa= any amino acid
  misc_feature (395)..(395): Xaa= any amino acid
MKHIHIIGIGGTFMGGIAAIAKEAGFEXSGCDAKMYPPMSTQLEALGIGVYEGFDTAQLDEFKADVYVIGNVAKRGMDVVEAILNRGLPYISGPQWLAENXLHHHWXLGVAXTHGKTTTASMLAWVLEYAGLAPGFXIGGVPENFSVSARLPQTPRQDPNSQSPFFVIEADEYDTAFFDKRSKFVHYRPRTAVLNNLEFDHADIFADLGAIQTQFHHLVRTVPSEGLIVCNGRQQSLQDTLDKGCWTPVEKFGTEHGWQAGEANADGSFDVLLDGKKAGHVAWSLMGGHNRMNALAVIAAARHAGVDIQTACEALSTFKNVKRRMEIKGTANGITVYDDFAHHPTAIETTIQGLRQRVGGARILAVLEPRSNTMKLGTMKAALPASLKEADQVFXYAGGADWDVAEALAPLGGRLHVGKDFDAFVAEIVKNAEAGDHILVMSNGGFGGIHTKLLDALR

SEQ ID NO: 871 - DNA, 8 bp, Neisseria gonorrhoeae
  misc_feature (1)..(8): N = Unknown
nnnnnnnn

SEQ ID NO: 872 - protein, 261 aa, Neisseria gonorrhoeae
MKHIHIIGIGGTFMGGIAAIAKEAGFKVSGCDAKMYPPMSTQLEALGIGVHEGFDAAQLEEFQADIYVIGNVARRGMDVVEAILNRGLPYISGPQWLAENVLHHHWVLGVAGTHGKTTTASMLAWVLEYAGLAPGFLIGGVPGKFRRFRPPTANAASRPEQQIAVFRHRSRRIRHRLFRQTLQIRALSPAYRRVEQSGIRPRRHLRRLGRDTDPVPPPRAHRTIRRPHRLQRTAAKPARYFGQRLLDAGGKIRHRTRLADW

SEQ ID NO: 873 - DNA, 1377 bp, Neisseria gonorrhoeae
atgaaacacatccacattatcggtatcggcggcacgtttatgggcgggattgccgccattgccaaagaagccgggttcaaagtcagcggttgcgacgcgaagatgtatccgccgatgagcacccagctcgaagccttgggcataggcgtacacgaaggcttcgatgccgcgcagttggaagaatttcaagccgatatttacgtcatcggcaatgtcgccaggcgcgggatggatgtggtcgaggcgattttgaaccgtgggctgccttatatttccggcccgcaatggctggctgaaaacgtgctgcaccatcattgggtactcggcgtggcagggacgcacggcaaaacgaccaccgcgtccatgctcgcctgggtcttggaatatgccggactcgcgccgggcttcctcatcggcggtgtaccggaaaatttcggcgtttccgcccgcctaccgcaaacgccgcgtcaagacccgaacagcaaatcgccgtttttcgtcatcgaagccgacgaatacgacaccgcctttttcgacaaacgctccaaattcgtgcattatcgcccgcgtaccgccgtgttgaacaatctggaattcgaccacgccgacatcttcgccgacttgggcgcgatacagacccagttccaccacctcgtgcgcaccgtaccatccgaaggcctcatcgtctgcaacggacagcagcaaagcctgcaagatactttggacaaaggctgctggacgccggtggaaaaattcggcaccggacacggctggcagattggtgaagtcaatgccgacggctcgttcgacgtattgcttgacggcaaaaaagccggacacgtcgcatgggatttgatgggcggacacaaccgcatgaacgcgctcgccgtcatcgctgccgcacgccatgccggagtcgatgttcagacggcctgcgaagccttgggtgcgtttaaaaacgtcaaacgccgcatggaaatcaaaggcacggcaaacggcatcaccgtttacgacgatttcgcccaccacccgaccgccatcgaaaccacgattcaaggtttgcgccaacgtgtcggcggcgcgcgcatcctcgccgtcctcgagccgcgttccaacaccatgaaactcggcacgatgaagtccgccctgcccgcaagcctcaaagaagccgaccaagtgttctgctacgccggcggcgcggactgggacgttgccgaagccctcgcgcctttgggctgcaggctgcgcgtcggtaaagatttcgataccttcgttgccgaaattgtgaaaaacgcccgaaccggcgaccatattttggtgatgagcaacggcggtttcggcggaatacacaccaaactgctggacgctttgagatag

SEQ ID NO: 874 - protein, 458 aa, Neisseria gonorrhoeae
MKHIHIIGIGGTFMGGIAAIAKEAGFKVSGCDAKMYPPMSTQLEALGIGVHEGFDAAQLEEFQADIYVIGNVARRGMDVVEAILNRGLPYISGPQWLAENVLHHHWVLGVAGTHGKTTTASMLAWVLEYAGLAPGFLIGGVPENFGVSARLPQTPRQDPNSKSPFFVIEADEYDTAFFDKRSKFVHYRPRTAVLNNLEFDHADIFADLGAIQTQFHHLVRTVPSEGLIVCNGQQQSLQDTLDKGCWTPVEKFGTGHGWQIGEVNADGSFDVLLDGKKAGHVAWDLMGGHNRMNALAVIAAARHAGVDVQTACEALGAFKNVKRRMEIKGTANGITVYDDFAHHPTAIETTIQGLRQRVGGARILAVLEPRSNTMKLGTMKSALPASLKEADQVFCYAGGADWDVAEALAPLGCRLRVGKDFDTFVAEIVKNARTGDHILVMSNGGFGGIHTKLLDALR

SEQ ID NO: 875 - DNA, 1181 bp, Neisseria meningitidis
  misc_feature (511)..(534): N= Unknown
ccgggctattacggctcggatgacgaatttaagcgggcattcggagaaaactcgccgacatmcaagaaacattgcaaccggagctgcgggatttatgaacccgtattgaaaaaatacggcaaaaagcgcgccaacaaccattcggtcagcattagtgcggacttcggcgattatttcatgccgttcgccagctattcgcgcacacaccgtatgcccaacatccaagaaatgtatttttcccaaatcggcgactccggcgttcacaccgccttaaaaccagagcgcgcaaacacttggcaatttggcttcratacctataaaaaaggattgttaaaacaagatgatacattaggattaaaactggtcggctaccgcagccgcatcgacaactacatccacaacgtttacgggaaatggtgggatttgaacggggatattccgagctgggtcagcagcaccgggcttgcctacaccatccaacatcgcratttcawagacaaagtgcatcaannnnnnnnnnnnnnnnnnnnnnnntacgattatgggcgttttttcaccaacctttcttacgcctatcaaaaaagcacgcaaccgaccaacttcagcgatgcgagcgaatcgcccaacaatgcgtccaaagaagaccaactcaaacaaggttatgggttgagcagggtttccgccctgccgcgagattacggacgtttggaagtcggtacgcgctggttgggcaacaaactgactttgggcggcgcgatgcgctatttcggcaagagcatccgcgcgacggctgaagaacgctatatcgacggcaccaacgggggaaataccagcaatttccggcaactgggcaagcgttccatcaaacaaaccgaaactcttgcccgccagcctttgattttwgattttaacgccgcttacgagccgaagaaaaaccttattttccgcgccgaagtcaaaaatctgttcgacaggcgttatatcgatccgctcgatgcgggcaatgatgcggcaacgagcgttattacagctcgttcgacccgaaagacaaggacrragacgtaacgtgtaatgctgataaaacgttgtgcaacggcaaatacggcggcacaagcaaaagcgtattgaccaattttgcacgcggacgcacctttttgatgacgatgagctacaagttttaa

SEQ ID NO: 876 - protein, 393 aa, Neisseria meningitidis
  misc_feature (21)..(21): Xaa= any amino acid
  misc_feature (104)..(104): Xaa= any amino acid
  misc_feature (163)..(163): Xaa= any amino acid
  misc_feature (165)..(165): Xaa= any amino acid
  misc_feature (171)..(178): Xaa= any amino acid
  misc_feature (301)..(301): Xaa= any amino acid
  misc_feature (339)..(339): Xaa= any amino acid
  misc_feature (353)..(353): Xaa= any amino acid
PGYYGSDDEFKRAFGENSPTXKKHCNRSCGIYEPVLKKYGKKRANNHSVSISADFGDYFMPFASYSRTHRMPNIQEMYFSQIGDSGVHTALKPERANTWQFGFXTYKKGLLKQDDTLGLKLVGYRSRIDNYIHNVYGKWWDLNGDIPSWVSSTGLAYTIQHRXFXDKVHQXXXXXXXXYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNFRQLGKRSIKQTETLARQPLIXDFNAAYEPKKNLIFRAEVKNLFDRRYIDPLDAGNDAAXERYYSSFDPKDKDXDVTCNADKTLCNGKYGGTSKSVLTNFARGRTFLMTMSYKF

SEQ ID NO: 877 - DNA, 2667 bp, Neisseria meningitidis
  misc_feature (835)..(835): N= Unknown
gaggcgcagatacaggttttggaagatgtgcacgtcaaggcgaagcgcgtaccgaaagacaaaaaagtgtttaccgatgcgcgtgccgtatcgacccgtcaggatatattcaaatccagcgaaaacctcgacaacatcgtacgcagcatccccggtgcgtttacacagcaagataaaagctcgggcattgtgtctttgaatattcgcggcgacagcgggttcgggcgggtcaatacgatggtggacggcatcacgcagaccttttattcgacttctaccgatgcgggcagggcaggcggttcatctcaattcggtgcatctgtcgacagcaattttattgccggactggatgtcgtcaaaggcagcttcagcggctcggcaggcatcaacagccttgccggttcggcgaatctgcggactttaggcgtggatgacgtcgttcagggcaataatacctacggcctgctgctaaaaggtctgaccggcaccaattcaaccaaaggtaatgcgatggcggcgataggtgcgcgcaaatggctggaaagcggagcatctgtcggtgtgctttacgggcacagcaggcgcagcgtggcgcaaaattaccgcgtgggcggcggcgggcagcacatcggaaattttggcgcggaatatttggaacggcgcaagcagcgatattttgtacaagagggtgctttgaaattcaattccgacagcggaaaatgggagcgggatttacaaaggcaacagtggaaatacaagccgtataaaaattacaacaaccaagaactacaaaaatacatcgaagagcatgacaaaagctggcgggaaaacctgncaccgcaatacgacattacccccatcgatccgtccagcctgaagcagcagtcggcaggcaatctgtttaaattggaatacgacggcgtattcaataaatacacggcgcaatttcgcgatttaaacaccaaaatcggcagccgcaaaatcatcaaccgcaattatcagttcaattacggtttgtctttgaacccgtataccaacctcaatctgaccgcagcctacaattcgggcaggcagaaatatccgaaagggtcgaagtttacaggctgggggcttttaaaggattttgaaacctacaacaacgcgaaaatcctcgacctcaacaacaccgccaccttccggctgccccgcgaaaccgagttgcaaaccactttgggcttcaattatttccacaacgaatacggcaaaaaccgctttcctgaagaattggggctgtttttcgacggtcctgatcaggacaacgggctttattcctatttggggcggtttaagggcgataaagggctgctgccccaaaaatcaaccattgtccaaccggccggcagccaatatttcaacacgttctacttcgatgccgcgctcaaaaaagacatttaccgcttaaactacagcaccaataccgtcggctaccgtttcggcggcgaatatacgggctattacggctcggatgacgaatttaagcgggcattcggagaaaactcgccgacatacaagaaacattgcaaccggagctgcgggatttatgaacccgtattgaaaaaatacggcaaaaagcgcgccaacaaccattcggtcagcattagtgcggacttcggcgattatttcatgccgttcgccagctattcgcgcacacaccgtatgcccaacatccaagaaatgtatttttcccaaatcggcgactccggcgttcacaccgccttaaaaccagagcgcgcaaacacttggcaatttggcttcaatacctataaaaaaggattgttaaaacaagatgatacattaggattaaaactggtcggctaccgcagccgcatcgacaactacatccacaacgtttacgggaaatggtgggatttgaacggggatattccgagctgggtcagcagcaccgggcttgcctacaccatccaacatcgcaatttcaaagacaaagtgcacaaacacggttttgagttggagctgaattacgattatgggcgttttttcaccaacctttcttacgcctatcaaaaaagcacgcaaccgaccaacttcagcgatgcgagcgaatcgcccaacaatgcgtccaaagaagaccaactcaaacaaggttatgggttgagcagggtttccgccctgccgcgagattacggacgtttggaagtcggtacgcgctggttgggcaacaaactgactttgggcggcgcgatgcgctatttcggcaagagcatccgcgcgacggctgaagaacgctatatcgacggcaccaacgggggaaataccagcaatttccggcaactgggcaagcgttccatcaaacaaaccgaaactcttgcccgccagcctttgatttttgatttttacgccgcttacgagccgaagaaaaaccttattttccgcgccgaagtcaaaaatctgttcgacaggcgttatatcgatccgctcgatgcgggcaatgatgcggcaacgcagcgttattacagctcgttcgacccgaaagacaaggacgaagacgtaacgtgtaatgctgataaaacgttgtgcaacggcaaatacggcggcacaagcaaaagcgtattgaccaattttgcacgcggacgcacctttttgatgacgatgagctacaagttttaa

SEQ ID NO: 878 - protein, 888 aa, Neisseria meningitidis
  misc_feature (279)..(279): Xaa= any amino acid
EAQIQVLEDVHVKAKRVPKDKKVFTDARAVSTRQDIFKSSENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRSVAQNYRVGGGGQHIGNFGAEYLERRKQRYFVQEGALKFNSDSGKWERDLQRQQWKYKPYKNYNNQELQKYIEEHDKSWRENLXPQYDITPIDPSSLKQQSAGNLFKLEYDGVFNKYTAQFRDLNTKIGSRKIINRNYQFNYGLSLNPYTNLNLTAAYNSGRQKYPKGSKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNTVGYRFGGEYTGYYGSDDEFKRAFGENSPTYKKHCNRSCGIYEPVLKKYGKKRANNHSVSISADFGDYFMPFASYSRTHRMPNIQEMYFSQIGDSGVHTALKPERANTWQFGFNTYKKGLLKQDDTLGLKLVGYRSRIDNYIHNVYGKWWDLNGDIPSWVSSTGLAYTIQHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNFRQLGKRSIKQTETLARQPLIFDFYAAYEPKKNLIFRAEVKNLFDRRYIDPLDAGNDAATQRYYSSFDPKDKDEDVTCNADKTLCNGKYGGTSKSVLTNFARGRTFLMTMSYKF

SEQ ID NO: 879 - protein, 2616 aa, Neisseria meningitidis
AAAGACAAAAAAGTGTTTACCGATGCGCGTGCCGTATCGACCCGTCAGGATATATTCAAATCCANCGAAAACCTCGACAACATCGTACGCANCATCCCCGGTGCGTTTACACANCAANATAAAAGCTCGGGCNTTGTGTCTTTGAATATTCGCNGCGACAGCGGGTTCGGGCGGGTCAATACNATGGTNGACGGCATCACNCANACCTTTTATTCGACTTCTACCGATGCGGGCAGGGCAGGCGGTTCATCTCAATTCGGTGCATCTGTCGACAGCAATTTTATNGCCGGACTGGATGTCGTCAAAGGCAGCTTCAGCGGCTCGGCAGGCATCAACAGCCTTGCCGGTTCGGCGAATCTGCGGACTTTANGCGTGGATGATGTCGTTCAGGGCAATANTACNTACGGCCTGCTGCTAAAAGGTCTGACCGGCACCAATTCAACCAAAGGTAATGCGATGGCGGCGATAGGTGCGCGCAAATGGCTGGAAAGCGGAGCATCTGTCGGTGTGCTTTACGGGCACAGCAGGCGCAGCGTGGCGCAAAATTACCGCGTGGGCGGCGGCGGGCAGCACATCGGAAATTTTGGCGCGGAATATCTGGAACGACGCAAGCAACGATATTTTGAGCAAGAAGGCGGGTTGAAATTCAATTCCAACAGCGGAAAATGGGAGCGGGATTTCCAAAAGTCGTACTGGAAAACCAAGTGGTATCAAAAATACGATGCCCCCCAAGAACTGCAAAAATACATCGAAGGTCATGATAAAAGCTGGCGGGAAAACCTGGCGCCGCAATACGACATCACCCCCATCGATCCGTCCAGCCTGAAGCNGCAGTCGGCAGGCAACCTGTTTAAATTGGAATACGACGGCGTATTCAATAAATACACGGCGCAATTTCGCGATTTAAACACCAAAATCGGCAGCCGCAAAATCATCAACCGCAATTATCAATTCAATTACGGTTTGTCTTTGAACCCGTATACCAACCTCAATCTGACCGCAGCCTACAATTCGGGCAGGCAGAAATATCCGAAAGGGTCGAAGTTTACAGGCTGGGGGCTTTTNAAAGATTTTGAAACCTACAACAACGCAAAAATCCTCGACCTCANCAACACCTCCACCTTCCGGCTGCCCCGTGAAACCGAGTTGCAAACCACTTTGGGCTTCAATTATTTCCACAACGAATACGGCAAAAACCGCTTTCCTGAAGAATTGGGGCTGTTTTTCGACGGTCCGGATCANGACAACGGGCTTTATTCCTATTTGGGGCGGTTTAAGGGCGATAAAGGGCTGCTGCCCCAAAAATCAACCATTGTCCAACCGGCCGGCAGCCAATATTTCAACACGTTCTACTTCGATGCCGCGCTCAAAAAAGACATTTACCGCTTAAACTACAGCACCAATACCGTCGGCTACCGTTTCGGCGGCNAATATACGGGCTATTACNGCTCGGATGACGAATTTAAGCGGGCATTCGGAGAAAACTCGCCGACATACANGAAACATTGCAACCAGAGCTGCGGAATTTATGAACCCGTATTGAAAAAATACGGCAAAAAGCGCGCCAACAACCATTCGGTCAGCATTAGTGCGGACTTCGGCGATTATTTCATGCCGTTCGCCAGCTATTCGCGCACACACCGTATGCCCAACATCCAAGAAATGTATTTTTCCCAAATCGGCGACTCCGGCGTTCACACCGCCTTAAAACCAGAGCGCGCAAACACTTGGCAATTTGGCTTCAATACCTATAAAAAAGGATTGTTAAAACAAGATGATATATTAGGATTAAAACTGGTCGGCTACCGCAGCCGCATCGACNACTACATCCACAACGTTTACGGGAAATGGTGGGATTTGAACGGGAATATTCCGAGCTGGGTCAGCAGCACCGGGCTTGCCTACACCATCCAACACCGCAATTTCAAAGACAAAGTGCACAAACACGGTTTTGAGTTGGAGCTGAATTACGATTATNGGCGTTTTTTCACCAACCTTTCTTACGCCTATCAAAAAAGCACGCAACCGACCAACTTCAGCGATGCGAGCGAATCGCCCAACAATGCGTCCAAAGAAGACCAACTCAAACAAGGTTATGGGTTGAGCAGGGTTTCCGCCCTGCCGCGAGATTACGGACGTTTGGAAGTCGGTACGCGCTGGTTGGGCAACAAACTGACTTTGGGCGGCGCGATGCGCTATTTCGGCAAGAGCATCCGCGCGACGGCTGAAGAACGCTATATCGACGNCACCAATGGGGNANNTACCAGCAATTTCCGGCAACTGGGCAAGCGTTCCATCANACAAACCGAAACCCTTGCCCGCCAGCCTTTGATTTTTGATTTNTACGCCGCTTACGAGCCGAAGAAAAANCTTATTTTCCGCGCCGAAGTCAAAAATCTGTTCGACAGGCGTTATATCGATCCGCTCGATGCGGGCAATGATGCGGCAACGCAGCGTTATTACAGTTCGTTCGACCCGAAAGACAAGGACGAAGAAGTAACGTGTAATGATGATAACACGTTATGCAACGGCAAATACGGCGGCACAAGCAAAAGCGTATTGACCAATTTTGCACGCGGACNCACCTTTTTGATAACGATGAGCTACAAGTTTTAA

SEQ ID NO: 880 - protein, 871 aa, Neisseria meningitidis
  misc_feature (22)..(22): Xaa= any amino acid
  misc_feature (31)..(31): Xaa= any amino acid
  misc_feature (38)..(38): Xaa= any amino acid
  misc_feature (40)..(40): Xaa= any amino acid
  misc_feature (45)..(45): Xaa= any amino acid
  misc_feature (52)..(52): Xaa= any amino acid
  misc_feature (68)..(68): Xaa= any amino acid
  misc_feature (95)..(95): Xaa= any amino acid
  misc_feature (124)..(124): Xaa= any amino acid
  misc_feature (133)..(133): Xaa= any amino acid
  misc_feature (277)..(277): Xaa= any amino acid
  misc_feature (355)..(355): Xaa= any amino acid
  misc_feature (370)..(370): Xaa= any amino acid
  misc_feature (414)..(414): Xaa= any amino acid
  misc_feature (477)..(477): Xaa= any amino acid
  misc_feature (483)..(483): Xaa= any amino acid
  misc_feature (500)..(500): Xaa= any amino acid
  misc_feature (608)..(608): Xaa= any amino acid
  misc_feature (660)..(660): Xaa= any amino acid
  misc_feature (749)..(749): Xaa= any amino acid
  misc_feature (753)..(754): Xaa= any amino acid
  misc_feature (767)..(767): Xaa= any amino acid
  misc_feature (781)..(781): Xaa= any amino acid
  misc_feature (790)..(790): Xaa= any amino acid
  misc_feature (861)..(861): Xaa= any amino acid
KDKKVFTDARAVSTRQDIFKSXENLDNIVRXIPGAFTXQXKSSGXVSLNIRXDSGFGRVNTMVDGITXTFYSTSTDAGRAGGSSQFGASVDSNFXAGLDVVKGSFSGSAGINSLAGSANLRTLXVDDVVQGNXTYGLLLKGLTGTNSTKGNAMAAIGARKWLESGASVGVLYGHSRRSVAQNYRVGGGGQHIGNFGAEYLERRKQRYFEQEGGLKFNSNSGKWERDFQKSYWKTKWYQKYDAPQELQKYIEGHDKSWRENLAPQYDITPIDPSSLKXQSAGNLFKLEYDGVFNKYTAQFRDLNTKIGSRKIINRNYQFNYGLSLNPYTNLNLTAAYNSGRQKYPKGSKFTGWGLXKDFETYNNAKILDLXNTSTFRLPRETELQTTLGFNYFHNEYGKNRFPEELGLFFDGPDXDNGLYSYLGRFKGDKGLLPQKSTIVQPAGSQYFNTFYFDAALKKDIYRLNYSTNTVGYRFGGXYTGYYXSDDEFKRAFGENSPTYXKHCNQSCGIYEPVLKKYGKKRANNHSVSISADFGDYFMPFASYSRTHRMPNIQEMYFSQIGDSGVHTALKPERANTWQFGFNTYKKGLLKQDDILGLKLVGYRSRIDXYIHNVYGKWWDLNGNIPSWVSSTGLAYTIQHRNFKDKVHKHGFELELNYDYXRFFTNLSYAYQKSTQPTNFSDASESPNNASKEDQLKQGYGLSRVSALPRDYGRLEVGTRWLGNKLTLGGAMRYFGKSIRATAEERYIDXTNGXXTSNFRQLGKRSIXQTETLARQPLIFDXYAAYEPKKXLIFRAEVKNLFDRRYIDPLDAGNDAATQRYYSSFDPKDKDEEVTCNDDNTLCNGKYGGTSKSVLTNFARGXTFLITMSYKF

SEQ ID NO: 881 - DNA, 8 bp, Neisseria gonorrhoeae
  misc_feature (1)..(8): N = Unknown
nnnnnnnn

SEQ ID NO: 882 - protein, 922 aa, Neisseria gonorrhoeae
MRSSFRLKPICFYLMGVMLYHHSYAEDAGRAGSEAQIQVLEDVHVKAKRVPKDKKVFTDARAVSTRQDVFKSGENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRGVAQNYRVGGGGQHIGNFGEEYLERRKQQYFVQEGGLKFNAGSGKWERDLQRQYWKTKWYKKYEDPQELQKYIEEHDKSWRENLAPQYDITPIDPSGLKQQSAGNLLNLEYDGVFNKYTAQFRDLNTRIGSRKIINRNYQFNYGLSLNPYTNLNLTAAYNSGRQKYPKGAKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNAINYRFGGEYTGYYGSENEFKRAFGENSPAYKEHCDPSCGLYEPVLKKYGKKRANNHSVSISADFGDYFMPFAGYSRTHRMPNIQEMYFSQIGDSGVHTALKPERANTWQFGFNTYKKGLLKQDDILGLKLVGYRSRIDNYIHNVYGKWWDLNGDIPSWVGSTGLAYTIRHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNVRQLGKRSIKQTETLARQPLIFDFYAAYEPKKNLIFRAEVKNLFDRRYIDPLDAGNDAATQRYYSSFDPKDKDEDVTCNADKTLCNGKYGGTSKSVLTNFARGRTFLMTMSYKF

SEQ ID NO: 883 - DNA, 2769 bp, Neisseria gonorrhoeae
atgagatcttctttccggttgaagccgatttgtttttatcttatgggtgttatgctatatcatcatagttatgccgaagatgcagggcgcgcgggcagcgaggcgcagatacaggttttggaagatgtgcacgtcaaggcgaagcgcgtaccgaaagacaaaaaagtgtttaccgatgcgcgtgccgtatcgacccgtcaggatgtgttcaaatccggcgaaaacctcgacaacatcgtacgcagcatacccggtgcgtttacacagcaagataaaagctcgggcattgtgtctttgaatattcgcggcgacagcgggttcgggcgggtcaatacgatggtggacggcatcacgcagaccttttattcgacttctaccgatgcgggcagggcaggcggttcatctcaattcggtgcatctgtcgacagcaattttattgccggactggatgtcgtcaaaggcagcttcagcggctcggcaggcatcaacagccttgccggttcggcgaatctgcggactttaggcgtggatgacgtcgttcagggcaataatacctacggcctgctgctaaaaggtctgaccggcaccaattcaaccaaaggtaatgcgatggcggcgataggtgcgcgcaaatggctggaaagcggagcgtctgtcggtgtgctttacgggcacagcaggcgcggcgtggcgcaaaattaccgcgtgggcggcggcgggcagcacatcggaaattttggtgaagaatatctggaacggcgcaaacagcaatattttgtacaagagggtggtttgaaattcaatgccggcagcggaaaatgggaacgggatttgcaaaggcaatactggaaaacaaagtggtataaaaaatacgaagacccccaagaactgcaaaaatacatcgaagagcatgataaaagctggcgggaaaacctggcgccgcaatacgacatcacccccatcgatccgtccggcctgaagcagcagtcggcaggcaatctgtttaaattggaatacgacggcgtattcaataaatacacggcgcaatttcgcgatttaaacaccagaatcggcagccgcaaaatcatcaaccgcaattatcaattcaattacggtttgtctttgaacccgtataccaacctcaatctgaccgcagcctacaattcgggcaggcagaaatatccgaaaggggcgaagtttacaggctgggggcttttaaaagattttgaaacctacaacaacgcgaaaatcctcgacctcaacaacaccgccaccttccggctgccccgcgaaaccgagttgcaaaccactttgggcttcaattatttccacaacgaatacggcaaaaaccgctttcctgaagaattggggctgtttttcgacggtcctgatcaggacaacgggctttattcctatttggggcggtttaagggcgataaagggctgttgcctcaaaaatcaaccattgtccaaccggccggcagccaatatttcaacacgttctacttcgatgccgcgctcaaaaaagacatttaccgcttaaactacagcaccaatgcaatcaactaccgtttcggcggcgaatatacgggctattacggctcggaaaacgaatttaagcgggcattcggagaaaactcgccggcatacaaggaacattgcgacccgagctgcgggctttatgaacccgtattgaaaaaatacggcaaaaagcgcgccaacaaccattcggtcagcattagtgcggacttcggcgattatttcatgccgttcgccggctattcgcgcacacaccgtatgcccaacatccaagaaatgtatttttcccaaatcggcgactccggcgttcacaccgccttaaaaccagagcgcgcaaacacttggcaatttggcttcaatacctataaaaaaggattgttaaaacaagatgatatattaggattgaaactggtcggctaccgcagccgcattgacaactacatccacaacgtttacgggaaatggtgggatttgaacggggatattccgagctgggtcggcagcaccgggcttgcctacaccatccgacaccgcaatttcaaagacaaagtgcacaaacacggttttgagctggagctgaattacgattatgggcgttttttcaccaacctttcttacgcctatcaaaaaagcacgcaaccgaccaatttcagcgatgcgagcgaatcgcccaacaatgcctccaaagaagaccaactcaaacaaggttatgggctgagcagggtttccgccctgccgcgagattacggacgtttggaagtcggtacgcgctggttgggcaacaaactgactttgggcggcgcgatgcgctatttcggcaagagcatccgcgcgacggctgaagaacgctatatcgacggcaccaacgggggaaataccagcaatgtccggcaactgggcaagcgttccatcaaacaaaccgaaacccttgcccgacagcctttgatttttgatttttacgccgcttacgagccgaagaaaaaccttattttccgcgccgaagtcaaaaacctgttcgacaggcgttatatcgatccgctcgatgcgggcaatgatgcggcaacgcagcgttattacagctcgttcgacccgaaagacaaggacgaagacgtaacgtgtaatgctgataaaacgttgtgcaacggcaaatacggcggcacaagcaaaagcgtattgaccaatttcgcacgcggacgcaccttcttgatgacgatgagctacaagttttaa

SEQ ID NO: 884 - protein, 922 aa, Neisseria gonorrhoeae
MRSSFRLKPICFYLMGVMLYHHSYAEDAGRAGSEAQIQVLEDVHVKAKRVPKDKKVFTDARAVSTRQDVFKSGENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRGVAQNYRVGGGGQHIGNFGEEYLERRKQQYFVQEGGLKFNAGSGKWERDLQRQYWKTKWYKKYEDPQELQKYIEEHDKSWRENLAPQYDITPIDPSGLKQQSAGNLFKLEYDGVFNKYTAQFRDLNTRIGSRKIINRNYQFNYGLSLNPYTNLNLTAAYNSGRQKYPKGAKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNAINYRFGGEYTGYYGSENEFKRAFGENSPAYKEHCDPSCGLYEPVLKKYGKKRANNHSVSISADFGDYFMPFAGYSRTHRMPNIQEMYFSQIGDSGVHTALKPERANTWQFGFNTYKKGLLKQDDILGLKLVGYRSRIDNYIHNVYGKWWDLNGDIPSWVGSTGLAYTIRHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNVRQLGKRSIKQTETLARQPLIFDFYAAYEPKKNLIFRAEVKNLFDRRYIDPLDAGNDAATQRYYSSFDPKDKDEDVTCNADKTLCNGKYGGTSKSVLTNFARGRTFLMTMSYKF

SEQ ID NO: 885 - DNA, 498 bp, Neisseria meningitidis
atgaacctgatttcacgttacatcatccgtcaaatggcggttatggcggtttacgcgctccttgccttcctcgctttgtacagcttttttgaaatcctgtacgaaaccggcaacctcggcaaaggcagttacggcatatgggaaatgctgggctacaccgccctcaaaatgcccgcccgcgcctacgaactgattcccctcgccgtccttatcggcggactggtctccctcagccagcttgccgccggcagcgaactgaccgtcatcaaagccagcggcatgagcaccaaaaagctgctgttgattctgtcgcagttcggttttatttttgctattgccaccgtcgcgctcggcgaatgggttgcgcccacactgagccaaaaagccgaaaacatcaaagccgccgccatcaacggcaaaatcagcaccggcaataccggcctttggctgaaagaaaaaaacagcgtgatcaatgtgcgcgaaatgttgcccgaccat

SEQ ID NO: 886 - protein, 166 aa, Neisseria meningitidis
MNLISRYIIRQMAVMAVYALLAFLALYSFFEILYETGNLGKGSYGIWEMLGYTALKMPARAYELIPLAVLIGGLVSLSQLAAGSELTVIKASGMSTKKLLLILSQFGFIFAIATVALGEWVAPTLSQKAENIKAAAINGKISTGNTGLWLKEKNSVINVREMLPDH

SEQ ID NO: 887 - DNA, 980 bp, Neisseria meningitidis
atgaacctgatttcacgttacatcatccgtcaaatggcggttatggcggtttacgcgctccttgccttcctcgctttgtacagcttttttgaaatcctgtacgaaaccggcaacctcggcaaaggcagttacggcatatgggaaatgctgggctacaccgccctcaaaatgcccgcccgcgcctacgaactgattcccctcgccgtccttatcggcggactggtctccctcagccagcttgccgccggcagcgaactgaccgtcatcaaagccagcggcatgagcaccaaaaagctgctgttgattctgtcgcagttcggttttatttttgctattgccaccgtcgcgctcggcgaatgggttgcgcccacactgagccaaaaagccgaaaacatcaaagccgccgccatcaacggcaaaatcagcaccggcaataccggcctttggctgaaagaaaaaaacagcrtkatcaatgtgcgcgaaatgttgcccgaccatacgcttttgggcatcaaaatttgggcgcgcaacgataaaaacgaattggcagaggcagtggaagccgattccgccgttttgaacagcgacggcagttggcagttgaaaaacatccgccgcagcacgcttggcgaagacaaagtcgaggtctctattgcggctgaagaaaactggccgatttccgtcaaacgcaacctgatggacgtattgctcgtcaaacccgaccaaatgtccgtcggcgaactgaccacctacatccgccacctccaaaacaacagccaaaacacccgaatctacgccatcgcatggtggcgcaaattggtttaccccgccgcagcctgggtgatggcgctcgtcgcctttgcctttaccccgcaaaccacccgccacggcaatatgggcttaaaactcttcggcggcatctgtstcggattgctgttccaccttgccggacggctctttgggtttaccagccaactcgg

SEQ ID NO: 888 - protein, 326 aa, Neisseria meningitidis
  misc_feature (156)..(156): Xaa= any amino acid
  misc_feature (309)..(309): Xaa= any amino acid
MNLISRYIIRQMAVMAVYALLAFLALYSFFEILYETGNLGKGSYGIWEMLGYTALKMPARAYELIPLAVLIGGLVSLSQLAAGSELTVIKASGMSTKKLLLILSQFGFIFAIATVALGEWVAPTLSQKAENIKAAAINGKISTGNTGLWLKEKNSXINVREMLPDHTLLGIKIWARNDKNELAEAVEADSAVLNSDGSWQLKNIRRSTLGEDKVEVSIAAEENWPISVKRNLMDVLLVKPDQMSVGELTTYIRHLQNNSQNTRIYAIAWWRKLVYPAAAWVMALVAFAFTPQTTRHGNMGLKLFGGICXGLLFHLAGRLFGFTSQL

SEQ ID NO: 889 - DNA, 1071 bp, Neisseria meningitidis
  misc_feature (148)..(148): Xaa= any amino acid
  misc_feature (153)..(153): Xaa= any amino acid
  misc_feature (172)..(172): Xaa= any amino acid
  misc_feature (229)..(229): Xaa= any amino acid
  misc_feature (260)..(260): Xaa= any amino acid
  misc_feature (669)..(669): Xaa= any amino acid
  misc_feature (770)..(772): Xaa= any amino acid
  misc_feature (907)..(907): Xaa= any amino acid
  misc_feature (951)..(951): Xaa= any amino acid
  misc_feature (961)..(961): Xaa= any amino acid
  misc_feature (1001)..(1001): Xaa= any amino acid
atgaacctgatttcacgttacatcatccgtcaaatggcggttatggcggtttacgcgctccttgccttcctcgctttgtacagcttttttgaaatcctgtacgaaaccggcaacctcggcaaaggcagttacggcatatgggaaatgntgggntacaccgccctcaaaatgnccgcccgcgcctacgaactgatgcccctcgccgtccttatcggcggactggtctctntcagccagcttgccgccggcagcgaactgancgtcatcaaagccagcggcatgagcaccaaaaagctgctgttgattctgtcgcagttcggttttatttttgctattgccaccgtcgcgctcggcgaatgggttgcgcccacactgagccaaaaagccgaaaacatcaaagccgcggccatcaacggcaaaatcagtaccggcaataccggcctttggctgaaagaaaaaaacagcattatcaatgtgcgcgaaatgttgcccgaccataccctgctgggcattaaaatctgggcccgcaacgataaaaacgaactggcagaggcagtggaagccgattccgccgttttgaacagcgacggcagttggcagttgaaaaacatccgccgcagcacgcttggcgaagacaaagtcgaggtctctattgcggctgaagaaaantggccgatttccgtcaaacgcaacctgatggacgtattgctcgtcaaacccgaccaaatgtccgtcggcgaactgaccacctacatccgccacctccaaannnacagccaaaacacccgaatctacgccatcgcatggtggcgcaaattggtttaccccgccgcagcctgggtgatggcgctcgtcgcctttgcctttaccccgcaaaccacccgccacggcaatatgggcttaaaantcttcggcggcatctgtctcggattgctgttccaccttgccggncggctcttcnggtttaccagccaactctacggcatcccgcccttcctcgncggcgcactacctaccatagccttcgccttgctcgccgtttggctgatacgcaaacaggaaaaacgctaa

SEQ ID NO: 890 - protein, 356 aa, Neisseria meningitidis
  misc_feature (50)..(50): Xaa= any amino acid
  misc_feature (58)..(58): Xaa= any amino acid
  misc_feature (77)..(77): Xaa= any amino acid
  misc_feature (87)..(87): Xaa= any amino acid
  misc_feature (223)..(223): Xaa= any amino acid
  misc_feature (257)..(258): Xaa= any amino acid
  misc_feature (303)..(303): Xaa= any amino acid
  misc_feature (321)..(321): Xaa= any amino acid
  misc_feature (334)..(334): Xaa= any amino acid
MNLISRYIIRQMAVMAVYALLAFLALYSFFEILYETGNLGKGSYGIWEMXGYTALKMXARAYELMPLAVLIGGLVSXSQLAAGSELXVIKASGMSTKKLLLILSQFGFIFAIATVALGEWVAPTLSQKAENIKAAAINGKISTGNTGLWLKEKNSIINVREMLPDHTLLGIKIWARNDKNELAEAVEADSAVLNSDGSWQLKNIRRSTLGEDKVEVSIAAEEXWPISVKRNLMDVLLVKPDQMSVGELTTYIRHLQXXSQNTRIYAIAWWRKLVYPAAAWVMALVAFAFTPQTTRHGNMGLKXFGGICLGLLFHLAGRLFXFTSQLYGIPPFLXGALPTIAFALLAVWLIRKQEKR

SEQ ID NO: 891 - DNA, 1071 bp, Neisseria gonorrhoeae
atgaacctgatttcacgttacatcatccgccaaatggcggttatggcggtttacgcgctccttgccttcctcgctttgtacagcttttttgaaatcctgtacgaaaccggcaacctcggcaaaggcagttacggcatatgggaaatgctgggctacaccgccctcaaaatgcccgcccgcgcctacgaactcatgcccctcgccgtcctcatcggcggactggcctctctcagccagcttgccgccggcagcgaactggccgtcatcaaagccagcggcatgagcaccaaaaagctgctgttgattctgtctcagttcggttttatttttgctattgccgccgtcgcgctcggcgaatgggttgcgcccacgctgagccaaaaagccgaaaacatcaaagccgccgccattaacggcaaaatcagcaccggcaataccggcctttggctgaaagaaaaaaccagcattatcaatgtgcgcggaatgttgcccgaccatacgcttttgggcatcaaaatttgggcgcgcaacgataaaaacgaattggcagaggcagtggaagccgattccgccgttttgaacagcgacggcagctggcagttgaaaaacatccgccgcagcatcatgggtacagacaaaatcgaaacatccgccgccgccgaagaaacttggccgattgccgtcagacgcaacctgatggacgtattgctcgtcaagcccgaccaaatgtccgtcggcgagctgaccacctacatccgccacctccaaaacaacagccaaaacacccaaatctacgccatcgcatggtggcgtaaactcgtttaccccgtcgccgcatgggtcatggcgctcgttgccttcgcctttacgccgcaaaccacgcgccacggcaatatgggcttaaaactcttcggcggcatctgtctcggattgctgttccaccttgccggcaggctcttcgggtttaccagccaactctacggcaccccacccttcctcgccggcgcactgcctaccatagccttcgccttgctcgctgtttggctgatacgcaaacaggaaaaacgttga

SEQ ID NO: 892 - protein, 356 aa, Neisseria gonorrhoeae
MNLISRYIIRQMAVMAVYALLAFLALYSFFEILYETGNLGKGSYGIWEMLGYTALKMPARAYELMPLAVLIGGLASLSQLAAGSELAVIKASGMSTKKLLLILSQFGFIFAIAAVALGEWVAPTLSQKAENIKAAAINGKISTGNTGLWLKEKTSIINVRGMLPDHTLLGIKIWARNDKNELAEAVEADSAVLNSDGSWQLKNIRRSIMGTDKIETSAAAEETWPIAVRRNLMDVLLVKPDQMSVGELTTYIRHLQNNSQNTQIYAIAWWRKLVYPVAAWVMALVAFAFTPQTTRHGNMGLKLFGGICLGLLFHLAGRLFGFTSQLYGTPPFLAGALPTIAFALLAVWLIRKQEKR

SEQ ID NO: 893 - protein, 287 aa, Neisseria meningitidis; identical to SEQ ID NO: 218

SEQ ID NO: 894 - protein, 287 aa, Neisseria meningitidis; identical to SEQ ID NO: 218

SEQ ID NO: 895 - protein, 287 aa, Neisseria meningitidis; identical to SEQ ID NO: 218

SEQ ID NO: 896 - protein, 287 aa, Neisseria meningitidis; identical to SEQ ID NO: 218

SEQ ID NO: 897 - protein, 287 aa, Neisseria meningitidis; identical to SEQ ID NO: 218

SEQ ID NO: 898 - protein, 287 aa, Neisseria meningitidis
MKTFFKTLSAAALALILAACGGQKDSAPAASASAAADNGAEKKEIVFGTTVGDFGDMVKEHIQPELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 899 - protein, 287 aa, Neisseria meningitidis; identical to SEQ ID NO: 898

SEQ ID NO: 900 - protein, 287 aa, Neisseria meningitidis
MKTFFKTLSAAALALILAACGGQKDSAPAASASAAADNGAEKKEIVFGTTVGDFGDMVKEQIQAELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 901 - protein, 287 aa, Neisseria meningitidis; identical to SEQ ID NO: 900

SEQ ID NO: 902 - protein, 287 aa, Neisseria meningitidis; identical to SEQ ID NO: 900

SEQ ID NO: 903 - protein, 287 aa, Neisseria meningitidis
MKTFFKTLSAAALALILAACGGQKDSAPAASASAAADNGAAKKEIVFGTTVGDFGDMVKEHIQPELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 904 - protein, 287 aa, Neisseria meningitidis; identical to SEQ ID NO: 903

SEQ ID NO: 905 - protein, 287 aa, Neisseria meningitidis; identical to SEQ ID NO: 903

SEQ ID NO: 906 - protein, 287 aa, Neisseria meningitidis; identical to SEQ ID NO: 222

SEQ ID NO: 907 - protein, 287 aa, Neisseria meningitidis; identical to SEQ ID NO: 903

SEQ ID NO: 908 - protein, 287 aa, Neisseria meningitidis; identical to SEQ ID NO: 903

SEQ ID NO: 909 - protein, 287 aa, Neisseria meningitidis; identical to SEQ ID NO: 900

SEQ ID NO: 910 - protein, 287 aa, Neisseria meningitidis; identical to SEQ ID NO: 900

SEQ ID NO: 911 - protein, 287 aa, Neisseria meningitidis; identical to SEQ ID NO: 900

SEQ ID NO: 912 - protein, 287 aa, Neisseria meningitidis; identical to SEQ ID NO: 900

SEQ ID NO: 913 - protein, 287 aa, Neisseria meningitidis; identical to SEQ ID NO: 218

SEQ ID NO: 914 - protein, 287 aa, Neisseria meningitidis
MKTFFKTLSAAALALILAACGGQKDSAPAASASAAADNGAAKKEIVFGTTVGDFGDLVKEQIQPELEKKGYTVELVEFTDYVRPNLALGEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 915 - protein, 287 aa, Neisseria meningitidis; identical to SEQ ID NO: 900

SEQ ID NO: 916 - protein, 287 aa, Neisseria meningitidis; identical to SEQ ID NO: 900

SEQ ID NO: 917 - protein, 287 aa, Neisseria meningitidis; identical to SEQ ID NO: 900

SEQ ID NO: 918 - protein, 287 aa, Neisseria meningitidis; identical to SEQ ID NO: 222

SEQ ID NO: 919 - protein, 287 aa, Neisseria meningitidis; identical to SEQ ID NO: 222

SEQ ID NO: 920 - protein, 287 aa, Neisseria meningitidis; identical to SEQ ID NO: 222

SEQ ID NO: 921 - protein, 288 aa, Neisseria gonorrhoeae; identical to SEQ ID NO: 226

SEQ ID NO: 922 - protein, 288 aa, Neisseria gonorrhoeae; identical to SEQ ID NO: 226

SEQ ID NO: 923 - protein, 287 aa, Neisseria meningitidis; identical to SEQ ID NO: 222

SEQ ID NO: 924 - DNA, 32 bp, Artificial Sequence
  Description of Artificial Sequence:  Novel Sequence
cgcggatccgctagcggacacacttatttcgg

SEQ ID NO: 925 - DNA, 27 bp, Artificial Sequence
  Description of Artificial Sequence:  Novel Sequence
cccgctcgagccagcggtagcctaatt

SEQ ID NO: 926 - DNA, 31 bp, Artificial Sequence
  Description of Artificial Sequence:  Novel Sequence
gcggatcccatatgtttgatttcggtttggg

SEQ ID NO: 927 - DNA, 25 bp, Artificial Sequence
  Description of Artificial Sequence:  Novel Sequence
cccgctcgaggacggcataacggcg

SEQ ID NO: 928 - DNA, 31 bp, Artificial Sequence; identical to SEQ ID NO: 926
  Description of Artificial Sequence:  Novel Sequence

SEQ ID NO: 929 - DNA, 27 bp, Artificial Sequence
  Description of Artificial Sequence:  Novel Sequence
cccgctcgagtgatttacggacgcgca

SEQ ID NO: 930 - DNA, 32 bp, Artificial Sequence
  Description of Artificial Sequence:  Novel Sequence
gcggatcccatatgtgcggaggtcaaaaagac

SEQ ID NO: 931 - DNA, 25 bp, Artificial Sequence
  Description of Artificial Sequence:  Novel Sequence
cccgctcgagtttggctgcgccttc

SEQ ID NO: 932 - DNA, 36 bp, Artificial Sequence
  Description of Artificial Sequence:  Novel Sequence
ggaattccatatggccatggtggaaggcgcacaacc

SEQ ID NO: 933 - DNA, 24 bp, Artificial Sequence
  Description of Artificial Sequence:  Novel Sequence
cgggatccatggaaggcgcacaac

SEQ ID NO: 934 - DNA, 26 bp, Artificial Sequence
  Description of Artificial Sequence:  Novel Sequence
cccgctcgaggactgtgcaaaaacgg

SEQ ID NO: 935 - DNA, 32 bp, Artificial Sequence
  Description of Artificial Sequence:  Novel Sequence
cgcggatcccatatgacccgtcaatctctgca

SEQ ID NO: 936 - DNA, 26 bp, Artificial Sequence
  Description of Artificial Sequence:  Novel Sequence
cccgctcgagtgcgccgaacactttc

SEQ ID NO: 937 - DNA, 32 bp, Artificial Sequence
  Description of Artificial Sequence:  Novel Sequence
cgcggatccgctagcgcgctgctttttgttcc

SEQ ID NO: 938 - DNA, 30 bp, Artificial Sequence
  Description of Artificial Sequence:  Novel Sequence
cccgctcgagtttcaaaatatatttgcgga

SEQ ID NO: 939 - DNA, 31 bp, Artificial Sequence
  Description of Artificial Sequence:  Novel Sequence
gcggatcccatatggctcaactgcttcgtac

SEQ ID NO: 940 - DNA, 25 bp, Artificial Sequence
  Description of Artificial Sequence:  Novel Sequence
cccgctcgagagcaggctttggcgc

SEQ ID NO: 941 - DNA, 32 bp, Artificial Sequence
  Description of Artificial Sequence:  Novel Sequence
cgcggatcccatatgccgaaggaagtcggaaa

SEQ ID NO: 942 - DNA, 27 bp, Artificial Sequence
  Description of Artificial Sequence:  Novel Sequence
cccgctcgagtttccgaggttttcggg

SEQ ID NO: 943 - DNA, 32 bp, Artificial Sequence
  Description of Artificial Sequence:  Novel Sequence
gcggatcccatatggacacaaaagaaatcctc

SEQ ID NO: 944 - DNA, 29 bp, Artificial Sequence
  Description of Artificial Sequence:  Novel Sequence
cccgctcgagtaatgggaaaccttgtttt

SEQ ID NO: 945 - DNA, 30 bp, Artificial Sequence
  Description of Artificial Sequence:  Novel Sequence
gcggatcccatatggcggtcaacctctacg

SEQ ID NO: 946 - DNA, 25 bp, Artificial Sequence
  Description of Artificial Sequence:  Novel Sequence
cccgctcgagggaaacgacttcgcc

SEQ ID NO: 947 - DNA, 31 bp, Artificial Sequence
  Description of Artificial Sequence:  Novel Sequence
cgcggatcccatatggctctgctttccgcgc

SEQ ID NO: 948 - DNA, 28 bp, Artificial Sequence
  Description of Artificial Sequence:  Novel Sequence
cccgctcgagagggtgtgtgataataag

SEQ ID NO: 949 - DNA, 35 bp, Artificial Sequence
  Description of Artificial Sequence:  Novel Sequence
ggaattccatatggccatgggcgggacactgacag

SEQ ID NO: 950 - DNA, 25 bp, Artificial Sequence
  Description of Artificial Sequence:  Novel Sequence
cgggatcctgcgggacactgacagg

SEQ ID NO: 951 - DNA, 28 bp, Artificial Sequence
  Description of Artificial Sequence:  Novel Sequence
cccgctcgagaggttggccttgtctatg

SEQ ID NO: 952 - DNA, 35 bp, Artificial Sequence
  Description of Artificial Sequence:  Novel Sequence
ggaattccatatggccatggttgccggcctgttcg

SEQ ID NO: 953 - DNA, 24 bp, Artificial Sequence
  Description of Artificial Sequence:  Novel Sequence
cgggatccattgccggcctgttcg

SEQ ID NO: 954 - DNA, 26 bp, Artificial Sequence
  Description of Artificial Sequence:  Novel Sequence
cccgctcgagaagcaggttgtacagc

SEQ ID NO: 955 - DNA, 32 bp, Artificial Sequence
  Description of Artificial Sequence:  Novel Sequence
gcggatcccatatgattttgctgcatttggat

SEQ ID NO: 956 - DNA, 29 bp, Artificial Sequence
  Description of Artificial Sequence:  Novel Sequence
cccgctcgagtcttccaatttctgaaagc

SEQ ID NO: 957 - DNA, 37 bp, Artificial Sequence
  Description of Artificial Sequence:  Novel Sequence
ggaattccatatggccatggtcgccagtgtttttacc

SEQ ID NO: 958 - DNA, 27 bp, Artificial Sequence
  Description of Artificial Sequence:  Novel Sequence
cgggatccttcgccagtgtttttaccg

SEQ ID NO: 959 - DNA, 28 bp, Artificial Sequence
  Description of Artificial Sequence:  Novel Sequence
cccgctcgagggtgtttttgaagctgcc

SEQ ID NO: 960 - DNA, 34 bp, Artificial Sequence
  Description of Artificial Sequence:  Novel Sequence
ggaattccatatggccatggtcggcgcgggtatg

SEQ ID NO: 961 - DNA, 23 bp, Artificial Sequence
  Description of Artificial Sequence:  Novel Sequence
cgggatccttcggcgcgggtatg

SEQ ID NO: 962 - DNA, 25 bp, Artificial Sequence
  Description of Artificial Sequence:  Novel Sequence
cccgctcgagcggcgagcgagagca

SEQ ID NO: 963 - DNA, 42 bp, Artificial Sequence
  Description of Artificial Sequence:  Novel Sequence
ggaattccatatggccatggtgattaaaatcaaaaaaggtct

SEQ ID NO: 964 - DNA, 36 bp, Artificial Sequence
  Description of Artificial Sequence:  Novel Sequence
cgggatccatgattaaaatcaaaaaaggtctaaacc

SEQ ID NO: 965 - DNA, 26 bp, Artificial Sequence
  Description of Artificial Sequence:  Novel Sequence
cccgctcgagattatgatagcggccc

SEQ ID NO: 966 - DNA, 33 bp, Artificial Sequence
  Description of Artificial Sequence:  Novel Sequence
cgcggatcccatatggatgtttctgtttcagac

SEQ ID NO: 967 - DNA, 30 bp, Artificial Sequence
  Description of Artificial Sequence:  Novel Sequence
cccgctcgagtttaaaccgataggtaaacg

SEQ ID NO: 968 - DNA, 37 bp, Artificial Sequence
  Description of Artificial Sequence:  Novel Sequence
ggaattccatatggccatggtgatgccggaaatggtg

SEQ ID NO: 969 - DNA, 26 bp, Artificial Sequence
  Description of Artificial Sequence:  Novel Sequence
cgggatccatgatgccggaaatggtg

SEQ ID NO: 970 - DNA, 25 bp, Artificial Sequence
  Description of Artificial Sequence:  Novel Sequence
cccgctcgagtgtcagcgtggcgca

SEQ ID NO: 971 - DNA, 31 bp, Artificial Sequence
  Description of Artificial Sequence:  Novel Sequence
gcggatcccatatgtatcgcaaactgattgc

SEQ ID NO: 972 - DNA, 26 bp, Artificial Sequence
  Description of Artificial Sequence:  Novel Sequence
cccgctcgagatcgatggaatagccg

SEQ ID NO: 973 - DNA, 31 bp, Artificial Sequence
  Description of Artificial Sequence:  Novel Sequence
gcggatcccatatgcagctgatcgactattc

SEQ ID NO: 974 - DNA, 26 bp, Artificial Sequence
  Description of Artificial Sequence:  Novel Sequence
cccgctcgaggacatcggcgcgtttt

SEQ ID NO: 975 - DNA, 33 bp, Artificial Sequence
  Description of Artificial Sequence:  Novel Sequence
cgggatcccagacctattctgtttattttaatc

SEQ ID NO: 976 - DNA, 30 bp, Artificial Sequence
  Description of Artificial Sequence:  Novel Sequence
cccgctcgaggggttcgattaaataaccat

SEQ ID NO: 977 - DNA, 38 bp, Artificial Sequence
  Description of Artificial Sequence:  Novel Sequence
ggaattccatatggccatggacggctgtacgttgatgt

SEQ ID NO: 978 - DNA, 26 bp, Artificial Sequence
  Description of Artificial Sequence:  Novel Sequence
cgggatccaacggctgtacgttgatg

SEQ ID NO: 979 - DNA, 29 bp, Artificial Sequence
  Description of Artificial Sequence:  Novel Sequence
cccgctcgagtttgtcagaggaattcgcg

SEQ ID NO: 980 - DNA, 31 bp, Artificial Sequence
  Description of Artificial Sequence:  Novel Sequence
gcggatcccatatgaacggtttggatgcccg

SEQ ID NO: 981 - DNA, 32 bp, Artificial Sequence
  Description of Artificial Sequence:  Novel Sequence
cgcggatccgctagcaacggtttggatgcccg

SEQ ID NO: 982 - DNA, 31 bp, Artificial Sequence
  Description of Artificial Sequence:  Novel Sequence
cccgctcgagtttgtctaagttcctgatatg

SEQ ID NO: 983 - DNA, 31 bp, Artificial Sequence
  Description of Artificial Sequence:  Novel Sequence
cgcggatcccatatgaatactcctccttttg

SEQ ID NO: 984 - DNA, 30 bp, Artificial Sequence
  Description of Artificial Sequence:  Novel Sequence
cccgctcgaggcgtattttttgatgctttg

SEQ ID NO: 985 - DNA, 32 bp, Artificial Sequence
  Description of Artificial Sequence:  Novel Sequence
gcggatcccatatgattgatagggatcgtatg

SEQ ID NO: 986 - DNA, 28 bp, Artificial Sequence
  Description of Artificial Sequence:  Novel Sequence
cccgctcgagttgatctttcaaacggcc

SEQ ID NO: 987 - DNA, 29 bp, Artificial Sequence
  Description of Artificial Sequence:  Novel Sequence
gcggatcccatatgttcagagctcagctt

SEQ ID NO: 988 - DNA, 30 bp, Artificial Sequence
  Description of Artificial Sequence:  Novel Sequence
cgcggatccgctagcttcagagctcagctt

SEQ ID NO: 989 - DNA, 28 bp, Artificial Sequence
  Description of Artificial Sequence:  Novel Sequence
cccgctcgagaaacagccatttgagcga

SEQ ID NO: 990 - DNA, 32 bp, Artificial Sequence
  Description of Artificial Sequence:  Novel Sequence
gcggatcccatatggatgacgtatcggatttt

SEQ ID NO: 991 - DNA, 26 bp, Artificial Sequence
  Description of Artificial Sequence:  Novel Sequence
cccgctcgagatagcccgctttcagg

SEQ ID NO: 992 - DNA, 32 bp, Artificial Sequence
  Description of Artificial Sequence:  Novel Sequence
cgcggatccgctagctccgaacgcgagtggat

SEQ ID NO: 993 - DNA, 28 bp, Artificial Sequence
  Description of Artificial Sequence:  Novel Sequence
cccgctcgagagcattgtccaaggggac

SEQ ID NO: 994 - DNA, 38 bp, Artificial Sequence
  Description of Artificial Sequence:  Novel Sequence
ggaattccatatggccatggtgctgtatctgaatcaag

SEQ ID NO: 995 - DNA, 28 bp, Artificial Sequence
  Description of Artificial Sequence:  Novel Sequence
cgggatccttgctgtatctgaatcaagg

SEQ ID NO: 996 - DNA, 25 bp, Artificial Sequence
  Description of Artificial Sequence:  Novel Sequence
cccgctcgagccgcatcggcagaca

SEQ ID NO: 997 - DNA, 30 bp, Artificial Sequence
  Description of Artificial Sequence:  Novel Sequence
gcggatcccatatgtacgcatttaccgccg

SEQ ID NO: 998 - DNA, 28 bp, Artificial Sequence
  Description of Artificial Sequence:  Novel Sequence
cccgctcgagtggattttgcagagatgg

SEQ ID NO: 999 - DNA, 35 bp, Artificial Sequence
  Description of Artificial Sequence:  Novel Sequence
cgcggatcccatatgaatgcagtaaaaatatctga

SEQ ID NO: 1000 - DNA, 27 bp, Artificial Sequence
  Description of Artificial Sequence:  Novel Sequence
cccgctcgaggcctgagacctttgcaa

SEQ ID NO: 1001 - DNA, 31 bp, Artificial Sequence
  Description of Artificial Sequence:  Novel Sequence
gcggatcccatatgagatttttcggtatcgg

SEQ ID NO: 1002 - DNA, 29 bp, Artificial Sequence
  Description of Artificial Sequence:  Novel Sequence
cccgctcgagttcatctttttcatgttcg

SEQ ID NO: 1003 - DNA, 31 bp, Artificial Sequence
  Description of Artificial Sequence:  Novel Sequence
gcggatcccatatgtctgtctttcaaacggc

SEQ ID NO: 1004 - DNA, 28 bp, Artificial Sequence
  Description of Artificial Sequence:  Novel Sequence
cccgctcgagtttgtttttgcaagacag

SEQ ID NO: 1005 - DNA, 34 bp, Artificial Sequence
  Description of Artificial Sequence:  Novel Sequence
gatcagctagccatatgaaacagaaaaaaaccgc

SEQ ID NO: 1006 - DNA, 26 bp, Artificial Sequence
  Description of Artificial Sequence:  Novel Sequence
cgggatccttacggtttgacaccgtt

SEQ ID NO: 1007 - DNA, 28 bp, Artificial Sequence
  Description of Artificial Sequence:  Novel Sequence
cgcggatcccatatggtttccgccgccg

SEQ ID NO: 1008 - DNA, 21 bp, Artificial Sequence
  Description of Artificial Sequence:  Novel Sequence
cccgctcgaggtgctgatgcg

SEQ ID NO: 1009 - DNA, 30 bp, Artificial Sequence
  Description of Artificial Sequence:  Novel Sequence
gcggatcccatatgaaaaccctgctgctgc

SEQ ID NO: 1010 - DNA, 24 bp, Artificial Sequence
  Description of Artificial Sequence:  Novel Sequence
cccgctcgaggccgcctttgcggc

SEQ ID NO: 1011 - DNA, 29 bp, Artificial Sequence
  Description of Artificial Sequence:  Novel Sequence
gcggatcccatatggcagagatctgtttg

SEQ ID NO: 1012 - DNA, 27 bp, Artificial Sequence
  Description of Artificial Sequence:  Novel Sequence
cccgctcgaggtttgccgatccgacca

SEQ ID NO: 1013 - DNA, 30 bp, Artificial Sequence
  Description of Artificial Sequence:  Novel Sequence
cgcggatcccatatggcggtttggggcgga

SEQ ID NO: 1014 - DNA, 24 bp, Artificial Sequence
  Description of Artificial Sequence:  Novel Sequence
cccgctcgagtcggcgcggcgggc

SEQ ID NO: 1015 - DNA, 36 bp, Artificial Sequence
  Description of Artificial Sequence:  Novel Sequence
ggaattccatatggccatggccataccttcttatca

SEQ ID NO: 1016 - DNA, 28 bp, Artificial Sequence
  Description of Artificial Sequence:  Novel Sequence
cgggatccgccataccttcttatcagag

SEQ ID NO: 1017 - DNA, 31 bp, Artificial Sequence
  Description of Artificial Sequence:  Novel Sequence
cccgctcgagttttttgcgattagaaaaagc

SEQ ID NO: 1018 - DNA, 30 bp, Artificial Sequence
  Description of Artificial Sequence:  Novel Sequence
gcggatcccatatgcatcctgccagcgaac

SEQ ID NO: 1019 - DNA, 28 bp, Artificial Sequence
  Description of Artificial Sequence:  Novel Sequence
cccgctcgagttcgcctacggttttttg

SEQ ID NO: 1020 - DNA, 27 bp, Artificial Sequence
  Description of Artificial Sequence:  Novel Sequence
gcggatcccatatgacggtaactgcgg

SEQ ID NO: 1021 - DNA, 28 bp, Artificial Sequence
  Description of Artificial Sequence:  Novel Sequence
cccgctcgagttgttgttcgggcaaatc

SEQ ID NO: 1022 - DNA, 30 bp, Artificial Sequence
  Description of Artificial Sequence:  Novel Sequence
gcggatcccatatgtcgggcatttacaccg

SEQ ID NO: 1023 - DNA, 26 bp, Artificial Sequence
  Description of Artificial Sequence:  Novel Sequence
cccgctcgagacgggtttcggcggaa

SEQ ID NO: 1024 - DNA, 32 bp, Artificial Sequence
  Description of Artificial Sequence:  Novel Sequence
gcggatcccatatgatttatcaaagaaacctc

SEQ ID NO: 1025 - DNA, 28 bp, Artificial Sequence
  Description of Artificial Sequence:  Novel Sequence
cccgctcgagttttccgcctttcaatgt

SEQ ID NO: 1026 - DNA, 30 bp, Artificial Sequence
  Description of Artificial Sequence:  Novel Sequence
gcggatcccatatggcagggctgttttacc

SEQ ID NO: 1027 - DNA, 28 bp, Artificial Sequence
  Description of Artificial Sequence:  Novel Sequence
cccgctcgagaaacggtttgaacacgac

SEQ ID NO: 1028 - DNA, 28 bp, Artificial Sequence
  Description of Artificial Sequence:  Novel Sequence
gcggatcccatatgaaccacgacatcac

SEQ ID NO: 1029 - DNA, 25 bp, Artificial Sequence
  Description of Artificial Sequence:  Novel Sequence
cccgctcgagcagccacaggacggc

SEQ ID NO: 1030 - DNA, 27 bp, Artificial Sequence
  Description of Artificial Sequence:  Novel Sequence
gcggatcccatatgacgtggggaacgc

SEQ ID NO: 1031 - DNA, 26 bp, Artificial Sequence
  Description of Artificial Sequence:  Novel Sequence
cccgctcgaggcggcgtttgaacggc

SEQ ID NO: 1032 - DNA, 33 bp, Artificial Sequence
  Description of Artificial Sequence:  Novel Sequence
gcggatcccatatgaccaaatttcaaacccctc

SEQ ID NO: 1033 - DNA, 28 bp, Artificial Sequence
  Description of Artificial Sequence:  Novel Sequence
cccgctcgagtaaacgaatgccgtccag

SEQ ID NO: 1034 - DNA, 30 bp, Artificial Sequence
  Description of Artificial Sequence:  Novel Sequence
gcggatcccatatgaggataaccgacggcg

SEQ ID NO: 1035 - DNA, 28 bp, Artificial Sequence
  Description of Artificial Sequence:  Novel Sequence
cccgctcgagtttgttcccgatgatgtt

SEQ ID NO: 1036 - DNA, 36 bp, Artificial Sequence
  Description of Artificial Sequence:  Novel Sequence
gcggatcccatatggaagatttatatataatactcg

SEQ ID NO: 1037 - DNA, 28 bp, Artificial Sequence
  Description of Artificial Sequence:  Novel Sequence
cccgctcgagatcagcttcgaaccgaag

SEQ ID NO: 1038 - DNA, 33 bp, Artificial Sequence
  Description of Artificial Sequence:  Novel Sequence
aaagaattcatgagtaaatcccgtagatctccc

SEQ ID NO: 1039 - DNA, 33 bp, Artificial Sequence
  Description of Artificial Sequence:  Novel Sequence
aaactgcagggaaaaccacatccgcactctgcc

SEQ ID NO: 1040 - DNA, 33 bp, Artificial Sequence
  Description of Artificial Sequence:  Novel Sequence
aaagaattcgcaccgcaaaaggcaaaaaccgca

SEQ ID NO: 1041 - DNA, 33 bp, Artificial Sequence
  Description of Artificial Sequence:  Novel Sequence
aaactgcagtctgcgcgttttcgggcagggtgg

SEQ ID NO: 1042 - DNA, 44 bp, Artificial Sequence
  Description of Artificial Sequence:  Novel Sequence
aaagaattcatgaacaaaaccctctatcgtgtgattttcaaccg

SEQ ID NO: 1043 - DNA, 39 bp, Artificial Sequence
  Description of Artificial Sequence:  Novel Sequence
aaactgcagttacgaatgcctgcttgctcgaccgtactg

SEQ ID NO: 1044 - DNA, 35 bp, Artificial Sequence
  Description of Artificial Sequence:  Novel Sequence
aaagaattcttgcttgtgcaaacagaaaaagacgg

SEQ ID NO: 1045 - DNA, 51 bp, Artificial Sequence
  Description of Artificial Sequence:  Novel Sequence
aaaaaagtcgacctattttttaggggcttttgcttgtttgaaaagcctgcc

SEQ ID NO: 1046 - DNA, 38 bp, Artificial Sequence
  Description of Artificial Sequence:  Novel Sequence
aaagaattctacaacatgtatcaggaaaaccaataccg

SEQ ID NO: 1047 - DNA, 39 bp, Artificial Sequence
  Description of Artificial Sequence:  Novel Sequence
aaactgcagttatgaaaacaggcgcagggcggttttgcc

SEQ ID NO: 1048 - DNA, 33 bp, Artificial Sequence
  Description of Artificial Sequence:  Novel Sequence
aaagaattcgcaaggctaccccaatccgccgtg

SEQ ID NO: 1049 - DNA, 33 bp, Artificial Sequence
  Description of Artificial Sequence:  Novel Sequence
aaactgcagcggtttggctgcctggccgttgat

SEQ ID NO: 1050 - DNA, 32 bp, Artificial Sequence
  Description of Artificial Sequence:  Novel Sequence
aaagaattcgccttggtctggctggttttcgc

SEQ ID NO: 1051 - DNA, 39 bp, Artificial Sequence
  Description of Artificial Sequence:  Novel Sequence
aaactgcagtcatccgccaccccacctcggccatccatc

SEQ ID NO: 1052 - DNA, 38 bp, Artificial Sequence
  Description of Artificial Sequence:  Novel Sequence
aaaaaagtcgacatgtcttaccgcgcaagcagttctcc

SEQ ID NO: 1053 - DNA, 42 bp, Artificial Sequence
  Description of Artificial Sequence:  Novel Sequence
aaactgcagtcaggaacacaaacgatgacgaatatccgtatc

SEQ ID NO: 1054 - DNA, 33 bp, Artificial Sequence
  Description of Artificial Sequence:  Novel Sequence
aaagaattcgcgctgttttttgcggcggcgtat

SEQ ID NO: 1055 - DNA, 33 bp, Artificial Sequence
  Description of Artificial Sequence:  Novel Sequence
aaactgcagcgccgtttcaagacgaaaaagtcg

SEQ ID NO: 1056 - DNA, 25 bp, Artificial Sequence
  Description of Artificial Sequence:  Novel Sequence
aaagaattcgcggaaacggtcgaag

SEQ ID NO: 1057 - DNA, 31 bp, Artificial Sequence
  Description of Artificial Sequence:  Novel Sequence
aaactgcagttaatcttgtcttccgatatac

SEQ ID NO: 1058 - DNA, 33 bp, Artificial Sequence
  Description of Artificial Sequence:  Novel Sequence
aaagaattcatgactgataatcgggggtttacg

SEQ ID NO: 1059 - DNA, 36 bp, Artificial Sequence
  Description of Artificial Sequence:  Novel Sequence
aaaaaagtcgaccttaagtaacttgcagtccttatc

SEQ ID NO: 1060 - DNA, 32 bp, Artificial Sequence
  Description of Artificial Sequence:  Novel Sequence
aaagaattcatgcaagctgtccgctacaggcc

SEQ ID NO: 1061 - DNA, 48 bp, Artificial Sequence
  Description of Artificial Sequence:  Novel Sequence
aaactgcagctattgcaatgcgccgccgcgggaatgtttgagcaggcg

SEQ ID NO: 1062 - DNA, 44 bp, Artificial Sequence
  Description of Artificial Sequence:  Novel Sequence
aaagaattcatggattttcgttttgacattatttacgaataccg

SEQ ID NO: 1063 - DNA, 36 bp, Artificial Sequence
  Description of Artificial Sequence:  Novel Sequence
aaactgcagttattttttgatgaaattttggggcgg

SEQ ID NO: 1064 - DNA, 33 bp, Artificial Sequence
  Description of Artificial Sequence:  Novel Sequence
aaagaattcgcagtacttgccattctcggtgcg

SEQ ID NO: 1065 - DNA, 33 bp, Artificial Sequence
  Description of Artificial Sequence:  Novel Sequence
aaactgcagctccggatcgtctgtaaacgcatt

SEQ ID NO: 1066 - DNA, 33 bp, Artificial Sequence
  Description of Artificial Sequence:  Novel Sequence
gcggatcccatatggaaattcgggcaataaaat

SEQ ID NO: 1067 - DNA, 25 bp, Artificial Sequence
  Description of Artificial Sequence:  Novel Sequence
cccgctcgagccagcggacgcgttc

SEQ ID NO: 1068 - DNA, 30 bp, Artificial Sequence
  Description of Artificial Sequence:  Novel Sequence
gcggatcccatatgaaagaagcggggtttg

SEQ ID NO: 1069 - DNA, 26 bp, Artificial Sequence
  Description of Artificial Sequence:  Novel Sequence
cccgctcgagccaatctgccagccgt

SEQ ID NO: 1070 - DNA, 31 bp, Artificial Sequence
  Description of Artificial Sequence:  Novel Sequence
cgcggatcccatatggaagatgcagggcgcg

SEQ ID NO: 1071 - DNA, 28 bp, Artificial Sequence
  Description of Artificial Sequence:  Novel Sequence
cccgctcgagaaacttgtagctcatcgt

SEQ ID NO: 1072 - DNA, 32 bp, Artificial Sequence
  Description of Artificial Sequence:  Novel Sequence
gcggatcccatatgtctgtgcaagcagtattg

SEQ ID NO: 1073 - DNA, 26 bp, Artificial Sequence
  Description of Artificial Sequence:  Novel Sequence
cccgctcgagatcctgtgccaatgcg

SEQ ID NO: 1074 - DNA, 31 bp, Artificial Sequence
  Description of Artificial Sequence:  Novel Sequence
gcggatcccatatgccgtctgaaaaagcttt

SEQ ID NO: 1075 - DNA, 27 bp, Artificial Sequence
  Description of Artificial Sequence:  Novel Sequence
cccgctcgagaaataccgctgaggatg

SEQ ID NO: 1076 - DNA, 33 bp, Artificial Sequence
  Description of Artificial Sequence:  Novel Sequence
cgcggatccgctagcatgaagcggcgtatagcc

SEQ ID NO: 1077 - DNA, 31 bp, Artificial Sequence
  Description of Artificial Sequence:  Novel Sequence
cccgctcgagttccgaatatttggaactttt

SEQ ID NO: 1078 - DNA, 31 bp, Artificial Sequence
  Description of Artificial Sequence:  Novel Sequence
cgcggatcccatatgggcacggcgggaaata

SEQ ID NO: 1079 - DNA, 26 bp, Artificial Sequence
  Description of Artificial Sequence:  Novel Sequence
cccgctcgagataacggtatgccgcc

SEQ ID NO: 1080 - DNA, 33 bp, Artificial Sequence
  Description of Artificial Sequence:  Novel Sequence
gcggatcccatatgtttcgtttacaattcaggc

SEQ ID NO: 1081 - DNA, 26 bp, Artificial Sequence
  Description of Artificial Sequence:  Novel Sequence
cccgctcgagcggcgttttatagcgg

SEQ ID NO: 1082 - DNA, 32 bp, Artificial Sequence
  Description of Artificial Sequence:  Novel Sequence
gcggatcccatatggcttttttggcggtaatg

SEQ ID NO: 1083 - DNA, 28 bp, Artificial Sequence
  Description of Artificial Sequence:  Novel Sequence
cccgctcgagtaacgtttccgtgcgttt

SEQ ID NO: 1084 - DNA, 29 bp, Artificial Sequence
  Description of Artificial Sequence:  Novel Sequence
gcggatcccatatgttgcccacaggcagc

SEQ ID NO: 1085 - DNA, 26 bp, Artificial Sequence
  Description of Artificial Sequence:  Novel Sequence
cccgctcgaggacgatggcaaacagc

SEQ ID NO: 1086 - DNA, 30 bp, Artificial Sequence
  Description of Artificial Sequence:  Novel Sequence
gcggatcccatatgccgtctgaagcagtct

SEQ ID NO: 1087 - DNA, 31 bp, Artificial Sequence
  Description of Artificial Sequence:  Novel Sequence
cccgctcgagatctgttgtttttaaaatatt

SEQ ID NO: 1088 - DNA, 33 bp, Artificial Sequence
  Description of Artificial Sequence:  Novel Sequence
gcggatcccatatggataattctggtagtgaag

SEQ ID NO: 1089 - DNA, 27 bp, Artificial Sequence
  Description of Artificial Sequence:  Novel Sequence
cccgctcgagaaacgtatagcctacct

SEQ ID NO: 1090 - DNA, 31 bp, Artificial Sequence
  Description of Artificial Sequence:  Novel Sequence
gcggatcccatatggataccgctttgaacct

SEQ ID NO: 1091 - DNA, 28 bp, Artificial Sequence
  Description of Artificial Sequence:  Novel Sequence
cccgctcgagaatggcttccgcaatatg

SEQ ID NO: 1092 - DNA, 33 bp, Artificial Sequence
  Description of Artificial Sequence:  Novel Sequence
gcggatcccatatgacctttttacaacgtttgc

SEQ ID NO: 1093 - DNA, 30 bp, Artificial Sequence
  Description of Artificial Sequence:  Novel Sequence
cccgctcgagagattgttgttgttttttcg

SEQ ID NO: 1094 - DNA, 31 bp, Artificial Sequence; identical to SEQ ID NO: 1003
  Description of Artificial Sequence:  Novel Sequence

SEQ ID NO: 1095 - DNA, 28 bp, Artificial Sequence
  Description of Artificial Sequence:  Novel Sequence
cccgctcgagtttgtttttgcaagacag

SEQ ID NO: 1096 - protein, 228 aa, Neisseria gonorrhoeae
MYALTAAQQQKALFRLVLFHILIIAASNYLVQFPFRIFGIHTTWGAFSFPFIFLATDLTVRIFGSHLARRIIFWVMFPALLLSYVFSVLFHNGSWTGLGALSQFNTFVGRIALASFAAYALGQILDIFVFDKLRRLKAWWIAPAASTVIGNALDTLVFFAVAFYASSDEFMAANWQGIAFVDYLFKLTVCTLFFLPAYGVILNLLTKKLTALQTKQAQDRPVPSLQNP

SEQ ID NO: 1097 - protein, 287 aa, Neisseria meningitidis; identical to SEQ ID NO: 898

SEQ ID NO: 1098 - DNA, 36 bp, Artificial Sequence
  Novel Sequence
ggaattccatatggccatggagacctattctgttta

What is claimed is:

1. An isolated nucleic acid molecule comprising an open reading frame, wherein the open reading frame comprises:
   (a) a nucleotide sequence selected from the group consisting of SEQ ID NO: 125, SEQ ID NO: 127, SEQ ID NO: 131, SEQ ID NO: 463, SEQ ID NO: 465, SEQ ID NO: 569, and SEQ ID NO: 571;
   (b) a fragment of (a) at least 25 nucleotides in length;
   (c) a nucleotide sequence completely complementary at the same length to (a) or (b); or
   (d) a nucleotide sequence having 90% or greater sequence identity to (a), (b) or (c).

2. An isolated nucleic acid molecule comprising an open reading frame, wherein the open reading frame comprises a fragment at least 25 nucleotides in length of a nucleotide sequence selected from the group consisting of SEQ ID NO: 125, SEQ ID NO: 127, SEQ ID NO: 131, SEQ ID NO: 463, SEQ ID NO: 465, SEQ ID NO: 569, and SEQ ID NO: 571.

3. An isolated nucleic acid molecule comprising a nucleotide sequence completely complementary at the same length to a nucleic acid molecule according to claim 1.

4. An isolated nucleic acid molecule comprising an open reading frame, wherein the open reading frame comprises a nucleotide sequences having 90% or greater sequence identity to a nucleic acid molecule according claim 1.

5. An isolated nucleic acid molecule which can hybridize to a nucleic acid molecule according to claim 1 under high stringency conditions.

6. A recombinant vector comprising:
   (a) an isolated nucleic acid molecule according to claim 1; and
   (b) control elements that are operably linked to said nucleic acid molecule whereby a coding sequence within said nucleic acid molecule can be transcribed and translated in a host cell, and at least one of said control elements is heterologous to said coding sequence.

7. A host cell transformed with the recombinant vector of claim 6.

8. A method of producing a recombinant polypeptide comprising:
   (a) providing a population of host cells according to claim 7; and
   (b) culturing said population of cells under conditions whereby the polypeptide encoded by the coding sequence present in said recombinant vector is expressed.

9. An isolated nucleic acid molecule comprising an open reading frame, wherein the open reading frame comprises a nucleotide sequence selected from the group consisting of SEQ ID NO: 125, SEQ ID NO: 127, SEQ ID NO: 131, SEQ ID NO: 463, SEQ ID NO: 465, SEQ ID NO: 569, and SEQ ID NO: 571.

10. A recombinant vector comprising:
    (a) an isolated nucleic acid molecule according to claim 9; and
    (b) control elements that are operably linked to said nucleic acid molecule whereby a coding sequence within said nucleic acid molecule can be transcribed and translated in a host cell, and at least one of said control elements is heterologous to said coding sequence.

11. A host cell transformed with the recombinant vector of claim 9.

12. A method of producing a recombinant polypeptide comprising:
    (a) providing a population of host cells according to claim 9; and
    (b) culturing said population of cells under conditions whereby the polypeptide encoded by the coding sequence present in said recombinant vector is expressed.

* * * * *

UNITED STATES PATENT AND TRADEMARK OFFICE
CERTIFICATE OF CORRECTION

PATENT NO. : 6,914,131 B1
DATED : July 5, 2005
INVENTOR(S) : Scarlato et al.

It is certified that error appears in the above-identified patent and that said Letters Patent is hereby corrected as shown below:

Column 1,
Lines 3-5, should read
-- This application is a continuation-in-part of international patent application PCT/IB98/01665, filed Oct. 9, 1998, from which priority is claimed under 35 U.S.C. § 120, which claims priority to Great Britain Patent Applications No. GB 19970023516, filed November 6, 1997; No. GB19970024190, filed November 14, 1997; No. GB19970024386, filed November 18, 1997; No. GB19970025158, filed November 27, 1997; No. GB19970026147, filed December 10, 1997; No. GB19980000759, filed January 14, 1998; and No. GB19980019016, filed September 1, 1998. --.

Signed and Sealed this

Twenty-seventh Day of September, 2005

JON W. DUDAS
*Director of the United States Patent and Trademark Office*